United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 33

SEQ ID NO: 179910 - protein, 110 aa, Triticum aestivum
  unsure (1)..(110): unsure at all Xaa locations
  Clone ID: PAT_TA_74328.pep
MARTKQTARKSTGGKAPRKQLATKAARKSAPTTGGVKKPHRYRPGTVALREIRKYQKSTELLIRKLPLQRLVREIAQDFKTDLRFQSHAVLALQXAXEAYLVGLFEDTNL

SEQ ID NO: 179911 - protein, 123 aa, Triticum aestivum
  Clone ID: PAT_TA_74329.pep
LSGCLSLSLSRSLSGAVPVWRRLAGRRCFLPVQALRRTSRSGLLMGQELLTAPTRTAPLLAAASRAQVISSCHGRILERTTLLTSSAARSREAPCIQEWRREPPRLNVLTCQHLEARIRGRPE

SEQ ID NO: 179912 - protein, 128 aa, Triticum aestivum
  Clone ID: PAT_TA_74330.pep
KKYYSFPFILIFSMDRNIKDWPTTLINHNDETYGQTWRHSSCVRQQGSPGNVAQQNSTFSGPCLLPMHIFGNGVSSLPMASPSERRGQPDLPISPSVEETNMSMEHPRSTMNKTAAALASIWPLSLLN

SEQ ID NO: 179913 - protein, 124 aa, Triticum aestivum
  Clone ID: PAT_TA_74331.pep
PTAAQAVGARGGGAGGGGGGGGGGRAARSGTKSARRRSWGRRGGWGGAAAARGRQRRATSGSASEPPGRRRRGPRTGRGRRTGRRAAAAAAPPRPSPRQAARPNPWPLPWWPGANWLTGVCGGD

SEQ ID NO: 179914 - protein, 68 aa, Triticum aestivum
  Clone ID: PAT_TA_74332.pep
QRPRRCFLLTTAKVTKWDCPYCSTKPNTKDGRFDHLLSYAEDVAIHGEDYMIKGRACRPREGPDFRVM

SEQ ID NO: 179915 - protein, 91 aa, Triticum aestivum
  Clone ID: PAT_TA_74333.pep
WAFPLFFLSWGRRTRITKGFPLPTPFAWVLSSEPTKNPSFNFVLGESIPKGYILHAFQPQLFPGVNKNLGTLGSTVLFHEVIFDCLTPACL

SEQ ID NO: 179916 - protein, 103 aa, Triticum aestivum
  Clone ID: PAT_TA_74334.pep
RSNNFTKEIHYPPSRFKGSLKSREPSFSTKTKLLWVSPFLPRGNENLKRRSGSTSQYRLGLARPKNTPGYPSWFWAPQHSQWPNTPGHQNKPFIPCEHTPNRV

SEQ ID NO: 179917 - protein, 192 aa, Triticum aestivum
  Clone ID: PAT_TA_74335.pep
MANPRVFFDMTVGGAPAGRIVMELYKDAVPRTVENFRALCTGEKGVGKSGKPLHYKGSSFHRVIPDFMCQGGDFTKGNGTGGESIYGEKFADEKFVHKHTKPGILSMANAGPNTNGSQFFICTVPCNWLDGKHVVFGEVVEGMDVVKNIEKVGSRSGTCSKQGVIRRLGPALDSSRPPGWSSSPRVPVSRSK

SEQ ID NO: 179918 - protein, 61 aa, Triticum aestivum
  unsure (1)..(61): unsure at all Xaa locations
  Clone ID: PAT_TA_74336.pep
GERXAEGHYPSXXXYQPLLLNNIYNLPNHLIKLRARMGLGNGSRQLLERALLATCAEGEPP

SEQ ID NO: 179919 - protein, 61 aa, Triticum aestivum
  unsure (1)..(61): unsure at all Xaa locations
  Clone ID: PAT_TA_74337.pep
TPPGPTPTRSSRGPAPGTSSSSTPPDPRSTPSPSPSPRTPGRGGSXXPPLXSGRAGSPSAP

SEQ ID NO: 179920 - protein, 286 aa, Triticum aestivum
  unsure (1)..(286): unsure at all Xaa locations
  Clone ID: PAT_TA_74338.pep
RVYDAQPLHSTPSPSASSPHLSPPTTILHIVPPPTPLSPTPFPTLPTPSSPPXPFSSPPLPTTPPQSIPXPPSSAPLSPSPLHLPPFSPSQHISLPPLHSNSIXPPPSSTLPPLPLSNSPHPSSSSPIPPTPIPLSXPPPLLSPSLHSHSHPSTSYPSLFYPPPHPLPQLPPTTPLPLSLSPSPPLLHTLTPPLLSPPLPTLPLPXNPHPPLSRFLSLPPTPPSSFTLSPPPLDSPFPPLQSPSSSFSHPILSHPLIPLLFLLRILSSLYSPYLLSQHSDSPLLIL

SEQ ID NO: 179921 - protein, 111 aa, Triticum aestivum
  Clone ID: PAT_TA_74339.pep
RPEIYIYPHSKPHHGESTSCPRPPSSTARSSLYNRPLAPSYYLHSAYYPTHLCRHGMIYQSTPLGLPFALQVRHPAPLSTLASRVTPRLLFISRPHTTSLIDVHWSPCYVP

SEQ ID NO: 179922 - protein, 158 aa, Triticum aestivum
  unsure (1)..(158): unsure at all Xaa locations
  Clone ID: PAT_TA_74340.pep
QYGIKEEKKAGRQRREPEERAARWEAKQKRRRRNAKKREHKQRGKEEXNREQIERKRKQTEETRRRLIGWHEXETNRQREIMQTMKQSERKPIERRKXRREKRKNRGQRKVESRETSEGNERKTATQTTGERGEDKAERRKNSTASQGKQRNQRRKQK

SEQ ID NO: 179923 - protein, 156 aa, Triticum aestivum
  Clone ID: PAT_TA_74341.pep
PCSSNGERMCFAVVYQVWWARRPCVVRLSYPLVFQCLSSLSLLSFPLLCLLVPFAKSQTGGLSQGLDPASHGILILKNPTRATAYAAGYCFDRWTAVSRCRRLCLPTADLRPKSELLSNFHSGSTSPDPQGNPVDPVSPGQKTESAQIKKPNVKPH

SEQ ID NO: 179924 - protein, 77 aa, Triticum aestivum
  unsure (1)..(77): unsure at all Xaa locations
  Clone ID: PAT_TA_74342.pep
QPFSQPQQPFPQQPEQIIPQQPQQPFPLQPQQPFPQQPXQIISQQPQQPFPLQPQQPSPQQPQLPFPQPQQPFVVVV

SEQ ID NO: 179925 - protein, 268 aa, Triticum aestivum
  unsure (1)..(268): unsure at all Xaa locations
  Clone ID: PAT_TA_74343.pep
RRFLIFVLAMTMSIITTARQLNPSEQELQSPQQPVPKEQSYPQQPYPSHQPFPTPQQYSPYQPQQPFPQPQQPTPIQPQQPFPQRPQQPFPQPQQQLPLQPQQSFPQPQHPIPQQPQQSFPQQPQRPEQQFPQQPQQIIPQQTQQPFPLQPQQPFPQQPQRPFAQQPEQIISQQPFPLQPQQPFSQPQQPFPQQPGQIIPQQPQQPSPLQPQQPFSQXQPQRPQQPFPQQPTTINSSGTHNKPFPLQPXQPGPQTNKKDHFGQQPKTN

SEQ ID NO: 179926 - protein, 155 aa, Triticum aestivum
  unsure (1)..(155): unsure at all Xaa locations
  Clone ID: PAT_TA_74344.pep
KRSVSHLLTSAVTFNADPPWMLNLYKSTGMYLDRATLDDLLKPSFSNSMETLYNVNCMQRILEHFVAMDQNTAGGGASPGSAASXSLIGSPXLTPITTVAKLTDGYXLAEVAPGAYLKLXRFRKLDAAGPEYRKASCPWALYRPIDMYLKAFDYP

SEQ ID NO: 179927 - protein, 167 aa, Triticum aestivum
  Clone ID: PAT_TA_74345.pep
GCGSARGDSGRISEEGMDLSCSESLDLSLGLHPHAHAPCSRARARRHAAWDVQHWDDFKTEGSAVAVATAMTVTTWLRPTVFGSRAIAFVQAPVPGSSMAGGGGGENPLLVVLCPSADMRPFETSLIFGRSISKASNHRNSRALGEILPLCGDPYRLLAPLSLYIIA

SEQ ID NO: 179928 - protein, 113 aa, Triticum aestivum
  Clone ID: PAT_TA_74346.pep
PTSPKIFFLHHIIYNLYNLSTFYTPQHNLHYLPNPTLFTHNYLLPLQISHNISLTTTFKLYTPHYSTSISYSTLLTPINTFLLHLHYFYYPYLSSDTTTYHSTILSYNSSYTS

SEQ ID NO: 179929 - protein, 118 aa, Triticum aestivum
  unsure (1)..(118): unsure at all Xaa locations
  Clone ID: PAT_TA_74347.pep
HYLHLCTXPYWLTPYSLSSTNCIIHDVRNIHSHRDNIILLFMMSVVHYXVAPLKYAVYARSXFFPSGASVSLSSSGLDIVPSQXAMCFANVSRALLYRRRIHPCARVEMYVKPRMLLR

SEQ ID NO: 179930 - protein, 74 aa, Triticum aestivum
  Clone ID: PAT_TA_74348.pep
PVLFRIRRPPNQRWGFFIFRFPPPVRHKGGLIGPPLQDIFVGRESSRWGNTQSHPKQYYSGNSRTQWNISLRAI

SEQ ID NO: 179931 - protein, 126 aa, Triticum aestivum
  Clone ID: PAT_TA_74349.pep
PPQHYTSYSHSTTYNFTISHTHFLTIQTFLYSINNHSFLTLNNLHINLIHTHHYTISLYSHLFFIYSSIYKHPILITPYYKQPNLHFITRSYPTQFIPSISIPYISILYIHHSIYSLPSHLSHKCL

SEQ ID NO: 179932 - protein, 199 aa, Triticum aestivum
  unsure (1)..(199): unsure at all Xaa locations
  Clone ID: PAT_TA_74350.pep
GHNQSSLWGTTSLRSFSQGXPKDHLPARHWNLXEGPVWTRGLPRGLLGPPFGNLRYPVTLLGQVVPNSLPGGGWTMFFRNKSXFSGFLVACRNGRSRKAARANPMNRSQAGQXSSPVSIHEYLLHGETCSPQRSERSYVDKAPALVLQEHIIVEPSLRDVVVSIAKSRTCECALSYTCAYACCRAGAIDMYLHRDCMHR

SEQ ID NO: 179933 - protein, 123 aa, Triticum aestivum
  Clone ID: PAT_TA_74351.pep
PYTHPHYHLHSIDTIYIITTFTYTTPNQLPKLSLHHPPELILNMSLNTGDSFTSQHTNLSTLTPTRIISPFNTHDHHMRDSLYTLISSISSQETHLDIISHSYQSISFHRYHTLAQSSHDNLL

SEQ ID NO: 179934 - protein, 121 aa, Triticum aestivum
  Clone ID: PAT_TA_74352.pep
ISYQHYTHDHITYNSNITNNTLKNTFSNIHHIYILMTSQHIIRLTLLYILTESSSPSLINTLTYDCFFHVYISLNHHPNNPNINFMVHLRPSNHTIHSSTHYFLLPFLLQPFTHILNIFFM

SEQ ID NO: 179935 - protein, 115 aa, Triticum aestivum
  Clone ID: PAT_TA_74353.pep
VAALIRGILGSSQGCIVALGVGYVYFSVVGSWAEERRDSLGSGRLSVYIALLVGGEVKSLRTGHRAHDVESMSVPLLVICGLNVMDGVWFEAGNIERSGEGYSLYGISAVKKTPR

SEQ ID NO: 179936 - protein, 93 aa, Triticum aestivum
  unsure (1)..(93): unsure at all Xaa locations
  Clone ID: PAT_TA_74354.pep
LSYIIHNDVAWSLDAYRSTIRLMGSRYNRLQHKYIQTYTDESLNTTLEETHTTYIVYXTRPRSNIIRSSRNTDELYLQNAPMHDTICCTRTYI

SEQ ID NO: 179937 - protein, 71 aa, Triticum aestivum
  Clone ID: PAT_TA_74355.pep
IFLLYQQRNNIYGDCFFLIITPHILGREQYLAALSLIEVFYPHINKPTRSYKYVLFYHLYFFQTILLFLPS

SEQ ID NO: 179938 - protein, 82 aa, Triticum aestivum
  Clone ID: PAT_TA_74356.pep
HDASDAQHDSQHTDYRVTLATCPVDLTIQSHTLTSEITLTRDQRCDIIYTLLDTFTIDMLLTLYYHSIYSECNNRQYVTHNA

SEQ ID NO: 179939 - protein, 119 aa, Triticum aestivum
  unsure (1)..(119): unsure at all Xaa locations
  Clone ID: PAT_TA_74357.pep
QATRMLYLIVRDRAEHDQLHTYLYTVYVXAHDSTPDSFTHHGVLRCSIEXAXNSIGCCTLIVSSTVYHISLRTVVHILYARTRLLVVCVARQDRRNAHIYIRLRDCVSVGGIRYLICSH

SEQ ID NO: 179940 - protein, 207 aa, Triticum aestivum
  unsure (1)..(207): unsure at all Xaa locations
  Clone ID: PAT_TA_74358.pep
WPLRERVFFFFFFFSGCPLNFFSFSFCLSSLSYFTLFTSSLVYLLLSFFFLVLLLTFFLYLSVPYLSFFSCLYLPLSYILFLSFLLSYNRLLFLYSHVALYFDCPHYVLIISYYPHLFFTYSFSRXSTASVDSLFSPYRCLLFVVVCVYLLYFELTILSFKLCFLFFLILYVFILPFLYPLLSFVSTSSLFFCLRYPLISTSFLFSF

SEQ ID NO: 179941 - protein, 302 aa, Triticum aestivum
  unsure (1)..(302): unsure at all Xaa locations
  Clone ID: PAT_TA_74359.pep
GGAHPQNTKRGREDRGGHKTESGKPRTQETATKXERETRTRDTGSGEETDGERGNTEGQEKTEAGTRTSGRRGQPETPRQRERXKEPQRKKSKARNRHQPNMARKKRKRGNGARAKQGKRRDRERGERRKPLGGEGEKPRKGDPKKTETANRGRGRTSERGEPRHRTRAKITRRPANTRTTRQRGQAHETRNHTRGXRKKTQQNARGASRDRATRXRQERTTRRTRGGRATNGAKIRETRXRRWRNSQRARSDRTTHAHGRRTTRRPQPRDKDGTNMARANRTQTPQNEHPQNKRWAKLTGT

SEQ ID NO: 179942 - protein, 275 aa, Triticum aestivum
  unsure (1)..(275): unsure at all Xaa locations
  Clone ID: PAT_TA_74360.pep
TSQILLLRRTPVRSNLSTSFLLCSRTRFTSLFRIVTSLPFKSPPVPLILAPNSSFTYNSISHWHNILHNCTTLSLRHLYPISLANLFSLIPTSISLPIPYPHPNSHTHITPATQNFXPHLSSIPPLFYLSLTLSTSIPLFAFDCRTLRFPLSETILPLAYLLAIPLLTSIFGSLASLFLPAAFLIRHFYSAILLSVLPTLSSCLSFFSSICMSQYAILICCPTNFRKSGNTNYLPALHPLLFIPNFAIFHYRQLPSFPFRLYMHTSPILSNTSHP

SEQ ID NO: 179943 - protein, 218 aa, Triticum aestivum
  unsure (1)..(218): unsure at all Xaa locations
  Clone ID: PAT_TA_74361.pep
SPISIPYPFFSHYHYTFSIHTLYSIFHHPLXXTILPPISSSINFHLPLYLTIIFSFSSPSPLNLITLSASDLLFVLPITNLTFFLSSYLDLLPLLYCHHSCIIXQXFILSYFYYMYPLQHSFXLIRHCLLLFLPHNIVHISLSFIHSILLFHFPFRISHSPLPLSHSYLIISSYLSFFYFFSLYLFLPICHFCNVHPSTLNILSFSSTSSILLLSPIP

SEQ ID NO: 179944 - protein, 145 aa, Triticum aestivum
  Clone ID: PAT_TA_74362.pep
RRPARSPRELCPGHTCQAWTPLRNSGGGFLLGRGFRTLSRLGPPPLKKWPTLSPPSKFAAPKNDFLIQLGFSMPDWFYDFQKPINVPSIRPSRQNPKLNSDFPFFPIFYFFGVLWAKEPLIDACAAVPCGPFIYRVPHLFCPVHP

SEQ ID NO: 179945 - protein, 128 aa, Triticum aestivum
  Clone ID: PAT_TA_74363.pep
KGGNLFMKILLTLYMMPFAPRTIKFSLPRVVQFLAKKGKKKKGSIAYGKFTWAHPGFQSWKTTSPPPMAWDSHRPAGQYLDICPRSPSHVYIGVTPWGKSTAPMSQTCRKQILRAPPPAWGFRGTPPP

SEQ ID NO: 179946 - protein, 35 aa, Triticum aestivum
  Clone ID: PAT_TA_74364.pep
SYRSTTTIPCNRYLIEGLIYAPDLHQQSGAMPCLL

SEQ ID NO: 179947 - protein, 114 aa, Triticum aestivum
  Clone ID: PAT_TA_74365.pep
LPYGAYMPYPHIFLFGRVHHLHSLEWRKLNMLSYNWAMVWNSISDGDDAGYSCPSGMMEKLQELIFFIPCPGSGQDNLVADIGRRYQRCSRRRRAVGGEQNQARYSACLPHGQS

SEQ ID NO: 179948 - protein, 140 aa, Triticum aestivum
  Clone ID: PAT_TA_74366.pep
VAQDRVHSKANLLKKHMRSEDVCELCHKESETTNHLLFDCCRVAALWPALGIPQPLCCRSIWDAKPASPTADGCWSTVRLLLLWRIWNHRHQVVFQGMRPSITRLVKAAAADLSDWAFRLKPIDRSSLLDWRPILLTISV

SEQ ID NO: 179949 - protein, 72 aa, Triticum aestivum
  Clone ID: PAT_TA_74367.pep
CCQCASHLGSLMVKCIFVRRWELACRNCTTLLCCTERLVTIRAKLKEVIHIAECDSLFFTEAAKVSADVIID

SEQ ID NO: 179950 - protein, 147 aa, Triticum aestivum
  Clone ID: PAT_TA_74368.pep
RTSYSFFLSPTGPSSTLSPPLHASSSLLDKRCAPLVMWMLGTSSEIRRKHQKRPVARWQQARYGRPAAAAFTSRWAARLARASPSIPRRPTYIHGWIGAPARRHELGAPLSEIRRKHLPGGRPCHQVTRSRADRGTQQLHRSSGNQI

SEQ ID NO: 179951 - protein, 41 aa, Triticum aestivum
  Clone ID: PAT_TA_74369.pep
CCCTNPNSRLFFAFPGQVNSCKVNVFQSFGCLMPLMNLFES

SEQ ID NO: 179952 - protein, 75 aa, Triticum aestivum
  Clone ID: PAT_TA_74370.pep
MGVIYRCKRPSNARLLSNLYSLKMNHRTHIWVAKKFFSMSIGCASRKVPKWLTRIVGGVLTRSTFSLFYDRLNNR

SEQ ID NO: 179953 - protein, 98 aa, Triticum aestivum
  Clone ID: PAT_TA_74371.pep
CTLHSQWRTHMSGLRINDVHAAAGSSPSGSWSRSQHLVSSLMDAYIDLNLFHFRWKHAMLSRHTCSPFHHGSLACRLGFHVSSSQRLQRSCILGEGKS

SEQ ID NO: 179954 - protein, 49 aa, Triticum aestivum
  Clone ID: PAT_TA_74372.pep
SKDPVGMSCCYMCACCSYKIVELSFFLRTFCGPLSWSACAFFRSKVSLL

SEQ ID NO: 179955 - protein, 76 aa, Triticum aestivum
  Clone ID: PAT_TA_74373.pep
WLPVAVKYHSCYFLFPYVESDWNAFLNRPHCVHKELLLHVLRRLIYICSMKICSFLVKNTTSSFLMYSFPRFVSQL

SEQ ID NO: 179956 - protein, 60 aa, Triticum aestivum
  Clone ID: PAT_TA_74374.pep
SHQGHCSWICQPAACCTRYSRIMQVLTIHTYPCMLVSPRVSMNSGDAFIYDYAPPFAPIL

SEQ ID NO: 179957 - protein, 137 aa, Triticum aestivum
  Clone ID: PAT_TA_74375.pep
IVSGGDDQAVQCFVFTLGPLPGCSANTASLSSPCDNGELKILGQHTVPSAHGSAVKGIWTDGAWAFSTGLDQRIRCWKMGQSGKFAEHSHVIISVPEPETLDVFHDRGSGKYRIAVAGRGMQMVELSPPEDDSMKIA

SEQ ID NO: 179958 - protein, 70 aa, Triticum aestivum
  Clone ID: PAT_TA_74376.pep
NLENPFVNKCNRLFSGFMRVSSFFLEQRNFIGKPIGIFLLGPLDCRKGPMKFWIYYLYKIFPSFPFWRGF

SEQ ID NO: 179959 - protein, 162 aa, Triticum aestivum
  Clone ID: PAT_TA_74377.pep
RDMSEVVTRMRGTPGYLAPEWLTSQITEKADVYSFGVVVMEIISGRKNLDTSQPEESIHLITLLEEKVKSDQLADLVDKQSDDMQVNKQEVIRMMRMAMWCLQIDCKKRPKMSEVVKVLEGTINTGNNIDYKFVATTTVNFGVAGDACSSAPPLASDVSGPR

SEQ ID NO: 179960 - protein, 100 aa, Triticum aestivum
  Clone ID: PAT_TA_74378.pep
PPAPPQRPSPPPLLPPPPPPLLPPPPPPPLRRCYRSLGYVSARAAGDARGVTVGPGTGARARRDGNESCPHSFCSPSPASSQPWPRCSRERERERERGGE

SEQ ID NO: 179961 - protein, 156 aa, Triticum aestivum
  Clone ID: PAT_TA_74379.pep
SELCSDPSLRYIFLLNNSHFVAQVSEPSVSLYLEQRSELNLTPECKKFMDSYLDVSWGHVLSCIPKSRFPGPIHCWINTSSLAKFESAFQKTYRAQKFWKVPDPRLRDVLQRAIAERVISGYGDYLEEHPELEKHIGRESSSPEVFKKMLGELFEG

SEQ ID NO: 179962 - protein, 76 aa, Triticum aestivum
  Clone ID: PAT_TA_74380.pep
LLFPCVTSFFSSPLSWFARHRCPSPSSPSLYPRDPPPPIGEKGPPRKIIFPFPLSATARMPLYIFWPPPVFISFAY

SEQ ID NO: 179963 - protein, 92 aa, Triticum aestivum
  Clone ID: PAT_TA_74381.pep
SRAAQQAAREAYYAPLLVRARVAASHGQTGVRPCLPFLSPLVGAGREGCWTLDMSKHRTALPRKFLCLHLEIAMKFLLCVWCSISLYPVLAV

SEQ ID NO: 179964 - protein, 77 aa, Triticum aestivum
  Clone ID: PAT_TA_74382.pep
YLNIVIIQIECISMVTMHGSILLGPSAQCQQISTWMHPRAIPTSRSHVVDGCSEHHCVTETMYLSQPTTGCGIHRPP

SEQ ID NO: 179965 - protein, 83 aa, Triticum aestivum
  Clone ID: PAT_TA_74383.pep
KARGHRVFFFYKREPQPGKGETNVTPPRGQRERGGKLGNSGNKAPRPKNNRGAKNTNGGRAGQNYPEGGPKILRPLDELFKCT

SEQ ID NO: 179966 - protein, 68 aa, Triticum aestivum
  Clone ID: PAT_TA_74384.pep
PNSARNFPVLAHRQCPFSVKKDGIMQLTFFRTWLSCLCFFSVVLTIWIYVHTYQMIRCFPKECGFGFP

SEQ ID NO: 179967 - protein, 143 aa, Triticum aestivum
  Clone ID: PAT_TA_74385.pep
MRYLFLLNNSYFIVQVSEPSGDNHGIKLTPECEKYMDSYLDASWGHVLPCISKSKFPGLLCCWINTSSHTKFESAFYQTYNAQKFWKVPDPLLRDALRIAITKRVISGYHNYLDEHPELKKQVRRESSGPDVLKEMLGQIFEG

SEQ ID NO: 179968 - protein, 179 aa, Triticum aestivum
  Clone ID: PAT_TA_74386.pep
FHQIRMKPGEEFKTAFKTHHGHYEFKVMPNGVTGGPSTFQGTMNIVLSPLLRKGVLVFIDDILVHSSTLEQHCELLRQVFQLLAKHQFYLKMSKCKFAQPRLTYLGHVISAAGVSTDDKNIAAVKDWPTPTNAREVRWFLGLAGYYRRFVRNFGIISRSLTNLLKKGAVFVRSEEAESV

SEQ ID NO: 179969 - protein, 114 aa, Triticum aestivum
  Clone ID: PAT_TA_74387.pep
QGCSRLCAPAWSCHPSSGRCSRPSLRRAPCRASSAPRSSPSPPGPGLPALLPPSRRRQRVRVPRRSPAYRTSSCAPPLWGSSPSPCTSSGGGRAAATERGLAQILSHKLLNPTA

SEQ ID NO: 179970 - protein, 61 aa, Triticum aestivum
  Clone ID: PAT_TA_74388.pep
DCGLNSQKPRDFPAKSLAKTSKRLVRCNGYKINLIIQVFESLPASRCLVRLTARQNSGTLT

SEQ ID NO: 179971 - protein, 84 aa, Triticum aestivum
  unsure (1)..(84): unsure at all Xaa locations
  Clone ID: PAT_TA_74389.pep
VVALQQQQIILPVACLALEFYMSSGDLLELDEEQWFGGMEDGSYYXASLAQGMLVAPPDERARPESGEQXRRPDAAMELLVRLI

SEQ ID NO: 179972 - protein, 80 aa, Triticum aestivum
  Clone ID: PAT_TA_74390.pep
KTIITLRFILHLLQCQNISIQAPLQSAVNRTEKYAFFFTLKGSELHPSTCFIIGANCNFLSKHFGHPRSFHKFSLRVFLM

SEQ ID NO: 179973 - protein, 98 aa, Triticum aestivum
  Clone ID: PAT_TA_74391.pep
GSLRALSSLSLRFYLSVYLFFLRETYLYIYLFTYVRFVGRAEEGESPLLLLLLVCSMMAGATSATAAAGAFAAAAAGAKARGTATACPWVVAAGGRRR

SEQ ID NO: 179974 - protein, 54 aa, Triticum aestivum
  unsure (1)..(54): unsure at all Xaa locations
  Clone ID: PAT_TA_74392.pep
RVKRGDVGRIMARKPKDVWTVRLAVGTYLXLDGKHFKPLEVVEDEGGDDQPQDE

SEQ ID NO: 179975 - protein, 52 aa, Triticum aestivum
  Clone ID: PAT_TA_74393.pep
GFFPKPKRGPVPKKGARGPGPPPWGPLPPPGPIGLFPPRVRSLGGGTPPLPG

SEQ ID NO: 179976 - protein, 88 aa, Triticum aestivum
  Clone ID: PAT_TA_74394.pep
LPPGRRNRESPLSGVDSFGPGPPLYRRYPCGPPVFSFPGLLPSAYYLRGTLWCLLPSGPVACFFVIRMACGLWPRSLFGSSCMVWFAP

SEQ ID NO: 179977 - protein, 42 aa, Triticum aestivum
  Clone ID: PAT_TA_74395.pep
ENAGGLIFNGGPIMGANTNGAFMKLGRKGPEYCRIYFPPYTY

SEQ ID NO: 179978 - protein, 129 aa, Triticum aestivum
  Clone ID: PAT_TA_74396.pep
TTSLPGGIDILSSKKSTTKLCATCRSSGAVAGELSAFSLCFKFWFILCTKLFCRFNATMAEFGQLKKSSLPWAGYLMVKLTRSTYQLVQLFGEICETFKLNAFTYDEMKLKSFGKTLTAKAKACLFSHP

SEQ ID NO: 179979 - protein, 113 aa, Triticum aestivum
  unsure (1)..(113): unsure at all Xaa locations
  Clone ID: PAT_TA_74397.pep
VLYESEPYKVLNISQYYRNLERERERERERERDKAAAAGKEEEARQGEEQQQARRKKQQGAXGRKRRGSEKRAEQQRGREKKEQQAGVQKRLGAATRGKGRREQRQEKKKTAA

SEQ ID NO: 179980 - protein, 75 aa, Triticum aestivum
  Clone ID: PAT_TA_74398.pep
RGARSRCNSKTARVTSREQQHPRKLTPACPFMSCLVFCWAWQWWPKINDRFLNGTRMTFGTRPLSLCIKIPRSRP

SEQ ID NO: 179981 - protein, 139 aa, Triticum aestivum
  Clone ID: PAT_TA_74399.pep
MDDAAAAAASKKRRRDLPALGDPPASREGAGGGDDASLDLISRLPDEILGTIISLLPGTKDGARTAILSSRWRHLWRSAPLNLAVDDALSSQESERIAVVSEILAAHPGPARRLCISSIFLGGHHHARFDGWFRSPALG

SEQ ID NO: 179982 - protein, 107 aa, Triticum aestivum
  Clone ID: PAT_TA_74400.pep
GLPFPVDSLYADPERKAYNVLGLYHGLGRTLFSPASAKIYSRLDSIKEATKNYTLKGTPADLTGVMQQGGMFVFRGKELLYAWRDEGTGDHAPLDDVLGICRQVPVA

SEQ ID NO: 179983 - protein, 128 aa, Triticum aestivum
  Clone ID: PAT_TA_74401.pep
SVRASSRCECMRAARGSHGSKTCLCLGRRTLGTAASLAMNLGSNEDDVRHGAERARLPAVPREREPSNIGRGEEDDDFVRSWRERRRAGGSQGCRHLVHALARVTQGCFVVGLGFRRLLSVYTGLQIS

SEQ ID NO: 179984 - protein, 94 aa, Triticum aestivum
  Clone ID: PAT_TA_74402.pep
KKTPPGGGPFSPEGEQNSPSKKAKGFKTQNRGTFLKANWPPKNWKKIFWGVGEKKNFQNKPFLKIFNGPRGGPLGPNFFSLGNPLGKGGFWFQK

SEQ ID NO: 179985 - protein, 135 aa, Triticum aestivum
  Clone ID: PAT_TA_74403.pep
SMSSSISSEEQRKAMIADTAVIDDDAPSAGQQKGVIKKKTKKKTFRLPNDELELILAFKPSVHYPDPIFSPVLEEKLPDTVRGVRPTMAKADAQAEVTDDEEEIIQVPRRGRRRHRPCISCSCNLMDPSNSIPAN

SEQ ID NO: 179986 - protein, 148 aa, Triticum aestivum
  Clone ID: PAT_TA_74404.pep
GSKLSSLTAKVHAFSVCDDPEYFYDYVQGLIDGLQSGLDSHDIVSIQNAKGLGYAMNTAEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 179987 - protein, 73 aa, Triticum aestivum
  unsure (1)..(73): unsure at all Xaa locations
  Clone ID: PAT_TA_74405.pep
PPANSGFGMPMQAFPQKSGFYVVAGPDPDIVLFRYKKKRGARGFFQPVRYXFPKACSGSRFRIKGRFAKANQS

SEQ ID NO: 179988 - protein, 81 aa, Triticum aestivum
  Clone ID: PAT_TA_74406.pep
VRVLPGCGHGFHVACVDAWLRTRATCPSCRAAIVATPMQMQVQPAATPTVVVVVAGSSSCRRCGQVTAPAGARAADGAFLA

SEQ ID NO: 179989 - protein, 148 aa, Triticum aestivum
  Clone ID: PAT_TA_74407.pep
GVSSMVDCGLLGDKCMNGIEPAASKNTTTCEPDVTSQAEFLVGSNFVTPRKSKLVDVTAPIASEEPLKTKSTLNSKGQNCGSVAGKTPGSYSKSASNTKSAPGDSSQPAGSSRKRKRKGWTTLKQIAEKEELERKQKMDNFVIPFFMQ

SEQ ID NO: 179990 - protein, 53 aa, Triticum aestivum
  Clone ID: PAT_TA_74408.pep
SSRTCLKDALVVQKFAYSRNIYTDQENWTMQLFLHLQKALNATNKCRKEGLCL

SEQ ID NO: 179991 - protein, 177 aa, Triticum aestivum
  Clone ID: PAT_TA_74409.pep
EFGTSGGQLNKFEVLGSPGFFAGWDPNPRRALEDVGTLLVSSTLRELCTDDVAGLLAAPIYSFLSSSLTKLILRGWGSKGMERFSKEQEDALQHLSSLQELEFRNFSDLQQLPATLCNLSRLKVLLIYCCPAGSSLLSEFSLPESLQELDVRLCRNEQLKQQCRGLVGTIPRIIIDW

SEQ ID NO: 179992 - protein, 134 aa, Triticum aestivum
  Clone ID: PAT_TA_74410.pep
CRKWLVDDFLAAAPSKKLGVVGFCYGGGRLVETLARDADAACFRAGVCFYGSRMDASLGARIAAPVLFVCGDGDPLCPVETVRELERSARGAKAAVYAGRGHGFAHRPESLEDDGDAEDAFAMMKSWFHDHLLA

SEQ ID NO: 179993 - protein, 183 aa, Triticum aestivum
  Clone ID: PAT_TA_74411.pep
NSARACTWPPRAPEPYVTKCLAKDRGSTSVLLGFRVSGVMVSDASGAVWRPDRSELKGTDIPGVRRMLRRYVSSAGGDGGGEDCALAAAVYGGEGGVLAQLRELKAWFEVQTLFHFYSASVLLSYDANAVTAPGGAPRVKLVDFAHVVESEGVIDHNFLGGLCSLIKFIDDIVSSDKAPPVQV

SEQ ID NO: 179994 - protein, 81 aa, Triticum aestivum
  Clone ID: PAT_TA_74412.pep
VFGEVYLTSCKPTDALAFSAWSMLYQSNMATVFKDVTLIHTKSFLLVVDPARPQVSNVQMYYYPDISSIYIYNVQMVERFA

SEQ ID NO: 179995 - protein, 187 aa, Triticum aestivum
  Clone ID: PAT_TA_74413.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIY

SEQ ID NO: 179996 - protein, 222 aa, Triticum aestivum
  Clone ID: PAT_TA_74414.pep
FGTRAAEGRGGEDEEGGVLVPALLARLAGAGDAEVRVLVMAALRRLAGCAGAETKERMASIEALSSIVRSLSRDVDERNEAIALLLDLSDIPQVRQRIGRIKGCIVMLVTLRNAHESGTYDDAEKLLHILSCNPQNVLLMAEAGYFRPLIHYLKEGSDMNKILMATAISKMFLSEQMKSSLGEDGAVEPLVEMFKSGNHEAKHSVLAALRNLSSSLQNAEIL

SEQ ID NO: 179997 - protein, 107 aa, Triticum aestivum
  Clone ID: PAT_TA_74415.pep
VQNNTQISEAGQLLNKHSSTTGVPEPEFMMATTRHRGAGPTLGRSYQQRPIKQPIAGRFSPFLSPGVFFLKKKNFQRAAMDERCAQPESTAPVRSPVTALPAGRRRH

SEQ ID NO: 179998 - protein, 179 aa, Triticum aestivum
  Clone ID: PAT_TA_74416.pep
EFGTSAGSPPPLPLLATGRRWAKLGPRRRRRGHSPASSSVGGAGRSGLGLSPTRVSLSSGGGGGFSGRGPWRRRRRWTQRARPASAAAGPSPFSSSSGLAPHDLFDSGDLSTSALAAAQRSTPPGPLAGSASGSSPASARGVGLLGLICKSPSPPCRLLPLTPSTGADDHERSCRSDGG

SEQ ID NO: 179999 - protein, 50 aa, Triticum aestivum
  Clone ID: PAT_TA_74417.pep
PPQVLNQVEEVKKEDPDANVRVIGFDNLRQVQWVNFIPFRPPGCKESAKA

SEQ ID NO: 180000 - protein, 205 aa, Triticum aestivum
  Clone ID: PAT_TA_74418.pep
IYKMSTAMASLVLAVLVLPSATTAAVATARRNCSDTCGMVGEIPYPFGLGPSCSLPGFSLTCADNTSYPMLGNLPIESFDIFGSNNLYANISYSYNYLYARISYTVKMIPSVRNYSVHWEAPARHFAMSGSSNMLFVVGCGVKASLFIGNSTFEVGNCYVLCAEARIMEKLPKGVCDGIGCCFIDIQVNLRAFTLNISRTSGSAR

SEQ ID NO: 180001 - protein, 135 aa, Triticum aestivum
  unsure (1)..(135): unsure at all Xaa locations
  Clone ID: PAT_TA_74419.pep
RRRAPSPPTATATPRPRWRPRRSRASWAPRARSRRRRSSGARRRRRAAEALRWPWPPRRAPPSRPSPAASSSPPAPAAWWATPPSPLPSLPKQGEKRPXSTGKRSRPPPPPPCRPSASSRLANHDSRAPAALTFN

SEQ ID NO: 180002 - protein, 125 aa, Triticum aestivum
  Clone ID: PAT_TA_74420.pep
MEGKEEDVRLGANKYSERQPIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFL

SEQ ID NO: 180003 - protein, 70 aa, Triticum aestivum
  Clone ID: PAT_TA_74421.pep
HMSTHMVVCLAPLIANKHISDRAAASYFLQYISRTMHRAAAPLQKLHPTDLLDGRNLVPKHTIVNTLWMW

SEQ ID NO: 180004 - protein, 99 aa, Triticum aestivum
  Clone ID: PAT_TA_74422.pep
MAYSGQRHAGAAGSSSRQGNGLKGQASSVEFLGRGMVGMQLRDAKPDDADDERDNEPDVVADSGSEAGQIIATTIRGRNGLPKQCVSYIAEHVVGTGSF

SEQ ID NO: 180005 - protein, 214 aa, Triticum aestivum
  unsure (1)..(214): unsure at all Xaa locations
  Clone ID: PAT_TA_74423.pep
IRHEPQCAVSSPPAPTNAANAAGGGKGRTQLAVAQVKKLCMQGRLEQARRLLLDALPRPPPTLLCNVLLIAYVAAALPDHALRLYALLNHAARPAPRSDHYTYSCALTACARSRRLRLGRSVHAHLLRRARSLPDTAVLRNSLLNLYASCARYRHDGVDVVRRLFDAMPKKNVVSWNTLFGWYVKTXRPDEALEMFLRMLEDGVRPTPVSFVNV

SEQ ID NO: 180006 - protein, 121 aa, Triticum aestivum
  Clone ID: PAT_TA_74424.pep
MLFQVGGQGARPTFFEMSAAQQLPASLRAALSYSFGVFALRRPSLHKVLDYEDEFFALLMSVLESHSLRTTDGSFSESLYGLRRRPVNVSVNRSSPGAESNVKVYDSALRKRQKTLSVIFL

SEQ ID NO: 180007 - protein, 185 aa, Triticum aestivum
  Clone ID: PAT_TA_74425.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDI

SEQ ID NO: 180008 - protein, 161 aa, Triticum aestivum; identical to SEQ ID NO: 157638
  Clone ID: PAT_TA_74426.pep

SEQ ID NO: 180009 - protein, 38 aa, Triticum aestivum
  Clone ID: PAT_TA_74427.pep
LTSVFTGKARISRSNNNNNNNNNNNNNNNKPSKHIMSR

SEQ ID NO: 180010 - protein, 208 aa, Triticum aestivum
  Clone ID: PAT_TA_74428.pep
NSARALMSPSQSAMAMAASRNAQVNVYVQNSRFLKAARELLDEVVSVRDAIKRKGDRKDDSAGNGECGKVEGDKGEENEGSSAAELSPAERQDLQNKVTALMAMLDQVDRRYRHYHQQMQMVVSSFDAVAGSGAARPYTALALQTISRHFRSLRDAIGAQVQSARRSLGEPQDGSGAGGLSRLRYIDQHLRQQRAMQQFGMMQQPQHA

SEQ ID NO: 180011 - protein, 143 aa, Triticum aestivum
  unsure (1)..(143): unsure at all Xaa locations
  Clone ID: PAT_TA_74429.pep
NSARAGTNLRKQVTSSANYHGKSSKANRFTVMAAENLDEKRNTDKWKGLAYDMSDDQQDITRGKGIADSLFQAPTGDGTHXAVLSSYEYVNQGLKKYDFDNTMGGLYMXPAFMDKLVVHLYKNFMTLPNIKVRTTCIITYYLI

SEQ ID NO: 180012 - protein, 46 aa, Triticum aestivum
  Clone ID: PAT_TA_74430.pep
MADREEEKAEAVREAEEEQEQQEEEYESDLDDAPLPAVRRRAAASD

SEQ ID NO: 180013 - protein, 237 aa, Triticum aestivum
  Clone ID: PAT_TA_74431.pep
DPKNSDQPTTTTGLRGFLGLTGYYRKFVHNYGLISKPLTQLLTKTGFEWNDQATEAFMTLKSVMARTPVLALPDFSVPFAVETDACDTGVGAVLMQRGHPIAYMSKALGVMNRKLSIYEKEFLAVIMAIDKWRQYLQRGPFTILTDHKSLCNLTDQQLTSDLQRKAMAKLIGLQFQFKYKRGVDNGAAYSLSRVAHRFETQTLSVCRPDWVQEVLNSYHTDTEMMTLLQQLAIHSPD

SEQ ID NO: 180014 - protein, 178 aa, Triticum aestivum
  Clone ID: PAT_TA_74432.pep
IRHEANWCYATVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSF

SEQ ID NO: 180015 - protein, 192 aa, Triticum aestivum
  Clone ID: PAT_TA_74433.pep
MYGQIWRLVPNACSPLPPIRAGAGRGSWPAGRPAPLRRPALASASASTRGLCRPLAVSAQSASLDAGVRVDKFFEVEMKVRDYELDQYGVVNNAIYASYCQHGRHELLESVGISADAVARSGESLALSEMHLKYFAPLRSGDKFVVKVRLASIKGIRMIFEHCIEKLPNHELIVEAKATAVCLHKDYRPTRV

SEQ ID NO: 180016 - protein, 80 aa, Triticum aestivum
  Clone ID: PAT_TA_74434.pep
NSARAGELEEGKLSSTNGNGSDQQAAEQDAHGPSATGHSTASMLRNASTLGDSILLIAALCFHSVFEGIAIGVAGKRQVG

SEQ ID NO: 180017 - protein, 104 aa, Triticum aestivum
  Clone ID: PAT_TA_74435.pep
MADQLSEEQIGEFKEAFSLFDKDGDGTDFRPPSLPPSALGDLAWTPSRSIRPGIGGPALPGVRLICAMRCAPRSDGVPGAILFSRSDLVVSAWFLMVIEAPARR

SEQ ID NO: 180018 - protein, 126 aa, Triticum aestivum
  Clone ID: PAT_TA_74436.pep
MAASLQAAATLMPAKIGGRASSARPTSHVGRAFGVDAGARITCSLQSDIREVASKCADAAKMAGFALATSALLVSGASAEGAPKRLTFDEIQSKTYMEVKGTGTANQCPTIDGGVDSFPFKAGKYE

SEQ ID NO: 180019 - protein, 125 aa, Triticum aestivum
  Clone ID: PAT_TA_74437.pep
LRAFRGTAASRRETTAGSAVAGRARTDRSRGSVPPSSFPPTPPPPAMPRVASDRRNLGHLPLPNPGGCSAKKILSLGHRVKDVDRPAHPPKVKKDKPILVPLLPRLPPPSPWTAAATVRRQQMTG

SEQ ID NO: 180020 - protein, 110 aa, Triticum aestivum
  Clone ID: PAT_TA_74438.pep
AARWLRQRCSTQETRVRSLVLTLFLFLFTKRSNGPAHVRVVAPPVFYIFFLFLFCFFPKNKFRIDGAPYFLFLFTFLFLFWFFISKLISDFQNIKQLRVLKKSRKMVNCL

SEQ ID NO: 180021 - protein, 219 aa, Triticum aestivum
  Clone ID: PAT_TA_74439.pep
IRHEPNVSDVFPALAAADLQGLRRQLARLFARLHLVFDREVDQRLRRRARDAAGEPRKENDDNDGGDFLDVLLDVAERDDDQAALLDRDTLRSLFSDLFAAGSDTTSSTIEWAMTELLQNQSSMDKAHDELTRVIGSGRDIEEPDIDSLPYLQAVIKETFRLHPPAPLLLPRQAQTTITVAGYTVPKGARVLVNVWAMGRDEAIWSEPEKFMPERFLGR

SEQ ID NO: 180022 - protein, 131 aa, Triticum aestivum
  Clone ID: PAT_TA_74440.pep
MEDGGGYSITFPDFPGGPDTFEAAAKFCYGVRVKLTPWNVAPLRCADEYLEMTEEHSEDNLAARAEAYLSQSVLRHPGEATKALKSCEELLPHTEELGIVARCVETIAARSSATSRSWFGDLAVLGLHMYK

SEQ ID NO: 180023 - protein, 85 aa, Triticum aestivum
  Clone ID: PAT_TA_74441.pep
SGDRSRPWPTSTGAAIETTRGLARERGAGGRVRSCSSSELWWRICTGPLTASRPDGHGSPHLSLTPRPPWAKTISDFWGAFWWRS

SEQ ID NO: 180024 - protein, 146 aa, Triticum aestivum
  unsure (1)..(146): unsure at all Xaa locations
  Clone ID: PAT_TA_74442.pep
MLSVRRRKEDAGGATGMADHAQLKDGEAYADDMPSFDDPYVSLAYIDEKLHNVLCHFXKDFEGGVYAENLGSKFDGYGSFLPTYQRFTXLPHTKTPPKVANASSRSTYHQSTEDVCQNPTAMAGPSVSQNNGSAAALSGDSIKKER

SEQ ID NO: 180025 - protein, 29 aa, Triticum aestivum
  Clone ID: PAT_TA_74443.pep
VQNIGPTIAINVPTATAVPRNLARAQPFF

SEQ ID NO: 180026 - protein, 136 aa, Triticum aestivum
  Clone ID: PAT_TA_74444.pep
ALAASARHGCNSNTGGFQRAVIMVGASLASPSPARRHCQLAASCTGCSKNQGCLQQKLGLLPRKENDGSPSLVAVVATPQRRPPRLSVTSRRHRQHRWGLVCSAGRWWGVRGRGGVSHGGGGAVATAGGTAARAEF

SEQ ID NO: 180027 - protein, 124 aa, Triticum aestivum
  Clone ID: PAT_TA_74445.pep
ASSLRRGHAMSASFHSKSLAICRAPALFVRRSRRGSSSARGSPGRRSFLAARLAGDPGRPPLPTLGSSPRLGSAPGSRGLGRAASYPPVSPVDGAGREGRGGEGFVAGGKRGLGPERGGARAEF

SEQ ID NO: 180028 - protein, 70 aa, Triticum aestivum
  Clone ID: PAT_TA_74446.pep
PIGPTTRRSCVSSAATSTSTSTSTATGSLTSVERSPSPPPSLSRTRAPTCAPTVALWSTSAAVSTSSCAP

SEQ ID NO: 180029 - protein, 183 aa, Triticum aestivum
  Clone ID: PAT_TA_74447.pep
EFGTSCLGLDRVAGEAAIHGAATSAHALLLLFLVPLVLLLVGAKRWNRRSKQRLNLPLPPSPPRALPVIGHLHHVGPLPHVSFRELASKHGRDLMLLRLGAVDTVVVSSPRAAAAVLRTHDHALASRSCSAVADIIFYKRTDVAFAPYGEPWRQARKVVTTHMLSAKKVHSFRHDREEEARIA

SEQ ID NO: 180030 - protein, 218 aa, Triticum aestivum
  unsure (1)..(218): unsure at all Xaa locations
  Clone ID: PAT_TA_74448.pep
DAAEQVVRVGQVGRDPHDLVQDGDGLLEPVLGEEQGGVAQLLDDLGAAPVPPPSRPPLPLAVLGPPPLLPPXGRTPPSAGRRGSPTPPRRARPAASASWRARPPAAAPRGGPSACATAPPGPRSRGCXTVATAPPGPXPPSPRTAPRPPRRRTRTPPPHPRRTPPRPRPPARTPPPPPPPPRLPPPSPASPKHGPRKAAEGVAPAGGESRGLEQPRAE

SEQ ID NO: 180031 - protein, 140 aa, Triticum aestivum
  Clone ID: PAT_TA_74449.pep
MKGAKSKGAAKADAKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKS

SEQ ID NO: 180032 - protein, 65 aa, Triticum aestivum
  Clone ID: PAT_TA_74450.pep
GSIPEREPEKRLPHPRKAAGAQITQSCNFSTANGLPSLSHARGLLADAVALVRREMPYWNRSAGA

SEQ ID NO: 180033 - protein, 154 aa, Triticum aestivum
  Clone ID: PAT_TA_74451.pep
IRHEEATTVTDNFVADLRYNPTSTLFVNVPCVSRLQWHPFSVTSSSSLEPDTLSVVIKNRGGWTQKLYETVSSLPPSGGHLGVSVEGPYSPAAGVTSFLGHDSLVMISGGIGITPFISVIRELVYQSSVAETASTPKLLLVCVFRTSAELDMLD

SEQ ID NO: 180034 - protein, 92 aa, Triticum aestivum
  Clone ID: PAT_TA_74452.pep
RCRHRACGNHRACRSGHPVSTFGCVLEMVTTGGGCACTLPVSDYTSRRGCLRWLFLTKTRPWTTLSSPAYLLSVTASLNLLCTTCSMPCILV

SEQ ID NO: 180035 - protein, 143 aa, Triticum aestivum
  Clone ID: PAT_TA_74453.pep
MRAPPLLALSTPHPARPPPHRPSRTGPGRTLFFSPRRRLLLAVARSKSRDDASFTDRILDYIEGGPKLRKWYGAPDLLPKDGGAEGEEDESSDIEEPRDAVLVTNGESEIGQMVILSLILKRARIKALVKDKRSTEEAFGTYV

SEQ ID NO: 180036 - protein, 87 aa, Triticum aestivum
  Clone ID: PAT_TA_74454.pep
EGGQVNKLHSCLKSQGSTWLLENQATYLTIDLILISLISLIVSNYSILNRDESRSNNRKRTCAGRRGSSGRWRRRRPWFAISPKETL

SEQ ID NO: 180037 - protein, 86 aa, Triticum aestivum
  unsure (1)..(86): unsure at all Xaa locations
  Clone ID: PAT_TA_74455.pep
MEAPLEPEPMALDAPTPLADADPAHADTEKTRTEGGDPVTGHIIXTTIGGKNGEPNRTINYMAERAAGTGSFGMVTHAKCLETGET

SEQ ID NO: 180038 - protein, 97 aa, Triticum aestivum
  Clone ID: PAT_TA_74456.pep
MGGRRWQLDAAAVIFRLLLLHGAFLFQLATSQSFIGVNYGTIADNLPPAASTASLLTSTSIGKLRLYEPQPDLVAALAGSNISILLGVPNSDVPSLA

SEQ ID NO: 180039 - protein, 128 aa, Triticum aestivum
  unsure (1)..(128): unsure at all Xaa locations
  Clone ID: PAT_TA_74457.pep
NSARARPDTARPKPPGHKPPPRLPPPSPPRRQPPPPSSSSSSSPPTPEKAXSPVRGPFDFGARFLLXPCFPWPGPSRPRPSXPGPPGPPPPPKSALGERPDSLDVRGIAARQASASSAVRAARTRAHA

SEQ ID NO: 180040 - protein, 103 aa, Triticum aestivum
  Clone ID: PAT_TA_74458.pep
GDRGSSSVRRARTAAGSGYLWWSGGGGRSAPSLPPSPPPRGEERKGEEAEAEAASASRFAGEPEARAAAAATVPCRSSAMAASVRGVGTVGISRATCPLVPNS

SEQ ID NO: 180041 - protein, 143 aa, Triticum aestivum
  Clone ID: PAT_TA_74459.pep
NSARAERRRGFLAVAAAKPARPRSSLTAGRRPALTPDPPVSYSSLHQTPAQALLQPICPLLFHRSLELLILVDHLYILEPRSSISISSRPGSSQAFSTGLSASSYCLSEGFTHSCILRNNKQTHSEESLCSNQLLSSTQYYRN

SEQ ID NO: 180042 - protein, 141 aa, Triticum aestivum
  Clone ID: PAT_TA_74460.pep
CYTNDGRKITKVAVCMYEKANRSCYMYVCMRTTLCIRTETHSFLVDGSAGARREYNHQSTTRALLQGRRCGGDSPAPAPSPAETAAARRWAGGGAAATVQQRTTRLEKASSSSSRRGSRPRRCHPHRARCRGAASWAPSGS

SEQ ID NO: 180043 - protein, 132 aa, Triticum aestivum
  Clone ID: PAT_TA_74461.pep
IRHEAAREVMRTHDAAFASRHLSATLDIITCGGKGVLFSPYDDRWRELRRVCVQELFSQRRVLSFRPAREDEVARLLRAVSDGCRGGRAVNLGEKMCRMTTDSVVRAAIGERCDHRDEFLHELDVAVRLTGG

SEQ ID NO: 180044 - protein, 50 aa, Triticum aestivum
  Clone ID: PAT_TA_74462.pep
EFGTRLKAPENMDISMASKGLLVFALLLAAAILDALTEQTHAKMEEKAGV

SEQ ID NO: 180045 - protein, 103 aa, Triticum aestivum
  Clone ID: PAT_TA_74463.pep
MGMAMTSSPQPPPPPRRRRSRLQSATTISAPSANPNPNPKAKVIPLLSDVGRLQSATPTPTPNGNPSPNPKSKVLPLLSDVGSNPSAIDYYSRVASNLAGAGR

SEQ ID NO: 180046 - protein, 89 aa, Triticum aestivum
  Clone ID: PAT_TA_74464.pep
PPGILHQNRAMVQVRRARTSTWWWDWRRLVRGVLGRPPPPLFFSCNLFFSSSSCSSPLGLPVPPLILPHNQIRGLPSRWCRIWCSLEGL

SEQ ID NO: 180047 - protein, 80 aa, Triticum aestivum
  Clone ID: PAT_TA_74465.pep
LLSKLKILVQILRNWRGVWVPEHTWSVRLPSMSSALSQSLSLNLSRRWGMEWSGRQVEQCLLMNQKVACKKPLNPCLVRL

SEQ ID NO: 180048 - protein, 105 aa, Triticum aestivum
  Clone ID: PAT_TA_74466.pep
TAPASLPRRPPPSLAQATAPHSRRRRRPLSSSSRPCLTAASSRLLVRGLDGAPVLHLKAHHAGRARYVLSCDTGRRICIFTENGTRPSPVRTGLLLFPTSGARRC

SEQ ID NO: 180049 - protein, 33 aa, Triticum aestivum
  Clone ID: PAT_TA_74467.pep
AVVCAIEHGEVRLGPWEGARSACVRLARSRAEF

SEQ ID NO: 180050 - protein, 163 aa, Triticum aestivum
  Clone ID: PAT_TA_74468.pep
IPGEHVLPHSSVKIWLPRGKPMMHGDPSFSSPTWIKRCASPNRSSQVRARGCTTGPAIRRHRRGDSPAATSDPATCTDDGPAGLASTRGDRSGGVPCLDDDGDVTRPIQRRASSDAQRTHASGREGLVGPAAGRRRRRERPAARFGRAMGRGRNGERIARAEF

SEQ ID NO: 180051 - protein, 122 aa, Triticum aestivum
  Clone ID: PAT_TA_74469.pep
QQAKEKEQQYGGARERGAAVWEWSSSLRSRRRSSRDREKRQKQFQRRGEAAWVQERQQHQREGKKQQGGRRRRSAARGRSRGRPDAHDPLVWSGVRGAAMAGDGGDGGWIWCGGASGGMGRS

SEQ ID NO: 180052 - protein, 92 aa, Triticum aestivum
  Clone ID: PAT_TA_74470.pep
MDVASVLLPFVLALVAIPILLALHDWPRLPPGPCPWPVVGNLRQIKPVRCRCFQEWAERYGPIFSVWFGSSLTVVVSTPELAKEVLKDHDQQ

SEQ ID NO: 180053 - protein, 103 aa, Triticum aestivum
  Clone ID: PAT_TA_74471.pep
CRSLIATKCAEASTVLSGNSACTSKTLNPKLFQMSPPYLPIYGITLSSYVNLHVPPLKTSKNYPFCVPGSFMERQEVVDIFRAKWVILRSSVYSLAIARENGR

SEQ ID NO: 180054 - protein, 116 aa, Triticum aestivum
  Clone ID: PAT_TA_74472.pep
ESARRSDHGDFVAAANWFIPHIRDTELVECQAIRNGLYLQQTLVANSVETESDCVLAVKAMQSMDEYLGADAAAVLECKQMATSFTKILKDCFREVNQVADSLARYSFDSRSSGLW

SEQ ID NO: 180055 - protein, 108 aa, Triticum aestivum
  Clone ID: PAT_TA_74473.pep
IQSIENKNSRQVTFSKRKNGLKKKVTELSILCGAEIALVIFSNTGKLYSNYGEGMGHLVEIEKKKRAQGYFYSSNPVYDGRSSPALLAARLPMFRRRICEQCPKGAGP

SEQ ID NO: 180056 - protein, 58 aa, Triticum aestivum
  Clone ID: PAT_TA_74474.pep
ITFKCFIIKDICHLVDEGLGYVYIHKIVKKTATLKKKQLGQIQPITNCLNSDIYKNKL

SEQ ID NO: 180057 - protein, 92 aa, Triticum aestivum
  Clone ID: PAT_TA_74475.pep
FSQQLHSILPSKFFSFNSFNSSGGIAWSFRKVPSHLVKLVFYSFHVQPECCLILSFFFFLEPEWFHSLSDSVSFRFSSFASLISSSRCSGSI

SEQ ID NO: 180058 - protein, 146 aa, Triticum aestivum
  unsure (1)..(146): unsure at all Xaa locations
  Clone ID: PAT_TA_74476.pep
IRPSLPLRLVSTTPLAPGLRSDRRRCRTPISTTESKGRLPAPSKTYPQQAGAIRKGGHXIVIKARPCKVVEVSTSKTGKHGHAKCHFVAIDIFNGKKLEDIVPSSHNCDVPHVDRQDYQLIDITDDGYVSLLTEXGNTKDDLKLPT

SEQ ID NO: 180059 - protein, 81 aa, Triticum aestivum
  Clone ID: PAT_TA_74477.pep
TRVYLKASMEKAPGTSIEAIIRRLSAPPVRLPPLTPANPSTAATPAAANLFQPRRAAVLVCLFHDATGELRVLLTKRASSL

SEQ ID NO: 180060 - protein, 46 aa, Triticum aestivum
  Clone ID: PAT_TA_74478.pep
AYPSLLAFYHLPFLSVNSETKEAPVHLPELVQCNGHSDQQVYHQGL

SEQ ID NO: 180061 - protein, 120 aa, Triticum aestivum
  unsure (1)..(120): unsure at all Xaa locations
  Clone ID: PAT_TA_74479.pep
GNNGAPLTLNNLAEEYGKQAVESSTTTAASSAAAHRXTRTKKKSIGGKDEAGKVYQCRFCSLKFGKSQALGGHMNRHRLERETETLNRARQLVFGNDTLSAVGAQISFRDVNIGGSAPSA

SEQ ID NO: 180062 - protein, 108 aa, Triticum aestivum
  unsure (1)..(108): unsure at all Xaa locations
  Clone ID: PAT_TA_74480.pep
MGIDLVXGGRNQRTKRVAPKSDDVYLKLLVKLYRFLVRRTKSKFNAVILKRLFMSKTNRPPLSMRRLSNFMKGKEEKNIAVVVGTITDDMRIREVPAMKVTALRFTET

SEQ ID NO: 180063 - protein, 64 aa, Triticum aestivum
  Clone ID: PAT_TA_74481.pep
HHRLYIHQSNTRRTDNSSTNEQINKQQREGTAPPEPARRRSATASSTRASSSAAATSRRASNDS

SEQ ID NO: 180064 - protein, 113 aa, Triticum aestivum
  unsure (1)..(113): unsure at all Xaa locations
  Clone ID: PAT_TA_74482.pep
PPAPPPPPPSEFDKPPSSPDPIAVTFSDLHTVDGLNALEAHLAGKTYISGXVGITKDDVKVFAAVPVKPSAEFPNAARWYDTVAAAVASRFPGQSSGVSASSAPAAAAPAASK

SEQ ID NO: 180065 - protein, 113 aa, Triticum aestivum
  unsure (1)..(113): unsure at all Xaa locations
  Clone ID: PAT_TA_74483.pep
DQTASTLGEKTEAAKQKAAETTEAARQKAAEATEAAKQKASETAQYTKESAVAXKDKTGSVLQQAGETVVNAVVGAKDAVANTLGIGGDNTNTTKDNTTGATTKDTISTTRNH

SEQ ID NO: 180066 - protein, 77 aa, Triticum aestivum
  unsure (1)..(77): unsure at all Xaa locations
  Clone ID: PAT_TA_74484.pep
ARRRHRRQSGGRVQPSTAAASLSLNTAARFAVAMVVLDAWQYFMHRXMHSSRYMYRRFHSWHHRVVAPYAFAAQYNH

SEQ ID NO: 180067 - protein, 43 aa, Triticum aestivum
  Clone ID: PAT_TA_74485.pep
PIPATGADCMNCVVSICALIYHHQTQRSPYRLCQCFLQSCLVP

SEQ ID NO: 180068 - protein, 65 aa, Triticum aestivum
  Clone ID: PAT_TA_74486.pep
IISLCCLIQINFPFNTPPEGELRTKSVLTLTRSDTIFWALMRIYYHMSRVIRILVIQVVPSACLR

SEQ ID NO: 180069 - protein, 153 aa, Triticum aestivum
  Clone ID: PAT_TA_74487.pep
MAAAKAAKRRAPPPKLLYISPTATFDSTAVYSCSFSPSSSWGRPRDHGDLLFTIDGARGNYVEVVTPAPCNGLTLLYDALDTAYYICNAATRAATRLLPSTDVACDSSAGLGLDARTDEHKVVRLINGMLNPKDLDPVRCEVYTPRGSYVDCR

SEQ ID NO: 180070 - protein, 33 aa, Triticum aestivum
  Clone ID: PAT_TA_74488.pep
TRRVCWPRRTRYVVLGEGVDSCGRRPRRGGLVP

SEQ ID NO: 180071 - protein, 131 aa, Triticum aestivum
  unsure (1)..(131): unsure at all Xaa locations
  Clone ID: PAT_TA_74489.pep
MAAKCYPTVSDEYLAAVAQGKRXLRGLIAEKNCAPLMLRLAWHSAGTFDVATKTXGAPFGTMKCPAELAHGANAGLDIAVRLLEPIKEQFPILSYADFYQLGXSSPYEVTGGPEVPFHPGRQDKPEPPPEG

SEQ ID NO: 180072 - protein, 141 aa, Triticum aestivum
  unsure (1)..(141): unsure at all Xaa locations
  Clone ID: PAT_TA_74490.pep
FSVFLAVSVVGWVVFTFAARLLAWFLSRVLRASVVFRVAGFHXLRDVTIKFSKGXLKSVSIGEIKLSFRKSLVKLSFGVLSKDPKVQLLISDLEIVTRSSSRSKKTSKPSKPRSTGKGKWLITSSMARLLSVSVADLMIKV

SEQ ID NO: 180073 - protein, 44 aa, Triticum aestivum
  Clone ID: PAT_TA_74491.pep
FFFFFFSKLRRHIFIRSGGTRKDTGRTHTGHAELRNTDGGLYFI

SEQ ID NO: 180074 - protein, 64 aa, Triticum aestivum
  Clone ID: PAT_TA_74492.pep
QFQFPSRFEWFVDRLPIADIAILVADEAYENRLQRGAPFAGAGEEASKGRENYRGRDQGVGLLG

SEQ ID NO: 180075 - protein, 159 aa, Triticum aestivum
  unsure (1)..(159): unsure at all Xaa locations
  Clone ID: PAT_TA_74493.pep
QDSARGHHHASAADKEAAKKHHHLDVNTLXGHTDCVTALDFSSDALKLXATVCADRVVRVFRIDDASSKSFKILKINLPAGAHPTAIAYSEGSSSVVVAAQALLGSSLYMYADVGAPPTGGNQQQGKLSPPEITWDHQKIHGEESVLNLAAARATHGTG

SEQ ID NO: 180076 - protein, 147 aa, Triticum aestivum
  Clone ID: PAT_TA_74494.pep
RFRPSNISEHLSHLLMTKVGADVTFEVGHETFAAHRCVLASRSAVFMAQLFGPMKEGTTAAAIRIQDMEPDIFKALLGFIYTDLMPEIEAEREAEVEEGGAEEVTWLRHLLAAADRFDLQRLKSMCEERLLEHIDLSSVSAILAVAA

SEQ ID NO: 180077 - protein, 149 aa, Triticum aestivum
  unsure (1)..(149): unsure at all Xaa locations
  Clone ID: PAT_TA_74495.pep
SGRSAAPRPRILQTEKLMSAPPLPEIMTVRLFLGRLAYQMVNNSERSQGKGLNHAKCSGSEDMGINPFGVHLGEENATVAISRQAGGEGSDNGEISNCVFSDLDREVGGGIECDSXGGECFRFDKAKSNEHAEDFERPVSAANQSESYV

SEQ ID NO: 180078 - protein, 146 aa, Triticum aestivum
  unsure (1)..(146): unsure at all Xaa locations
  Clone ID: PAT_TA_74496.pep
LIEMPSKCLLILSATHSYANVQSLPEIDYCAATYSGFSRSLEFTKYPRQYIVPRLTDXFKEEKAKQYTEKCLEKADSTARYEMLMSKMADLSKKICSDGTKCNTFMLEFDSIQEKLLATEGENPRNNDNCMEIITTSYLVQSRLVS

SEQ ID NO: 180079 - protein, 68 aa, Triticum aestivum
  unsure (1)..(68): unsure at all Xaa locations
  Clone ID: PAT_TA_74497.pep
MTGLDKKKASDVLXKTSADXHVSCAREMTKLSCISDIIPXMEVCDFDFEPCXATSMNAINGSAFSTIH

SEQ ID NO: 180080 - protein, 179 aa, Triticum aestivum
  unsure (1)..(179): unsure at all Xaa locations
  Clone ID: PAT_TA_74498.pep
VLALPGVLVVWCPRSFAPSVVPGGVDGARRXRLSASAETPLPDGLAGRPGSSSSARSDEGEPSRQGRPAVTYSGTSLRRPPPPQDPVRDPRLPLPGSPGDVRRRDEDRRRQEDLRRESALREALVTRPTPAVRYREGPAPSAPVARATAPRPSNGNWRRRGSGSGDSGAVRDAPSHRRG

SEQ ID NO: 180081 - protein, 79 aa, Triticum aestivum
  Clone ID: PAT_TA_74499.pep
RKFAQKAMGTNDVRIDVKLNKHIWSSGIRSVPRRVRVRIARKRNDKEDAKEELYSLVTVAEVPQEGLKGLGTKVVEDED

SEQ ID NO: 180082 - protein, 89 aa, Triticum aestivum
  unsure (1)..(89): unsure at all Xaa locations
  Clone ID: PAT_TA_74500.pep
QHHAGFYNRALPKHPVVQARRRAGRRGRSGDPSSRTSAXDSERREQEHGKGXWRSEEEEDDRRQQRRRGSGSESEEEQDQQRYETVRAR

SEQ ID NO: 180083 - protein, 158 aa, Triticum aestivum
  unsure (1)..(158): unsure at all Xaa locations
  Clone ID: PAT_TA_74501.pep
MKQIPVYDMDENVRRERLPVVAGAYARQFKKDFTXFLQLRAKELVPEGRMVVSLPGRRSDEPVTETSLIWGTAAQILGAMASEGVIDKEKLDSLYIPVHGPSDEELREIIQEEGSFSITEIRVHDPISGMDRALLTPNRMVNSLRAAFEPIIVQHFGS

SEQ ID NO: 180084 - protein, 140 aa, Triticum aestivum
  unsure (1)..(140): unsure at all Xaa locations
  Clone ID: PAT_TA_74502.pep
PRSFSSSRDTGFTDTLTDAAHSAASAAVPASFPGEVAWAAEDSSMAVAAVQHLIDVIHSFTXWISIALSTVLLRCGMFTISTLVNKRLYGMRQDLEQYIKWVKNTKGEKSIQELADAADPMVRKLGFLPTLHIIVTPYTF

SEQ ID NO: 180085 - protein, 86 aa, Triticum aestivum
  Clone ID: PAT_TA_74503.pep
ATWKLSTMVAILPLTHSLRQAQVWTSVDDFMSMHTNFGSLTSLVRSVEGGPMSRLIQDQCDLQLGFGAQKQQIYPSFEEHLRMASA

SEQ ID NO: 180086 - protein, 107 aa, Triticum aestivum
  Clone ID: PAT_TA_74504.pep
ATSRLLNASWPDEAKHTETSSFSCLPDLTMAARLKTLRAWLPHQPWWSPFSERERERRRRSRRWRVYGASHRRVHVRTCQQAQRGRARVSLQLAPGWTSSYVGDRIN

SEQ ID NO: 180087 - protein, 85 aa, Triticum aestivum
  Clone ID: PAT_TA_74505.pep
DGKEGIAKAANLLCSTYLNGDSHTQEDVKSEVNVKNEPVFTETDMASALKSIGCAGPEPDLLLVYGPARCHLGFPTWRLRYTEIM

SEQ ID NO: 180088 - protein, 142 aa, Triticum aestivum
  unsure (1)..(142): unsure at all Xaa locations
  Clone ID: PAT_TA_74506.pep
TPGTERDSVCTPPGASIDHFCSPGCRKIYKRLKKLLGFKNNMEAGFSWSLVRCFAESEAAPSEKESRIXYCNSKTAVAFSVMNECFLPRIDERSGINIIHNVVYDCGSDFNRLNFSDFYTFILERGEEVISAATVRIHGTEL

SEQ ID NO: 180089 - protein, 102 aa, Triticum aestivum
  unsure (1)..(102): unsure at all Xaa locations
  Clone ID: PAT_TA_74507.pep
AEPGLPPPRRASAEAPPPRHXSPAPPPSTAASPWPTAPPARCAXSPPRPRRSAPCTPAAGPTTPDSEPRPKHPKLCGMKSSSLHAIGAAGWVHQAGHGNARS

SEQ ID NO: 180090 - protein, 34 aa, Triticum aestivum
  Clone ID: PAT_TA_74508.pep
NLLKALCGHQFMIGCEVAHSFNSKHRRKKITTMS

SEQ ID NO: 180091 - protein, 97 aa, Triticum aestivum
  Clone ID: PAT_TA_74509.pep
APTAGGMDEMEARFAALKGAAVCPEKETRVRLEDLGGESDEEDEVEKVMRWAMDAARLDVATAGSGASNAEEKEEGDKSSTSSEDEEERLELEEKRK

SEQ ID NO: 180092 - protein, 129 aa, Triticum aestivum
  unsure (1)..(129): unsure at all Xaa locations
  Clone ID: PAT_TA_74510.pep
DGSRRGGAAAAAKGKKKGSVSFVIDCXKPVEDKIMEIASLEKFLQERIKVAGGKAGNLGDSVTVTRDKSKVTVTSDGAFSKRYLKYLTKKYLKKHNVRDWLRVIAANKERNVYELRYFNIAENEGEEED

SEQ ID NO: 180093 - protein, 64 aa, Triticum aestivum
  Clone ID: PAT_TA_74511.pep
NQRATGYGERILVSIQNGVRPCSAKPHFVVIPWPTTSHIIPIVDIGCLLALHGAAVTILTTPAS

SEQ ID NO: 180094 - protein, 99 aa, Triticum aestivum
  Clone ID: PAT_TA_74512.pep
GSPGLQAERRRAAAPSPVPADPPNTDPRTPMPLAQCTTRPFGYRAGLAPSSSAGTAAPESSSHGRTQHTPVGGTLHASERWRSFCRCNFKVSPWRDPLC

SEQ ID NO: 180095 - protein, 87 aa, Triticum aestivum
  unsure (1)..(87): unsure at all Xaa locations
  Clone ID: PAT_TA_74513.pep
SPSIAQPEPLPRYNRHRHTRHRQQKVHSMFVCTMLRNQAQFLRXEWIMYHSHIGVQRWFIYDNNSDYGIEEVLGSMDPSTYNVTRHL

SEQ ID NO: 180096 - protein, 92 aa, Triticum aestivum
  unsure (1)..(92): unsure at all Xaa locations
  Clone ID: PAT_TA_74514.pep
HHQLDRIRRGSWFPVTTFRQSSPKRXPRKSPRSTPRMLRSSLLRQTLWFVPSNRRPDKFCSGKLARGTSSFGRACKSLHVEADVPAAADMHC

SEQ ID NO: 180097 - protein, 178 aa, Triticum aestivum
  unsure (1)..(178): unsure at all Xaa locations
  Clone ID: PAT_TA_74515.pep
AGIRHEGLTTEVKSVEMHHESLLEALPGDNVGFNVKNVAVKDXLKRGFVASNSKDDPAKEAANFTSQVIIMNHPGQIGNGYAPVLDXCHTSHIAFKFAELVTKIDRRSGKEIEAAPKFLKNGDASIVKIIPTKPMVVETFATYPPLGRFALRDMRQTXVAVSVIKGVEKKDPTGSQVT

SEQ ID NO: 180098 - protein, 188 aa, Triticum aestivum
  unsure (1)..(188): unsure at all Xaa locations
  Clone ID: PAT_TA_74516.pep
HDDGASYQLSPVGEEIDCMSNLSEIDDLASTFAKLNRSISGTRNPGVIXGDRRSISRESSLTTTDWVQEAEFSNWVDHDILGSDELQDSKQLCPQPQYLPQFGESKPLSRTSSYPLEPLQHRSSEPILGHRSPSFTSYSPPSGGELSYPGQGLTRHSSIPSPGAGYPMGSPSSSLTGSPYDMPGLPHG

SEQ ID NO: 180099 - protein, 33 aa, Triticum aestivum
  Clone ID: PAT_TA_74517.pep
WVPLVVILIVHNFGTGILQSCRSWCELSQLYIL

SEQ ID NO: 180100 - protein, 69 aa, Triticum aestivum
  Clone ID: PAT_TA_74518.pep
MVRFGKKLTAGQVPKWRGYYINYKLMKKKVKQYGQQLQQGEKDRCRVLKHFSKMLDDQVEDSNRVGRFV

SEQ ID NO: 180101 - protein, 122 aa, Triticum aestivum
  unsure (1)..(122): unsure at all Xaa locations
  Clone ID: PAT_TA_74519.pep
SGSPVAAGELQRKMPPPADGGVPGLVTFVPKYCNQLLXEQYRPVLTQVVNIXRSWRNEAFNDKMLVDAVHNIVKALEANFDTLAKAYEDKTLSSLFMMNTHSHFFKHLKSTKMGEILGDEWL

SEQ ID NO: 180102 - protein, 94 aa, Triticum aestivum
  unsure (1)..(94): unsure at all Xaa locations
  Clone ID: PAT_TA_74520.pep
GMGAGRXLKTHRRNQRWAXDKAYKKSHLGHEWKKPFAGSSHAKGIVSEKIGIEAKQPNSAIXCKCARVQLVKNGXRMIAAFVPNDGCLNFIEEN

SEQ ID NO: 180103 - protein, 103 aa, Triticum aestivum
  Clone ID: PAT_TA_74521.pep
HCPQCDQPTGTGLWCCCISRRELCWFRRRMVGWEFALADDNGFNHLYLLSRKVSEGGDAEWVECPVMYLGDSLPFAASVVVLKNNSISDGLCRGGKYHFGEHG

SEQ ID NO: 180104 - protein, 151 aa, Triticum aestivum
  unsure (1)..(151): unsure at all Xaa locations
  Clone ID: PAT_TA_74522.pep
IKIFCKADEGYCLSVRDGNVVLAPSNPRDEHQHWFKDMRFSAQIKDEEGNPAFAIVNKATGLAVKHSLGQSHPVKLVPFNPEYLDESVMWTESGDVGKGFRCIRMVNNIRLNFDALHGDXDHGGVHDGTTVVLWEWAKGDNQSWKILPWGE

SEQ ID NO: 180105 - protein, 109 aa, Triticum aestivum
  unsure (1)..(109): unsure at all Xaa locations
  Clone ID: PAT_TA_74523.pep
RSTSCLSTGETAPARAGSSRSTRPGTPSSTTPTATLAPSRRCPASTPPIGELPSPCASPAPTXTQPPGTPVAPTCSTASTCSTRATSRRSSTATPGGLMELKLGTGSSS

SEQ ID NO: 180106 - protein, 78 aa, Triticum aestivum
  unsure (1)..(78): unsure at all Xaa locations
  Clone ID: PAT_TA_74524.pep
WPGVKKAEQAXHKTKETAEAAAKTGAETHERSKQGKAKVEETAKEKAGQGYETLKQTEDAAAEKAGAAEDTAAEKAAA

SEQ ID NO: 180107 - protein, 56 aa, Triticum aestivum
  Clone ID: PAT_TA_74525.pep
CRIGTRRPVLKGMDIICILIFLLMPVLFLHEVIICLKLIFWSWSIQHYWELLKTRQ

SEQ ID NO: 180108 - protein, 105 aa, Triticum aestivum
  unsure (1)..(105): unsure at all Xaa locations
  Clone ID: PAT_TA_74526.pep
SGLELSMEKAQHKYVGLPVTCAILICLFALQHYGTHRVGFIFAPIVCIWLLCISMIGLYNIIHWNHHVYXALSPYYMYQFLKKTQKGGWLSLGGILLCVTGSEAM

SEQ ID NO: 180109 - protein, 154 aa, Triticum aestivum
  unsure (1)..(154): unsure at all Xaa locations
  Clone ID: PAT_TA_74527.pep
QPDGRRRRAAAKIVSLKLQKRLASSVLKCGKGKVWLDPXEVNEISMANSRQNIRKLVKDGFIIRXPQKIHSRSRARRAHEAKQKGRHSGYGKRRGTREARLPTKILWIRRMRVLRRLLRKYREAKKIDKHMYHDMYLKVKGNMFKNKRVLMESI

SEQ ID NO: 180110 - protein, 161 aa, Triticum aestivum
  unsure (1)..(161): unsure at all Xaa locations
  Clone ID: PAT_TA_74528.pep
EYERAVFRALSALVGEDRHTEXAVDRHFELLKEFPXDLMSLKRAQLLCFYVGRPDTSLKFVQQVLPENQDRGNYIXGMLAFPLLELGQNGRSLXAARKGLAXNENDFWSQPNMCHVFQQECPFREATEFMESCSPSWTSCSSFMFTHNWWHVAVCYLEGEA

SEQ ID NO: 180111 - protein, 176 aa, Triticum aestivum
  unsure (1)..(176): unsure at all Xaa locations
  Clone ID: PAT_TA_74529.pep
CKSTTTGHLIYKLVSXIDKRVXIERFEKEAAEMNKRSFKYAWVLDKLKGEAVRGGITIDIALWKYETTKYYCTVXDAPCHRDFIKNMITGTSQADCAVLIIDSTTGGFEAGISKDGQTREHALLAFTLGVKQMICCCNKMDSSTPKYSKARYEEIVPEVSSYLKKVGYKPYQVPFV

SEQ ID NO: 180112 - protein, 146 aa, Triticum aestivum
  Clone ID: PAT_TA_74530.pep
MPRKSSKGDGKAAADALRRLDLDASAAEDAPVETPPPRPEAPAPPVEASSSGTAAVGGGPEEEDLRRLHELVGFDRERVELTEEEVRANHQRQEDEICALEAIFGDYLVLFNRKEGQRSFQVHVNVEIPEDGKDVSVRLGFGTGAL

SEQ ID NO: 180113 - protein, 78 aa, Triticum aestivum
  unsure (1)..(78): unsure at all Xaa locations
  Clone ID: PAT_TA_74531.pep
SLRQXPSDWRSTLREGLHTVLFKHTPSSYNCHRLCLIPMTFRFELFILFNLITWAGSRFWLLATVMIRLCSLFVRMLV

SEQ ID NO: 180114 - protein, 133 aa, Triticum aestivum
  unsure (1)..(133): unsure at all Xaa locations
  Clone ID: PAT_TA_74532.pep
CQXRRINENDEDPQPPRPPENTTTLLAFRTAAHAPSIPDRRIPNNTLKKDCDDDDAVARTCPRVSHGTRGVRWKGYARRPSGRHGGAHERHRVGAGPADKDFSRPLTXPRPQTIHPAPPNTPPTNCATTVEQS

SEQ ID NO: 180115 - protein, 197 aa, Triticum aestivum
  Clone ID: PAT_TA_74533.pep
MASHGAAPAAGSDAARVEVSGTGQTNQPAYPPLVSGDHSWSTTTGAAAAGSWNYPVANQSQDAVYYDPQRDVSVSGDNQNVASSAPPAVQSTMGLTNASHSHVPYSSSLQHGYNPAEYANYYYNYPQATNSCSVQQGGANQHSGAAYQPLTSFQNSGSYVDPTSNTYYNASRHQTAPGYASTNYYYQTDTRHDGSSG

SEQ ID NO: 180116 - protein, 216 aa, Triticum aestivum
  unsure (1)..(216): unsure at all Xaa locations
  Clone ID: PAT_TA_74534.pep
NTRGAKQETEGSPPRRGSTSLPGRGPREALAFRSSSMRGKKMIYGFSISLILINLASIMERADENLLPAVXYKEVSAAFDAGPTDLGYLTFIMNFLKSIASPLAGVLALQYDRPTILAVGTVFWALSTGAVGVSQYFQQVAFWRGVNGVGLAIVIPSLQSFIADSYREGTRXARFGLLSLIGSIGGIGGSIVATVMAGRDYWGFPGLRFAFIVVAF

SEQ ID NO: 180117 - protein, 169 aa, Triticum aestivum
  unsure (1)..(169): unsure at all Xaa locations
  Clone ID: PAT_TA_74535.pep
VKLQESEKETRLLVEALXSKLEDSRESLVTSEKKVRELETQLQDEQLVSAKSQKKSDNLETELRKXXKELENEKAAREEAWAKVSSLELEVAATMRDLSIEKRRYQGARERVILRETQLRAFYSTTEEISSLFAKQQEQLKAMQRTLEDEENXESTLLGLDLSEVPVAN

SEQ ID NO: 180118 - protein, 60 aa, Triticum aestivum
  Clone ID: PAT_TA_74536.pep
WGCQCMIYRANNVLLSMGNLNPHPSKKVISLQVLALGEVLSLSTSSEGPRLCADALCHHV

SEQ ID NO: 180119 - protein, 60 aa, Triticum aestivum
  Clone ID: PAT_TA_74537.pep
DFQFCKAAGTAQKGSLPLFRLPNLKVTPAAIGGLLVTVLMISADHQSQQDGDQKTDRLSR

SEQ ID NO: 180120 - protein, 81 aa, Triticum aestivum
  Clone ID: PAT_TA_74538.pep
MVVVRHGDERRPGTKALEASMAAGTRVVRSVYLPVDKGVEVLHVGVSKGPSLQCRRSRSASSRWIRHVDHKTGEEHLFRRP

SEQ ID NO: 180121 - protein, 138 aa, Triticum aestivum
  unsure (1)..(138): unsure at all Xaa locations
  Clone ID: PAT_TA_74539.pep
RDWYTLSTCLTLYXNKEMLGKRMWKFPAPXLMNTVHFTIAGLLRTRVIVVVPXNGAWRPSXSTMSWKDYFQRVVPTALATALDINLTNISLVVITVTFATMCKSGAPIYILLFAXLFRLEKPSFNILGIMLIVSVGVL

SEQ ID NO: 180122 - protein, 168 aa, Triticum aestivum
  Clone ID: PAT_TA_74540.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLTAKLEGDDLDVFKKNVESATKYLLSKLKDLQFFVGESMHDDRGVVFAYYKEGAADPTFLYFAHGLKEVKC

SEQ ID NO: 180123 - protein, 122 aa, Triticum aestivum
  Clone ID: PAT_TA_74541.pep
LMRKDWLRLVAERAMQHIENNDLPKPTQIVRIHGAKLNGHENEDGCGNSLSSSGKESRPQPHDTMMCSYSLSSTNETNSSDGGGWQQSHKNDAHWGTQDSYSSGDHTPRRKPIFQNQKDAER

SEQ ID NO: 180124 - protein, 207 aa, Triticum aestivum
  Clone ID: PAT_TA_74542.pep
KFGSLASKISSGNGRQGHARFRQRIKKPMPLFDSNLFRDSPASASGWPDAAAAAPKTSSPGPSTGLQLFPRYQQMEASSSKDPVRIPAAQFPQRMVVENPSVGSNGPPLQLVQPVSVAPPAGTPAPALPAAHLHFIQQQQSYQRFQLMHQMKLQSEMMKRGGHGDHQGGSTGAGKGVNLKFDGSYCTGSSSRSFLTSLSMEGSIASL

SEQ ID NO: 180125 - protein, 37 aa, Triticum aestivum
  Clone ID: PAT_TA_74543.pep
LGPRLETMIQSTWAYPTRRASVLIGGETPGGGERIAR

SEQ ID NO: 180126 - protein, 76 aa, Triticum aestivum
  Clone ID: PAT_TA_74544.pep
TGSPRNNKIHLNSLPMSYQFFERDYDPWWLLRLVISACYSYQHSGAMLLMACCLDVSFKTFFDKYKLIIKKYTNSV

SEQ ID NO: 180127 - protein, 83 aa, Triticum aestivum
  Clone ID: PAT_TA_74545.pep
AFYGDLWARRGGGRDGRTRAQQRRCRSAAEQSFRWWWWWWCTRHGRAAEGGHGRQARPQEHPPRPWRHRQLRGQQPARPPWRH

SEQ ID NO: 180128 - protein, 156 aa, Triticum aestivum
  Clone ID: PAT_TA_74546.pep
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNPDEMIKAGRLSEPYKGIGDCFGRTIKDEGFGSLWRGNTANVIRYFP

SEQ ID NO: 180129 - protein, 55 aa, Triticum aestivum
  Clone ID: PAT_TA_74547.pep
FMAPGNGRRPSSASASSSTHWLVQLSSSSSSKNYRLVWATTEAAASTLSVSVCLL

SEQ ID NO: 180130 - protein, 153 aa, Triticum aestivum
  Clone ID: PAT_TA_74548.pep
RSDKEEPYLIPGGDTLRFSHNIPFHRLSEADKPHIPNGAFELDPASMPSNLEEASSSADLNRSSTQEGNIGGNVSSTRDSFKCEMPAGKTKQGLDTAATNEGNVHNGVKKPNINADCKHDDGSEASVIDAHTVDQWDDSFQSESPATFVYPEP

SEQ ID NO: 180131 - protein, 39 aa, Triticum aestivum
  Clone ID: PAT_TA_74549.pep
KTSWLLSMTSSTRIGGEVEAIVVSLAKEGLLHGITHALP

SEQ ID NO: 180132 - protein, 86 aa, Triticum aestivum
  Clone ID: PAT_TA_74550.pep
MMARVDRLDLVVGYLEELRHSGSGSGRSSTTATSTLSSSSPTTPRARPHGCRSAEELLRETNAKGSLVERIAFLEDRVLRMEEERM

SEQ ID NO: 180133 - protein, 190 aa, Triticum aestivum
  unsure (1)..(190): unsure at all Xaa locations
  Clone ID: PAT_TA_74551.pep
EGFINPSIAGLAVTYALNLNGQLSSITWNICNTENKMISVERIMQYSRIPSEAPLIVDDHRPPNSWPKDGXXNIRNLEVRYAEHLPSVLRNISCTIPGRKKVGIVGRTGSGKSTLIQALFRIVEPRVGTIEIDDVDLSKIGLHDLRGRLSIIPQDPTMFEGTVRGNLDPLNEYSDPHIXWRHLDKCQLGD

SEQ ID NO: 180134 - protein, 56 aa, Triticum aestivum
  unsure (1)..(56): unsure at all Xaa locations
  Clone ID: PAT_TA_74552.pep
PRSSKNQIHYYQYKLYYVISSCRSPQXKYCMLVRCMFNVVTPLPLLARRPIAPFVA

SEQ ID NO: 180135 - protein, 120 aa, Triticum aestivum
  Clone ID: PAT_TA_74553.pep
VARQRRPSHDARNARPRRRCNKGGRGQRHTDQRARAHLARGRHPGVERARCPTGRSRRRRAGDGRDAAAETLAIGEGSWASAGDQKWWIQPDQRMEGRRLARRCAASWWTSPESMALVAA

SEQ ID NO: 180136 - protein, 78 aa, Triticum aestivum
  unsure (1)..(78): unsure at all Xaa locations
  Clone ID: PAT_TA_74554.pep
NFVSAYQSASLPSTSFVKVCFPGQPNPPLSSGGSSSSGSSGLRGWVVALVVLGVVSGLVLAEWALXWAFCRNSPKYGP

SEQ ID NO: 180137 - protein, 77 aa, Triticum aestivum
  unsure (1)..(77): unsure at all Xaa locations
  Clone ID: PAT_TA_74555.pep
MSCNCGSGCSCGSDCKCGKVYPDLTEQGSAXAAQVAAVVVLGLWQPENKAGQFEVAAGQSGEGCSCGDNCKCNPCNC

SEQ ID NO: 180138 - protein, 142 aa, Triticum aestivum
  Clone ID: PAT_TA_74556.pep
RHVDAHGGGPAAAPPHLFGGATAATTEGSAASSAGQDTGAFVAADADADRLTPRRRRASRPTAAPVRRRGRDGVGAGPGGVRPGGGDGGRGEASRRRHGQRQRRRRRQHQELLVQLTLSSSDQSVLCSFSKLVTTAPASLVE

SEQ ID NO: 180139 - protein, 86 aa, Triticum aestivum
  unsure (1)..(86): unsure at all Xaa locations
  Clone ID: PAT_TA_74557.pep
IISYDSPAQRDRGMASRSLTIHIRAFVVVGPVLLHPTCISCAGDYNLLVPPISLGXCSRLIVHLRRNGYAFVRMEMRLRKIHEGTV

SEQ ID NO: 180140 - protein, 82 aa, Triticum aestivum
  unsure (1)..(82): unsure at all Xaa locations
  Clone ID: PAT_TA_74558.pep
QSLVRWFNSVAXHYADALDEVTSAYVGKRGIGKSPAPSLKEKVPGLKENTSGHEMDLPGAKVGEVCVRFAPEPSGYLHIGHA

SEQ ID NO: 180141 - protein, 146 aa, Triticum aestivum
  Clone ID: PAT_TA_74559.pep
MVKYSTDPANPTKSAKAMGRDLRVHFKNTRETAFALRKMSLNKAKRYLEDVLAHKQAIPFRRYCRGVGRTAQVKNRQPNGQGRWPAKSAKFVLDLLKNAESNAEVKGLDVDALYISHIRVNQAQKQRRRTYRAHGRINPYMSNPCH

SEQ ID NO: 180142 - protein, 167 aa, Triticum aestivum
  Clone ID: PAT_TA_74560.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARY

SEQ ID NO: 180143 - protein, 89 aa, Triticum aestivum
  Clone ID: PAT_TA_74561.pep
MAVTFSDLHTADGLKALEAHLAGKTYISGDGITKDDVQVFAAVPVKPSAEFPSAARWYDTVAAAVASRFPGQSSGVSASSAPAAAAPAA

SEQ ID NO: 180144 - protein, 126 aa, Triticum aestivum
  unsure (1)..(126): unsure at all Xaa locations
  Clone ID: PAT_TA_74562.pep
APRSPDEPPNHHSSRHPSRTTGEPLPRASSSRPRRPSSPSWSAARRRRGGRRSPRRSPRRRGPRTPRPTAAPAPPATARRXRLQLVPRVPHRPRRQHHPPPPKTAATEHEGFEFPFFFPSCESAAR

SEQ ID NO: 180145 - protein, 37 aa, Triticum aestivum
  Clone ID: PAT_TA_74563.pep
ITISPITIGIATTNCHQKFIPMFSCSFGQADIEPAAR

SEQ ID NO: 180146 - protein, 45 aa, Triticum aestivum
  Clone ID: PAT_TA_74564.pep
EGVGSSKGRGGSRRAVYCERERETRGRWVLGQRRGRAQVPPLLAA

SEQ ID NO: 180147 - protein, 204 aa, Triticum aestivum
  Clone ID: PAT_TA_74565.pep
GSPGCRRRATSTTAPVCRARTPPRLSQSSARASDGAVRDAFRFLLSLMAKPHSHVRLLAFSIVDELFMRSKLFRSLLADGLDGFVPLAVGFRTNEQLPPPAASAATLRKAAIQALERWHHLFGVHYRQLRLAVDYLKSSARIQFPGLRAARAAREARTQEILTAKVEQLRSTIGSIKAEIRSTIEEIRNGLGIIRAEYEKFERY

SEQ ID NO: 180148 - protein, 80 aa, Triticum aestivum
  Clone ID: PAT_TA_74566.pep
ERLTLPIVTPHVAVVERQCGDPSSILRTRYIPGIPDPSKPDTRGGEDITQDLNIRVRRRAGFIRQHPGIQIFEFRNSSAS

SEQ ID NO: 180149 - protein, 58 aa, Triticum aestivum
  Clone ID: PAT_TA_74567.pep
LPSSTPVGLPDLEEPKPPPAMVSRDRSGVLAYAHPLRSPANGSTSSSAASTSTSTRAR

SEQ ID NO: 180150 - protein, 35 aa, Triticum aestivum
  Clone ID: PAT_TA_74568.pep
TGFSFSMSPPYNAPDSCLWFAGLHLRVKMIACSAC

SEQ ID NO: 180151 - protein, 72 aa, Triticum aestivum
  Clone ID: PAT_TA_74569.pep
SGSPGCRTEFFAIPLPSPPRPPPPSGIAGEESRRGASSYQLNTKSWSTRRPAASLVRAPSFASITACFFGSA

SEQ ID NO: 180152 - protein, 104 aa, Triticum aestivum
  Clone ID: PAT_TA_74570.pep
WATARMASSCASLRPVEQRASSFARALGRFHLLSGPFAVAPTGSTGLTISLRYGDEGAEFVHANRTPRARLAPRSTPVPAAFAVTPAGNASLAILLRCGNERRR

SEQ ID NO: 180153 - protein, 101 aa, Triticum aestivum
  Clone ID: PAT_TA_74571.pep
KDRFFSTWRSHSGYDPSCTPLEKIDFFRREESFRLDPVVAMPARSCDCADASHQGPCTPSLAALPPNPSGSVSRRPSPRLVSFCSSQPMEKARTNSRSSTP

SEQ ID NO: 180154 - protein, 49 aa, Triticum aestivum
  Clone ID: PAT_TA_74572.pep
AVNRHEGSPWRAATRPTTWPSCNAPCCHFYTHPRRPTCSYKSSSPCESS

SEQ ID NO: 180155 - protein, 124 aa, Triticum aestivum
  Clone ID: PAT_TA_74573.pep
SHEGHTPLHSTDGSGSRSGAGADGETTPATAPGRRRCSLWADCSGERSPHSQPALSWSSIPLDLAGLVLRLLPTYADRARFAAVCPQWRAAAKRKQLLPPPLPLLALAGWHLLQPTVYQSPSGS

SEQ ID NO: 180156 - protein, 36 aa, Triticum aestivum
  Clone ID: PAT_TA_74574.pep
RSQCCLTKHVFKMSKQYLANVALKINVKVGGRNTVL

SEQ ID NO: 180157 - protein, 50 aa, Triticum aestivum
  Clone ID: PAT_TA_74575.pep
DVDLVGLDALACPCCRPLFSPPPSVGGGLLASLAAASSRPGPFGLPPAAR

SEQ ID NO: 180158 - protein, 118 aa, Triticum aestivum
  Clone ID: PAT_TA_74576.pep
MGKEKIHISIVVIGHVDSGMSTTTGHLIYQLGGIDKRVIERFEKEAAEMNKRSFRYAWVLDKLKAERERGITIDVALWKFETTKYSCTVIDAPGHRDFIQNMITGTSQADCAELIIDS

SEQ ID NO: 180159 - protein, 115 aa, Triticum aestivum
  unsure (1)..(115): unsure at all Xaa locations
  Clone ID: PAT_TA_74577.pep
MVKAVAVLTGSEGVKGTIFFTQEGDGPTTVTGSVTGLKEGLHGFHVHALGDTTNGCMSTGPHFNPASHVHXAPEDXIRHAGDLGNVTAGADGVAXINVTDCHIPLTGPNSIVGRA

SEQ ID NO: 180160 - protein, 33 aa, Triticum aestivum
  Clone ID: PAT_TA_74578.pep
LVPFHRPESRTIDIHPFLCRVSEHHHPSAQAQT

SEQ ID NO: 180161 - protein, 118 aa, Triticum aestivum
  Clone ID: PAT_TA_74579.pep
QKGSGSEKTKEQEERKVKTEHSKVNPSQEMKGSGSEKTKGQEIQKMETEHSRVNPSQELKGSGSKKTEEQEEQKVKTEHSTVSSSKELKGNVGEKIEEQEDQQLVQCDQVSKPEVAPP

SEQ ID NO: 180162 - protein, 185 aa, Triticum aestivum
  Clone ID: PAT_TA_74580.pep
SPLSVRFFLQSHVSPFPIARCFARASRRSQYLPEAENFLCVCIAKLMASRGGGGGAHASRPPLRVGRTKEYRMGRDTQLLAAQGSPVSLFVLCGDRFEGSQLFRSGELSVHMIRVEGHPVSMASCTVRDHPWMLARDALVARVDARVFVFELPGFFYAVVVPPDEAFGARAAERKCATLAEIFSR

SEQ ID NO: 180163 - protein, 138 aa, Triticum aestivum
  Clone ID: PAT_TA_74581.pep
RLSSISLLLLLPPIPNQEEPGARRAKEEKRRSPSPARAQDSRRRDLAQERRWGSPFTKLFSRLFAKKEMRILMVGLDAAGKTTILYKLKLGEIVTTIPTIGFNVETVEYKNISFTVGDVGGQDKIRPLWRHYFQNTQG

SEQ ID NO: 180164 - protein, 164 aa, Triticum aestivum
  unsure (1)..(164): unsure at all Xaa locations
  Clone ID: PAT_TA_74582.pep
HIWLVQRNSRKRTNFMPQELTDSGTMLSYDGNKLVVSGYSDALASRNLDKVEDMTVGRCDGLFPEELDDSFVFCSVKSLQLHASHLTSSKSSSSKVLNCFPALSVLHIAGDGDHDYXECVRAFSWCKELSFAWCKGLVLVPVENENGGGIQEDKSLLQSLSILR

SEQ ID NO: 180165 - protein, 152 aa, Triticum aestivum
  unsure (1)..(152): unsure at all Xaa locations
  Clone ID: PAT_TA_74583.pep
LTSIYLINGAGGGCGDKQKKCCPLRRSRKGCMKGQGXPGHQQCPFRGVRQRTWGKXWVAEIREPNRGARLWLGTFATALDAARAYDAAARALYGDCARLNLSASPSQMQHPPAQGSGANGNSAPGTPCCSSNNSDSSASTPTGTPTDMDCSA

SEQ ID NO: 180166 - protein, 123 aa, Triticum aestivum
  unsure (1)..(123): unsure at all Xaa locations
  Clone ID: PAT_TA_74584.pep
QKGGCKRWESLGLHLTWCGSPPEMEAFCQQGYSRISLAGIPLCSLICSALFYLVPSSITSICCILLAASSSHVCPAISSAAQAIACFRLRLGXLDSEMCSQQTACTIKISRNLLSSCGCIWHC

SEQ ID NO: 180167 - protein, 103 aa, Triticum aestivum
  Clone ID: PAT_TA_74585.pep
GSRERISTTRSSVSLAARKPFSVSISIVVYCAVLSSHGEDGIRAAHRPRESARPRGRRRSRSLPTTGLPHWPLAVPDPEQNINQQAPRDFSERRSTLLSRRCK

SEQ ID NO: 180168 - protein, 61 aa, Triticum aestivum
  unsure (1)..(61): unsure at all Xaa locations
  Clone ID: PAT_TA_74586.pep
MGKEKTHINIVVIGHXVTPRKSTTTGHLXIYKLGGIDKRVIERFEKDAAEMNKRSFKYAWV

SEQ ID NO: 180169 - protein, 155 aa, Triticum aestivum
  Clone ID: PAT_TA_74587.pep
VKSCWQPYLEACGNKDGGVRIEVASPPHSYFLVFSSSTYCARVLNASSNIKCGGDYVEFCRWSNAVRGQRAELAFKARISLEGLPDTGLEFGTYEVMIASFGGDLIDVLPPKDQWSAEIDLWVRNPSKIPKQIVTDVPFPDPEPWQADSDYEGQS

SEQ ID NO: 180170 - protein, 151 aa, Triticum aestivum
  unsure (1)..(151): unsure at all Xaa locations
  Clone ID: PAT_TA_74588.pep
MAAAGDAGEKKMITLKSSDGEEFEVEEAVAMESQTIRHMIEDDCADXGIPLPNVDSKILSKVIEYCNKHVQAKPADRAAAGAGAGASDAAPAAPAEDLKNWDAEFVKVDQATLFDLILAANYLNIKGLLDLTCQTVADMIKGKTPEEIRKT

SEQ ID NO: 180171 - protein, 59 aa, Triticum aestivum
  Clone ID: PAT_TA_74589.pep
DVDLQRFDCRVLLGRGDPWRRWWTWRRPCPSPCCRRRPSASSHAVGAPLERNPRAGRRR

SEQ ID NO: 180172 - protein, 110 aa, Triticum aestivum
  Clone ID: PAT_TA_74590.pep
AASLPVVVGGDFNLLRFAEDKSNANVNFAWMQMFNDFIADLGLREIDRIGARFTWTNRQASPTQSVLDKVLVSPKWDLRCHLASLRAITRIGSDHVPLLLSFADSPSIPL

SEQ ID NO: 180173 - protein, 109 aa, Triticum aestivum
  unsure (1)..(109): unsure at all Xaa locations
  Clone ID: PAT_TA_74591.pep
GARLAAGQWPAFHQAPRNVTVLSTTXRGTGVSFSDEQRKQLAAEQAARAVPLTVEARVPVRLRFGXCCRTWTVDVKATCQVTVDRLAGEAAAANRGCRVKVRPFLWWWW

SEQ ID NO: 180174 - protein, 84 aa, Triticum aestivum
  Clone ID: PAT_TA_74592.pep
RARYGWGGETHHSVGKIIDIESDGLLIIDIPNRSASWQADPSDMEKIDDFKVGDWVRVKATVPSPKYGWEDVTRSSIGVVHSLE

SEQ ID NO: 180175 - protein, 140 aa, Triticum aestivum
  Clone ID: PAT_TA_74593.pep
MHERLLQMATLATTKNESDDGNFALWEEPYKQARKWTPCAAKYTLEEEPSDDDDGFILISANGGLNQQRVAVCNAVVVAALLNATLVLPRFLHSSVWKDKSQFGDIYQEDYFVNYMKSDVLIVKDLPPHLQSLDLEAIGS

SEQ ID NO: 180176 - protein, 191 aa, Triticum aestivum
  unsure (1)..(191): unsure at all Xaa locations
  Clone ID: PAT_TA_74594.pep
MARAPTMVVQDDYIDMDLSPSSPQCALLEFEFQSAGGGGGGGVSRRREEAAYASPADELFYRGKLLPLHLPPRLQLVQKLLQEQQVNVPEIKPAVAGPAAPSVSASADVKDGGDGQVGAKRYSWSKRLKLMKRWTSREYIKSLFLAXAGDLGIVNGCCGRRERASLLDQDELCSHRRSFSGIIRRVRLVVA

SEQ ID NO: 180177 - protein, 151 aa, Triticum aestivum
  Clone ID: PAT_TA_74595.pep
MSTQSVQCFGKKKTATAVAHCKAGNGLIKVNGRPLNLLQPEVLRFKVYEPVLIVGLDKFAQVDIRIRVTGGGHTSQVYAVRQALSKALIAYYQKFVDEHSKNLLKQALTQYDRTLLVADNRRCEPKKFGGQGARSRFQKSYRSAVISRRLL

SEQ ID NO: 180178 - protein, 64 aa, Triticum aestivum
  Clone ID: PAT_TA_74596.pep
IHPLLLFSQTCTHVFRKTINRGVKTGEENETLLLLASWLSLSSRSTTTCHVLLKIKIVVIKFHK

SEQ ID NO: 180179 - protein, 66 aa, Triticum aestivum
  Clone ID: PAT_TA_74597.pep
SRSSSIVVSYCPRIRARAREAPYARHTPSYFAHSRRISSSSSSCPATTALPRPRPQAPRGASPPIP

SEQ ID NO: 180180 - protein, 86 aa, Triticum aestivum
  unsure (1)..(86): unsure at all Xaa locations
  Clone ID: PAT_TA_74598.pep
SFRKRFDDELKRHXAETQAREEIRRSLEXEVRRLTXTVGQTEGEKKEKEDQMSRCEAYIDXVESKLRVCQRYVRTLXETSLQEEMA

SEQ ID NO: 180181 - protein, 66 aa, Triticum aestivum
  Clone ID: PAT_TA_74599.pep
IFRAFTFLGTLLTLDMLCLFIACSFLSPFISALLGPLLFFTPLLLLGCLLVFQVPGSGPPPLQDTG

SEQ ID NO: 180182 - protein, 129 aa, Triticum aestivum
  Clone ID: PAT_TA_74600.pep
GFGGWRLTGGREVAISAVFTALLVVSILFLPSVLLTSGRLGPSSAKEWPFLTAAKDGGGYPVSFAYLISASTGDAERATSLLAALYHPANSYLLHLDRDAPAEEHRRLAELVSGQPVYGRVGNVWIVGK

SEQ ID NO: 180183 - protein, 148 aa, Triticum aestivum
  unsure (1)..(148): unsure at all Xaa locations
  Clone ID: PAT_TA_74601.pep
LECTIDDLMKYGARFVSFFNECTNTFAGLTRLYLENLRFAESDFVCNILDXTASRLKHLGFLNCDTESWITLQMEHAELSELSIVNCRFDMVKVDWVPKLTRMVFEYWMSFKEPPLSFGYVPLLDVLSVSDVGLSWHEMVKLSTFLHE

SEQ ID NO: 180184 - protein, 81 aa, Triticum aestivum
  unsure (1)..(81): unsure at all Xaa locations
  Clone ID: PAT_TA_74602.pep
PPPPPPPXDLPXSVRPRDLPDLPPSRPDPRPPYHRRGCTPPPTTSPATTVPLPHRPPATSLPLHRRRGFSSPLFLGLIQWE

SEQ ID NO: 180185 - protein, 136 aa, Triticum aestivum
  Clone ID: PAT_TA_74603.pep
MVKIPSPRRLFRSRSRNTVGGIGGVDMCAMVAEHERIEWEVRPGGMLVQKRRAPHDDGCDDAVEAILVRVSAGCGGWQHDVSIDATATFGDLKVLLSLATGLWPREQRLLYRGRERDDGNHLHMAGVQDKDKVLLL

SEQ ID NO: 180186 - protein, 139 aa, Triticum aestivum
  Clone ID: PAT_TA_74604.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEG

SEQ ID NO: 180187 - protein, 108 aa, Triticum aestivum
  unsure (1)..(108): unsure at all Xaa locations
  Clone ID: PAT_TA_74605.pep
QNTVRLQRDGKGRKAAGRRARFRSLTTAMIGAALLPSLLXAAAGDHFSPPPPSPSACPWNGRERPPAAGVTPSMESKIQKKVVRKRTSASDSASRESPSTATKPSRPR

SEQ ID NO: 180188 - protein, 83 aa, Triticum aestivum
  Clone ID: PAT_TA_74606.pep
DPLWSEAVSSRRRRACNWASAWPGLSIWMTPRSRHGRRGGWDPRRWGSRRAPRSRPRGGRGGAARKSVALESARRQRTPSSSR

SEQ ID NO: 180189 - protein, 86 aa, Triticum aestivum
  Clone ID: PAT_TA_74607.pep
MAAPAKASWMVAMSVGAVEALKDQAGLCRWNYALRSIHRAAKASVRGGVSHGKKQLPATAVVETWRAEKAEEGLRTVMYLSCWGPN

SEQ ID NO: 180190 - protein, 152 aa, Triticum aestivum
  Clone ID: PAT_TA_74608.pep
MATERHAGKIYTRAMFEQFGHIIYECGAYQVEEVEKGKTYVAIHTDATRRERWCRVSYKVTVIDGGDEFDCECGQFSHMGMLCSHVLKVLDFIRVMEIPHKHIVKRWTRDARGILPPHLSQYQRDNASSNNPFSYRHFNMYMQAMELVRMGD

SEQ ID NO: 180191 - protein, 104 aa, Triticum aestivum
  Clone ID: PAT_TA_74609.pep
AAGLGAGRFLWIEPWLSRGVLLRAWIGGCSAVPTNQLQVQNKSALEFVDVAATQRRPSRPSTRQIKGCQGGANKRSKGRAFCCSQTGPMGRCSLQVIQQIQGCS

SEQ ID NO: 180192 - protein, 111 aa, Triticum aestivum
  Clone ID: PAT_TA_74610.pep
MELLLVQGAFLHHHQGCKGLSRKWRIMFCYLPPRKWLRSNGYLHYRRKTITGSLVCIGHADYYVLIRSFAKLAEVDVRVLHTSVLKLERRLAWIEERIGRSLDALQNPPIS

SEQ ID NO: 180193 - protein, 111 aa, Triticum aestivum
  unsure (1)..(111): unsure at all Xaa locations
  Clone ID: PAT_TA_74611.pep
MTFPQFDGENLRLWKIMCEQYFAMYGIDKSFWLPMATLNFSNTTTIXLQSVQRKVSGLNWEXVCEFLCGKFGIDQHQQLIRLFYHSSCRGYATTSGRWCSSGGRRTLTRPV

SEQ ID NO: 180194 - protein, 101 aa, Triticum aestivum
  unsure (1)..(101): unsure at all Xaa locations
  Clone ID: PAT_TA_74612.pep
LMTIRAFHSKILKRFSLGTAVGFXITKGVLTETPAILVFVARKGHKTWLNPNQCLPAILAGPGGVWCDVDVVEFSYYGAPAQTPKEQMFSELVNKLCGSDE

SEQ ID NO: 180195 - protein, 45 aa, Triticum aestivum
  Clone ID: PAT_TA_74613.pep
MAVDPFLGSRQMMKLAQKRYLLDTQQRDASFTGYGMLNSSISDEE

SEQ ID NO: 180196 - protein, 117 aa, Triticum aestivum
  Clone ID: PAT_TA_74614.pep
PPGVQTAAVRGVESRPNQERPRSSPSSSSSSPPRLDLAAHAWLAPRPTPALFGHGLKRHLWLGLLAPPAVSMVVLRLPCLRQSLSGLVDLLDLTSPSPAPCCGLWWSSKDLCEGFFL

SEQ ID NO: 180197 - protein, 37 aa, Triticum aestivum
  Clone ID: PAT_TA_74615.pep
QQTIWISLVRCYCISPESPPPAWSPPAQMIRTKKPSL

SEQ ID NO: 180198 - protein, 74 aa, Triticum aestivum
  Clone ID: PAT_TA_74616.pep
NLCQELQFGNIIRYSDMCTLPYHTSPLDTKFSSRTSGLQLNASEVIRKQIYESLRFHCTEILTKMMMFIRCSSS

SEQ ID NO: 180199 - protein, 176 aa, Triticum aestivum
  unsure (1)..(176): unsure at all Xaa locations
  Clone ID: PAT_TA_74617.pep
RSSKLLEAFHVGXFFPWLSWMGRRGFDRRLRTVRAXLGTFVDKIIDEHVRRGKNPDDADADMVDGLLALLADANQASGEDDLRFTRDNVXAMMMDMLFGGPDTVGFTIEWAMAEXMHCPDILLRLQQELVDIVGLDRTVDESDLGKLPFLKCVIQETLRMHPPIPIHLHGNTTDCV

SEQ ID NO: 180200 - protein, 139 aa, Triticum aestivum
  Clone ID: PAT_TA_74618.pep
MELATMVTLTLLALSAATLARLLVERARRRRCYLLDYVCYKGTDDRKLPTDLCGEIIQRNKLLGLEEYKFLLKVIVNSGIGEETYGPRNIIAGGDASPDRVAEGMEEMDETFHAVLDELFARSAAPGGLGLRPADVDLL

SEQ ID NO: 180201 - protein, 57 aa, Triticum aestivum
  Clone ID: PAT_TA_74619.pep
MYLNVYLILDTSICMTSDSGRREYHSPSVALFIHLTFHRVISRLSTIQPSYKRQYKP

SEQ ID NO: 180202 - protein, 98 aa, Triticum aestivum
  Clone ID: PAT_TA_74620.pep
PTPTSQTPTAPAPKPKPYKPSGLASPHPTQRLQIPVWQWRGPRPWSSRTTTSTWTSPPPRPNARFLEFEFQSAGWGGASVSRRREEAAYASPADELFY

SEQ ID NO: 180203 - protein, 114 aa, Triticum aestivum
  unsure (1)..(114): unsure at all Xaa locations
  Clone ID: PAT_TA_74621.pep
INGYCKEGKEKKAMKMFEHMAAKGIRTTVVTYTSLMYALSKKGMVQEAXGCSSEAVRRGIRPDLVMYNALINSHCTGGDMDRAFEIMGEMEKKRITPDDVTYNTLMRGLCLLGR

SEQ ID NO: 180204 - protein, 109 aa, Triticum aestivum
  unsure (1)..(109): unsure at all Xaa locations
  Clone ID: PAT_TA_74622.pep
REEEEDVGPRQGRQGLGKGGAKRHRKVLRDNIQGITKPAIRRLARRGGVKRISGLIYEETRGVLKIFLENVIXRDAVTYTEHARRKTVTAMDVVYALKRQGRTLYGFGG

SEQ ID NO: 180205 - protein, 146 aa, Triticum aestivum
  Clone ID: PAT_TA_74623.pep
MSDTDEHHFESKADSGASKTYPQQAGAIRKGGHIVIKARPCKVVEVSTSKTGKHGHAKCHFVAIDIFDGKKLEDIVPSSHNCDVPHVDRQDYQLIDITDHGYLSLLTESGNTEDDLKLPTDHVLLGQIKTGFADGKDLILSVMSAM

SEQ ID NO: 180206 - protein, 127 aa, Triticum aestivum
  unsure (1)..(127): unsure at all Xaa locations
  Clone ID: PAT_TA_74624.pep
MAIKRTKAEKKIAYDQKLCQLLEEYTKVLIAVADNVGSKQLQEIRKGLRGDSIVLMGKNTLIRRCIKVHSEKTGNKDFLELSNLLVGDVGLIFTKGDLKEVREEVAXYKVGAPARVGLVAPVDVVVP

SEQ ID NO: 180207 - protein, 116 aa, Triticum aestivum
  Clone ID: PAT_TA_74625.pep
ARKVLELERIPRFETNFVLEGGSIHVDGEGTCITTEQCLCHGNRNPHMSKDEIENQLKTHLGVSKVIWLPKGLYGDEMISGHVDNICCFTGPSTVLLSWIDDKSDPQYEHSGAAFD

SEQ ID NO: 180208 - protein, 157 aa, Triticum aestivum
  Clone ID: PAT_TA_74626.pep
MASSGAGAGRVRLAVVGDVHDDWILDEDTKALHFLQPDLVLFTGDYGNENVQLVKSISDLQFPKAAILGNHDCWRTHQFSEKKVDCVRLQLESLGEQHVGYQCLDFPTIKLSVVGGRPFSCGGDRLFRPKLLSQRLVRDVLTYRYLSSSNFLCISLS

SEQ ID NO: 180209 - protein, 159 aa, Triticum aestivum
  Clone ID: PAT_TA_74627.pep
KRYSTIIHSLWFLGVFVHEYVFFQLQNELQNVHSGLRMWRWRREMGRRPSVSPYLPAHSHRGFATRARRRRRPSSSWPTASRAKLPCPSALPRPRTLPPKESVQGALNRRPHRHLLSVLCLRVFSSSTSSGSPLSSTSSGSPLSSTSSGSPVDSHGGSR

SEQ ID NO: 180210 - protein, 96 aa, Triticum aestivum
  unsure (1)..(96): unsure at all Xaa locations
  Clone ID: PAT_TA_74628.pep
MLGVYSGEVVEVPAELVAAGSRTPSPKTRASELVKRFLXAPSPPCPWSLESLGNLAYSHAHQSLLLPRSFAAEDEIFCLFEGVLDNLGRLSQQYGL

SEQ ID NO: 180211 - protein, 183 aa, Triticum aestivum
  unsure (1)..(183): unsure at all Xaa locations
  Clone ID: PAT_TA_74629.pep
MSLVTDVRTRLXHWRNDGWEPLLEDVKVFCTKNDIPIPSMDDIFTKWGKSRKGGRNNVTADHFFRVDTFYAAIDSITTEFDHRFNEVSSELLQNFSCLDPRNSFSRFNLNKLARLTEIYHDDFSDSEREHIEHNLDLFIIHMRRIEDFRACHDIASLAQMIVELERHVMFPTVYRLIELALLL

SEQ ID NO: 180212 - protein, 68 aa, Triticum aestivum
  Clone ID: PAT_TA_74630.pep
RERLRERTLGAMRRAKVGAGRGRGVGRDAHQVWWRAGWETIRCNAHNGGQATTCEHQTSVSVHCYGNL

SEQ ID NO: 180213 - protein, 82 aa, Triticum aestivum
  Clone ID: PAT_TA_74631.pep
LFTHTPLSWHRRLGASSSCPRRDSDLVAVTLPRATEVQRPWCCPHATVIGGRCAAYRHGDSASRSYSLNFEAPSECCNFFCC

SEQ ID NO: 180214 - protein, 184 aa, Triticum aestivum
  unsure (1)..(184): unsure at all Xaa locations
  Clone ID: PAT_TA_74632.pep
LDSGETIAVKKLWPATTAAAAAFKDAGRDSFSAEVRTLGSIRHKNIVRFLXCCWNKSTRLLMYDYMANGSLGAVLHECGGGGAQLEWDVRYRIVLGSAQGLAYLHHGCSPPIVHRDIKANNILIGLDFEAYIADFGLAKLVDEGADFGRSSNTVDGSYGYIAPEYGYMLKITEKSDVYSYGVVV

SEQ ID NO: 180215 - protein, 125 aa, Triticum aestivum
  unsure (1)..(125): unsure at all Xaa locations
  Clone ID: PAT_TA_74633.pep
LPLFRPNSGGSXALGMGSPFRFHLWRHINSGDGRTKTPLSPTVAGSEPHPFSMTHGLGGSSVQLMESSRQSLGVYHSYSVGSLGQMQFSSELRNPTRGQTTLQSRRSQSREDLTSSLADLHIPKV

SEQ ID NO: 180216 - protein, 71 aa, Triticum aestivum
  Clone ID: PAT_TA_74634.pep
TTACSSSLNNSFCTTSFFIASFAKFSAKLPPRFRSEMVGGKACEPTGKNSFESASYVPGSLRDRSSDESRS

SEQ ID NO: 180217 - protein, 176 aa, Triticum aestivum
  unsure (1)..(176): unsure at all Xaa locations
  Clone ID: PAT_TA_74635.pep
TTTTFRPRTGLDPSPRPTHKSPPSSAPSPATXTLPSPSSSTTLAGAPSPVTDHRRSGSRAPWRERPSLTPDLPSPRAPSAPPXSTMQAHASALASPRRPEPPRRTTAPPASPSAPSTXPSSPLRSATTRPTLMPPSTTTSSTTPPCLSNQMLESRSQTPPSAIIPTTLEVPTTTCR

SEQ ID NO: 180218 - protein, 110 aa, Triticum aestivum
  Clone ID: PAT_TA_74636.pep
RRDRSRDRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGHVLPLRSVP

SEQ ID NO: 180219 - protein, 36 aa, Triticum aestivum
  unsure (1)..(36): unsure at all Xaa locations
  Clone ID: PAT_TA_74637.pep
TKYGKEFVAAAMEXRPDCGVNRTIIEKLSVKATIQR

SEQ ID NO: 180220 - protein, 66 aa, Triticum aestivum
  unsure (1)..(66): unsure at all Xaa locations
  Clone ID: PAT_TA_74638.pep
ALTEHQFSELTPVLXPEVVEALDRGGFRXRCTPXVQAATIPLLLTHTDVAVDAASGSGKTLAFVVP

SEQ ID NO: 180221 - protein, 175 aa, Triticum aestivum
  unsure (1)..(175): unsure at all Xaa locations
  Clone ID: PAT_TA_74639.pep
SSLPSKAYIEEVVQELQKGEGECPICLEAFEDAVLTPCAHRLCRECILSSWQSPAAGLCPVCRKXMTKQDLITAPTNSRFQVDVEKNWVESSKISFLLQELESLRSSGAKSIVFSQWTAFLDLLEIPLSRHGISFTRLDGTLNLQQREKVIREFSEDKRILVLLMSLKAGGVGIN

SEQ ID NO: 180222 - protein, 170 aa, Triticum aestivum
  unsure (1)..(170): unsure at all Xaa locations
  Clone ID: PAT_TA_74640.pep
SITITDVQQWLDERNVVIESVRQYLLCAQNRMKVXADKHRTKREFQEGDLVFLKLQPYVQSFVVHRAHHKLAFRYYGPYPITAKIGSVAYRMALPAASKIHPVFHVSQLKKFVAPHQQVLSKLPVPNSLLLVPMHILQCRVRQEGKRTIAQVLILCNDRAPDAATWEDLE

SEQ ID NO: 180223 - protein, 34 aa, Triticum aestivum
  unsure (1)..(34): unsure at all Xaa locations
  Clone ID: PAT_TA_74641.pep
FSSRSGXHIGSSSPAGSSPSAAMPMLPLKEVPKY

SEQ ID NO: 180224 - protein, 123 aa, Triticum aestivum
  unsure (1)..(123): unsure at all Xaa locations
  Clone ID: PAT_TA_74642.pep
WQVVDLPAFNQSPEEREGGILGNSGGFSSLEPLGVPPPWCEHEEPAPSVVADDVLPAMDVALHEMVCQGEEEQAKVAEKVTSSNDLEHFEEALPXGLVGEVPPFVSSSVTFASGGITNIVSSG

SEQ ID NO: 180225 - protein, 57 aa, Triticum aestivum
  Clone ID: PAT_TA_74643.pep
IEEGLYIRSKIISIRPCSDIHQIRGIRRVVEHLICSSSNLAYNSAGSAEPSLGAEGL

SEQ ID NO: 180226 - protein, 168 aa, Triticum aestivum
  unsure (1)..(168): unsure at all Xaa locations
  Clone ID: PAT_TA_74644.pep
MEVLMALXGTPMETDDPITSYMLQAWARLCKCLGQDFLPYMHVVMPPLLQSAQLKPDVTITSAESDDEIESDDDSIETITLGDKRIGIRTSVLEEKATACNMLCCYADELKEGFFPWIDQVAPTLVPLLKFYFHEEVRRAAVAAIPELXRSAPLAVEKGQAPGRDESY

SEQ ID NO: 180227 - protein, 87 aa, Triticum aestivum
  Clone ID: PAT_TA_74645.pep
MEKVRKASLCFFSSKIPRASVQLHIRVCYVDSIIFRMLVCTKIWYIYCLQLSIMFCSKATCCKVVYVLGFQYSFQNKTVVQVLKLFR

SEQ ID NO: 180228 - protein, 51 aa, Triticum aestivum
  unsure (1)..(51): unsure at all Xaa locations
  Clone ID: PAT_TA_74646.pep
IPGSSISSLLFCSCNKTFVECTSLKXVLLVRTIAWRCNPKSYASVVMLLYL

SEQ ID NO: 180229 - protein, 48 aa, Triticum aestivum
  Clone ID: PAT_TA_74647.pep
YERREYHIKGTYKRFHFSIVRSNKIICSLTGTNCRRFAPKVLFKEVKQ

SEQ ID NO: 180230 - protein, 186 aa, Triticum aestivum
  Clone ID: PAT_TA_74648.pep
GHIVRSTGRKDRHSKVCTARGPRDRRVRLSAHTAIQFYDVQDRLGYDRPSKAVDWLIKNAKDAIDNLDTLPAWQPTAVAPAASNAAAPPSSSTQPDSADNSDDQAQAITIAHSSFDFAGSGGAGGATGGISFLPPSLDSDSIADTIKSFFPMGGTTGGEPSSSTVAAHSSAMGFQGYTPDLLSRTG

SEQ ID NO: 180231 - protein, 170 aa, Triticum aestivum
  unsure (1)..(170): unsure at all Xaa locations
  Clone ID: PAT_TA_74649.pep
VNPKVFFDTTIGGQPAGRIVMELFADQVPKTAENFRALCTGEKGTGKSGKPLHYKGSSFHRXIPQFMLQGGDFTRGNGTGGESIYGEKFEDENFNLRHTGPGILSMANARPGTNGSQFFICTVKTSWLDGKHVVFGQVVQGLEVVQAIXKVGSQNGSTKQTVPIADCGQF

SEQ ID NO: 180232 - protein, 113 aa, Triticum aestivum
  unsure (1)..(113): unsure at all Xaa locations
  Clone ID: PAT_TA_74650.pep
SPAPITGEDKTILASETMEIPEEVTVKVSAKIXSVTGPRGTLTRNFKHLNLEFQLQEGGRKLKVDAWFGTRKTMADIRTAISHVQNLITGVTKGFRYKMRFVYAHFPINASIT

SEQ ID NO: 180233 - protein, 83 aa, Triticum aestivum
  unsure (1)..(83): unsure at all Xaa locations
  Clone ID: PAT_TA_74651.pep
LPTPATPTPSTPTPPRXRWTASARPPTDATPSPDLLPLTGSSPSSSPAAPSRRPRLPPPQPRAPAPPRAHGSTTTGPHLGTTA

SEQ ID NO: 180234 - protein, 44 aa, Triticum aestivum
  Clone ID: PAT_TA_74652.pep
VHTNKSSAAKQIRISVGHNEGLGRRHTILTRKQLLYFSVTASCR

SEQ ID NO: 180235 - protein, 45 aa, Triticum aestivum
  unsure (1)..(45): unsure at all Xaa locations
  Clone ID: PAT_TA_74653.pep
LWWXLGLTTSVHPRVLXCVHQPATPLPPXLRDPLPSSPSPAVAWR

SEQ ID NO: 180236 - protein, 66 aa, Triticum aestivum
  Clone ID: PAT_TA_74654.pep
AAPSLATAATAILAVLAAALATAARAQTCGSQAGGATCPNCLCCSRFGFCGSGSEWCGAGCQSQCS

SEQ ID NO: 180237 - protein, 45 aa, Triticum aestivum
  unsure (1)..(45): unsure at all Xaa locations
  Clone ID: PAT_TA_74655.pep
VVLGARPISSGAASSVHXSLLPLAFTQGATVVRTRSKPLQPRGSS

SEQ ID NO: 180238 - protein, 166 aa, Triticum aestivum
  Clone ID: PAT_TA_74656.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKHMICCCNKMDATTPKYSKAR

SEQ ID NO: 180239 - protein, 110 aa, Triticum aestivum
  unsure (1)..(110): unsure at all Xaa locations
  Clone ID: PAT_TA_74657.pep
SWSRVSGAPNEHFSSTSPQIPTTLPLSLLPTRRALPPGEAFFPGLLSPGLIFPQKFPRGAFPWGATPRLFSPYPENPGRVHPXFPFSPKFGGGRKRRKTGQRGGPRTPRL

SEQ ID NO: 180240 - protein, 35 aa, Triticum aestivum
  unsure (1)..(35): unsure at all Xaa locations
  Clone ID: PAT_TA_74658.pep
LFWLLGPXTYALSYLVLFRPSIGLCSYSAMAVPCF

SEQ ID NO: 180241 - protein, 96 aa, Triticum aestivum
  unsure (1)..(96): unsure at all Xaa locations
  Clone ID: PAT_TA_74659.pep
GLQINMKGRWHSGPMYVGTGCCFNRQALYGYDPVLTEADXEPNXVVKSXCGGRKKKSKSYMDNKNRMMKRFXLLSPIFNMEDIEEGIEGMCLQFLP

SEQ ID NO: 180242 - protein, 94 aa, Triticum aestivum
  Clone ID: PAT_TA_74660.pep
RGSMVLLFSLTFSSSVVVLFNGCNKNSMLAGGPGSSLDRPLPFPARKFLNRFPALIECKIQLHWVGDSLPSAPNFCYLLRALPPTTGYSTGSDP

SEQ ID NO: 180243 - protein, 133 aa, Triticum aestivum
  Clone ID: PAT_TA_74661.pep
MMETKPPSPGSGGGSAPGVHHHRRWAAPLLASVLLSSLLISASLFFSSSRALLLSFSPLPSAAPGEPLFVEAKLRQQQQEARARPHRAVPRIAYLVSGSAGDGVALRRTLRALYHPANRYVLHLDLEAPAAER

SEQ ID NO: 180244 - protein, 50 aa, Triticum aestivum
  unsure (1)..(50): unsure at all Xaa locations
  Clone ID: PAT_TA_74662.pep
WCXIFPRRPLPTADASCASAQLXGKVAQEPRQGSTALTGPRALVRVVAXV

SEQ ID NO: 180245 - protein, 111 aa, Triticum aestivum
  unsure (1)..(111): unsure at all Xaa locations
  Clone ID: PAT_TA_74663.pep
GYTTTYYTPPPRHRRTAIGTEEGEGPGGVRTKPAKYGRRQAEEEEVGARXKQKEKVEQRGSYYTTRSTYDKLAHRGSPSTSQIHRPTVPTTDVAYRIQRLRYVYAGPXQGS

SEQ ID NO: 180246 - protein, 151 aa, Triticum aestivum
  unsure (1)..(151): unsure at all Xaa locations
  Clone ID: PAT_TA_74664.pep
VPRLIVDPRGCRIFGLRLFRLPPPPQPAACLEPPSPWGEDLRGAIWQIKNQAHHPQVQGSLPVCVACTLKHPVHLMHCRAMHSTASVLSHSSSLTWWFHPCFSMXQHRAAHCSPQIAVLLSRCXHLVHLLCNHSTPLHSSHCQCTQALPYP

SEQ ID NO: 180247 - protein, 61 aa, Triticum aestivum
  Clone ID: PAT_TA_74665.pep
KMSYILVQREYHITTPKWENASKCYITKKEMHHNVITEVSERCIKSEQKVLIRIPLFPMVI

SEQ ID NO: 180248 - protein, 122 aa, Triticum aestivum
  Clone ID: PAT_TA_74666.pep
TYAFLYMCELRSFTSHTHLVFHQVKLSTLMPLSKREVNGRLYIEEVGVDLELCVHAHGHDVDPIMEASCNNNYFLVIISFGICELILCNHGSDHIFYLIPFLGQVKPLVLYRSIHPSNLYFD

SEQ ID NO: 180249 - protein, 79 aa, Triticum aestivum
  Clone ID: PAT_TA_74667.pep
RERTSLSFFFFFLAQMPFQRINICTFLQFCHTTSSLSVSPPPAMCHPSSHSPHPFLPHLSPNTLHPHHTQLCTQHISTA

SEQ ID NO: 180250 - protein, 33 aa, Triticum aestivum
  Clone ID: PAT_TA_74668.pep
RFVDPESPFTCKPSAPSLESTCGHTDEGSCLKL

SEQ ID NO: 180251 - protein, 41 aa, Triticum aestivum
  Clone ID: PAT_TA_74669.pep
WLVFWDISGIQPQLSPTSFTIIYSSLFFIWLFVVCNCMQLA

SEQ ID NO: 180252 - protein, 223 aa, Triticum aestivum
  unsure (1)..(223): unsure at all Xaa locations
  Clone ID: PAT_TA_74670.pep
MGKEKIHISIVVIGHVDSGKSTTXTGHLIYKLGGIDKRVIERFEKXSAEMNKRSFKYAWVLDKLKAERERGITIDIALWKFETTKYSCTVIDAPGHRDFIKNMITGTSQADCAVLIIDSTTGXFEAGISKDGQTREHALLAFTLGVKQMICCCNKMDATXPKYSKARYEEIVKEVSSYLKKVGYNPDKVPFVPISGFEGDXMIERSTNLTGTRAHPSRGLTDQ

SEQ ID NO: 180253 - protein, 53 aa, Triticum aestivum
  unsure (1)..(53): unsure at all Xaa locations
  Clone ID: PAT_TA_74671.pep
WAXTWNRKKLKTRLGTGSLGSVAWECPKVEPRXNQQTPXGFPTKLXLRRLIYX

SEQ ID NO: 180254 - protein, 67 aa, Triticum aestivum
  Clone ID: PAT_TA_74672.pep
MMKPQHGAAGGGGHGRRTPFLTSYALTLAFITFVSLLYFKDFSSTLHQPFLHHPPPRHRPRPHPHVP

SEQ ID NO: 180255 - protein, 81 aa, Triticum aestivum
  unsure (1)..(81): unsure at all Xaa locations
  Clone ID: PAT_TA_74673.pep
PASGARRPMGTNSNQXKGTKLNYTGYYLANSIHSRLKHGLQKPSPPANRHQPKWQAVRLPAPTPPRPKANPIIRPTFQPVF

SEQ ID NO: 180256 - protein, 245 aa, Triticum aestivum
  unsure (1)..(245): unsure at all Xaa locations
  Clone ID: PAT_TA_74674.pep
MEGGKPSTQRHSSGAVRPIVLVVVAVSLVVVLFMATRVSPGCRPLLKAVYQQGLGRAGPSATADPLLXXXLLSPDFDDRSCLSRYRASLYRQPSLHNLSSHLVSRLRRYESLHQLCGPGTPAYSRAVARLREAMDGHASSNSTSSSDTECSYIIWTPVEGLGNRILSTASAFLYALLTDRVLLVHHPADDLNDMFCEPFPGSNXTWVLPEEGFAIQGXQGAQRPTRESLGQRGWGRGREPAGARG

SEQ ID NO: 180257 - protein, 63 aa, Triticum aestivum
  Clone ID: PAT_TA_74675.pep
QTRRRRSAAMNPEYDYLFKLLLIGDSGVGKSCLLLRFADDSYLESYISTIGVDFKIRTVEQDG

SEQ ID NO: 180258 - protein, 38 aa, Triticum aestivum
  unsure (1)..(38): unsure at all Xaa locations
  Clone ID: PAT_TA_74676.pep
EEXHGDQEHAMTVQEYPRPNCRSPGMPLVDKXGGHRVA

SEQ ID NO: 180259 - protein, 67 aa, Triticum aestivum
  Clone ID: PAT_TA_74677.pep
HEVEAWVRRAFKEERPLSEVVDPSLLGEVHAKKQVLAVFHVALGCTEPDPELRPRMRAVAESLDRVN

SEQ ID NO: 180260 - protein, 57 aa, Triticum aestivum
  unsure (1)..(57): unsure at all Xaa locations
  Clone ID: PAT_TA_74678.pep
VALVPLTRPWPRTASSLRPDVSXLSXSDSPSKXVLAALATARHLLLACXRTYLGERG

SEQ ID NO: 180261 - protein, 71 aa, Triticum aestivum
  unsure (1)..(71): unsure at all Xaa locations
  Clone ID: PAT_TA_74679.pep
APGGSPAGVWPPGXRNNRETRAPFWFFNRGPHKAFPLCFVKGPFPSQLEPGTGSYPRATXTTFEFPDSDCL

SEQ ID NO: 180262 - protein, 160 aa, Triticum aestivum
  unsure (1)..(160): unsure at all Xaa locations
  Clone ID: PAT_TA_74680.pep
RCFVGGXAWATDDQSLQNAFSKYGDVIDSKIITDRETGRSRGFGFVTFASDEAMRQAIEAMNGQDLDGRNITVNEAQSRRSGGGGGGFGGGGGGGGYGGQRREGGGGGGYGGGGGGYGGGRSGGGGGYGSREGGGGYGSGGGGRGYGGRRGGSGGGNWRE

SEQ ID NO: 180263 - protein, 117 aa, Triticum aestivum
  Clone ID: PAT_TA_74681.pep
MESFAAEGFEADLEVSFGDNVLDWDATDRGARETTPCSLIYSSETMSTPGSATGARNHSRRRAQTPVCRYVPSSLEMDEFFAAAEQQQHQTFREKYNFCPASERPLPGRYEWTVLDC

SEQ ID NO: 180264 - protein, 210 aa, Triticum aestivum
  Clone ID: PAT_TA_74682.pep
RHEVHLAQAFSLPCTTTTSSHPNFQGWWCRNHRAPSGYTMALVDWIELSDDAEIIELSSGEENVEEYQEASTQSNSAQHQATLHDDQTVFVADGEGREEATESGNAEEATASSSVTEKESGNPEEAAVSQTCPHTPTAVVTEKESGNPQEATVSQTCPHTATAVTFPGPDPPSPKALTFEACVAKPGERRRNVAGSSSMPIHLGLVGALA

SEQ ID NO: 180265 - protein, 68 aa, Triticum aestivum
  unsure (1)..(68): unsure at all Xaa locations
  Clone ID: PAT_TA_74683.pep
SNHHHLNYPADLPPTHPNRIASKNEALEILNLQISLRLCRALCVVLYRVCACSVSXIPFLLIATXSAF

SEQ ID NO: 180266 - protein, 161 aa, Triticum aestivum
  unsure (1)..(161): unsure at all Xaa locations
  Clone ID: PAT_TA_74684.pep
GTRSQSNPPSTAGASRRGRASDGGSQSEGAHGAVTGSSSDTRAAAGWPSARLPADGLAGPFPRTFPPTGVAPTPPRRLALAPPRPPPPASRAGARPRIRAPPPTPGLEGRRPTSRLPPXDSRYPPPLRRRSPTRAPPPPPCFLPTAYPCAVGNQPPCTASA

SEQ ID NO: 180267 - protein, 76 aa, Triticum aestivum
  unsure (1)..(76): unsure at all Xaa locations
  Clone ID: PAT_TA_74685.pep
STMVQXKNPALLKVSQFLLHWHGGTRGKLQPTEGPDGKAHSRGGRXQMPGREKWGSLVKKTTPRGARAPPGGEFPX

SEQ ID NO: 180268 - protein, 126 aa, Triticum aestivum
  unsure (1)..(126): unsure at all Xaa locations
  Clone ID: PAT_TA_74686.pep
ALFSAXHSCGGARIGGEAAAEPSHRRHHGYSRVTPCTSAGPPGGXKPRKLRPALRHGGHAHGRHTLLEPSXAPPKDTXAQSSLKGYIGTPNKEHVQARAPLLRRAALTLAHACDAAFPFPGFPPFW

SEQ ID NO: 180269 - protein, 62 aa, Triticum aestivum
  unsure (1)..(62): unsure at all Xaa locations
  Clone ID: PAT_TA_74687.pep
LFFRETGGKHLRETTXGGPTGPXPIFLRVKTPKSPTKNFGVFPIFRPTGVVPTLWPPFPGFA

SEQ ID NO: 180270 - protein, 70 aa, Triticum aestivum
  unsure (1)..(70): unsure at all Xaa locations
  Clone ID: PAT_TA_74688.pep
RKLKLGDSPPGGALGQREISGGNGKGAKGKVPERGTXNRGWVYTLIGGGALGLGTNFLKKGFTLGKAPGX

SEQ ID NO: 180271 - protein, 27 aa, Triticum aestivum
  unsure (1)..(27): unsure at all Xaa locations
  Clone ID: PAT_TA_74689.pep
PTTLQRHRGIRSRRTMYEWYPXIDIYS

SEQ ID NO: 180272 - protein, 104 aa, Triticum aestivum
  unsure (1)..(104): unsure at all Xaa locations
  Clone ID: PAT_TA_74690.pep
PVYSIDRGSSNPSSPPLKMQIFVKTLTGKTITLEVESSDTIDNCEWPMIQDKXGIPPDQQXRLIFAGKQLXDCVRTLADYNIPEGIPPLPPGSYRLRWWHADLT

SEQ ID NO: 180273 - protein, 92 aa, Triticum aestivum
  Clone ID: PAT_TA_74691.pep
YDDISQARGHRVTQLRNIHSTVCTCTAISPTRDRAEECRPSATCPLSSDPCAPHSQPCSLRPSRLRTCEFIYFASGKRWLDGQGLVEVLPDN

SEQ ID NO: 180274 - protein, 85 aa, Triticum aestivum
  Clone ID: PAT_TA_74692.pep
AAVKLVASPWLQAFGGLVVLTRIILKVSRRLGHGCLSQPKSGLFCGASTRCPLSVPPQAAAACLPHALSCTCTGVHTVSPQCRCC

SEQ ID NO: 180275 - protein, 241 aa, Triticum aestivum
  unsure (1)..(241): unsure at all Xaa locations
  Clone ID: PAT_TA_74693.pep
MGVVAVRKSSTVVVRPPPEPATATVNINLSPLDKNVMSVPAAVFMVFDSRIXNPAATIEKALSQALAHYPAVSGRLAAGAEQGEFHIRCTGEGVPFVAAAADCALKDAEFFGRSAAGALLEELAIYYPAEHCGFGDPLLMMQVTEFSCGGFVVGVTWNHVLADAAGIGQFLQAVGELARGLPSPSVAPVRRDDALTAVPPAHRRLRGAYDDAPAGRHPRSTSPLPMGADRPSGRVHAGGSS

SEQ ID NO: 180276 - protein, 54 aa, Triticum aestivum
  Clone ID: PAT_TA_74694.pep
SGNNKKFRPSVSDAEHMQWHKCLKPGISNRHVHAYGNKKQGLKFKSGIGKMDKS

SEQ ID NO: 180277 - protein, 52 aa, Triticum aestivum
  unsure (1)..(52): unsure at all Xaa locations
  Clone ID: PAT_TA_74695.pep
WAAQQSIVNWLSFKACKHAIXMASSGQGLCEQAFVMACXAAVWWCLLCNLCS

SEQ ID NO: 180278 - protein, 87 aa, Triticum aestivum
  Clone ID: PAT_TA_74696.pep
ARHSFTPVLRLLASSPSHSLLIPQLLVDQPLPAHHDTPLNDVTTCPQYKIPSAYLTQSPLRNFPNALLFRRGAEHHRRWPGCCRQPP

SEQ ID NO: 180279 - protein, 152 aa, Triticum aestivum
  Clone ID: PAT_TA_74697.pep
MLLPPSSLPPPPPSTSPSSPLPLVRAMSPLTPSPTPPGPLVVTGAYPTGPAGGEAKPSTPAGSEGLRPSPLPRVVTTLLLPPTLLSQPPRFPLSRLPPPACPPSPLPCTPSPVTAPTPTLPAPLASRPPPSLPCPLAPVPFPPRSSPASLSS

SEQ ID NO: 180280 - protein, 37 aa, Triticum aestivum
  Clone ID: PAT_TA_74698.pep
LEAHPYLLEDGINVLIYAGEYRPYIAIGSETQGGSTT

SEQ ID NO: 180281 - protein, 70 aa, Triticum aestivum
  Clone ID: PAT_TA_74699.pep
YIFSTYVVCYHFVEDFLNCYVCRYVQMDVINFIMFHTMQIFFVGPKLALGFEDRIMLKTYWVKLWPKEMG

SEQ ID NO: 180282 - protein, 42 aa, Triticum aestivum
  Clone ID: PAT_TA_74700.pep
YVSVWQMLRGAMLLSLVDLHAPSRGFHSCLSNPFGIRTLAVL

SEQ ID NO: 180283 - protein, 62 aa, Triticum aestivum
  Clone ID: PAT_TA_74701.pep
SGACTSEGQWNCIDGKSFQQCGSGTWSTAMAVAQGTTCQVGQSTTLSISAAKIKRVVRAFRA

SEQ ID NO: 180284 - protein, 116 aa, Triticum aestivum
  unsure (1)..(116): unsure at all Xaa locations
  Clone ID: PAT_TA_74702.pep
ADSLTEEQVSEFKEAFSLFDKDGDGQITTKELGTVMRSLGQNPSESELXQNLINEVDADNNGTIDFPEFLTMMXRKMKDTDSXEEIREAFKVFDRDNNGFISAAELRHVMTSIGEK

SEQ ID NO: 180285 - protein, 154 aa, Triticum aestivum
  unsure (1)..(154): unsure at all Xaa locations
  Clone ID: PAT_TA_74703.pep
CPLLGAWIAETYLGRFKTILYSVLVAEIGHLILVALAAPSVLENSNTALGVLILGLIIMGLGTGTFKPNIAPXIAEQVPQEKMRVETRGTERVIVDPAVTVTRIYNWFYFFINIGALVGQISMVYAERYVGFWLAYLIPHVMFIIALPVLIFCK

SEQ ID NO: 180286 - protein, 47 aa, Triticum aestivum
  Clone ID: PAT_TA_74704.pep
RRSLMGESSEFVGEKVAYALAQGLKVIACVGETLEQREAGSTMAVVA

SEQ ID NO: 180287 - protein, 151 aa, Triticum aestivum
  Clone ID: PAT_TA_74705.pep
MASLHYLPPVKPSAIALGTAFNHAVSLAVLGPVFGDAYRRAQQANSKEEYFHSKEAATAAASWGSSVLGSGIQAYGVGALINATGTLTYKGAAYLGSLIFFASAAPSIVSQVVTEKRPMDTIAIGALARVLKTVGLSMFLTYWGTRTNPFD

SEQ ID NO: 180288 - protein, 95 aa, Triticum aestivum
  unsure (1)..(95): unsure at all Xaa locations
  Clone ID: PAT_TA_74706.pep
APLRVKADSGASKTYPQQAGAIRKGGHIVIKARPCKXVVKVSTSKTGKHGHAKCHFVAIDIFNGKKLEDIVPSSHNCDVPHVDRQDYQLIDITDN

SEQ ID NO: 180289 - protein, 60 aa, Triticum aestivum
  Clone ID: PAT_TA_74707.pep
GLTQTNVCAEPGDSGGSWYSGAQAQVVTSGGSGDCSSGGVTYFQPVNEILSAYGLTLTRG

SEQ ID NO: 180290 - protein, 37 aa, Triticum aestivum
  Clone ID: PAT_TA_74708.pep
LPLSRAIQFTLNCFRVQSGNLPKSTIIVHQVEPGEWK

SEQ ID NO: 180291 - protein, 126 aa, Triticum aestivum
  Clone ID: PAT_TA_74709.pep
ALLALCDPQKLAENSITPDYSKSLPEIYAQLIHMVVDDDRWENNWKAAFIVLAIPHALMLKESELEGLDQEAMSILEEYRKYYYDDPGCSSGLVERIVRCYTSSLPDALFLELTENEMRRFICTAT

SEQ ID NO: 180292 - protein, 43 aa, Triticum aestivum
  Clone ID: PAT_TA_74710.pep
AQEAGLPPEGLHLVLGQRTISHETSFEVVVESMGAHPAMREPI

SEQ ID NO: 180293 - protein, 80 aa, Triticum aestivum
  Clone ID: PAT_TA_74711.pep
QRVVVKLNDQLLQFHSPLDRRVLQRVDRHVKHTKWKNLQHTSPFLHLINHSTPLDTSSIDTFKWLMEIPNVGFERSVELQ

SEQ ID NO: 180294 - protein, 44 aa, Triticum aestivum
  Clone ID: PAT_TA_74712.pep
RYEKYTTWNSANMRVTIHSASLAIAALAVAASATPMGLPNRQST

SEQ ID NO: 180295 - protein, 113 aa, Triticum aestivum
  unsure (1)..(113): unsure at all Xaa locations
  Clone ID: PAT_TA_74713.pep
LGSTVSWGLYFFFYNRAKQRYLQEKDVQLRPFDHLASAAEAGALVCLFTNPIWXVKTRMQLRTPGHTSSYSGFSDALRTIRKEEGWRALYRGIGPGLLLVTHGAIQFTAYEEL

SEQ ID NO: 180296 - protein, 104 aa, Triticum aestivum
  unsure (1)..(104): unsure at all Xaa locations
  Clone ID: PAT_TA_74714.pep
VALNRRVVTRNVLTSPISLPYTNLSTNTNTIPSPPGPPPPRRRSISSSSYXSTNPDHHVSNILSNPMSHSRSTHSRRSSADTTRRMSSVREESKSEEGSVEDGE

SEQ ID NO: 180297 - protein, 156 aa, Triticum aestivum
  Clone ID: PAT_TA_74715.pep
RSPSTPAIALRARRPSPSGLATARAMRPVDPAPAAPPPRPPTTATRHRRSVAATSLPGRGQGRGTYQNGNQGGRGQAHLMPGGRPLDRIFCTVGCALSSIGACSLGASQRRWRARASPRQPCSRLPHDLPWHGFFFDSSSAAAAVVGSGRPDRRHA

SEQ ID NO: 180298 - protein, 178 aa, Triticum aestivum
  Clone ID: PAT_TA_74716.pep
KVSWAIPVDETAKEELKQREVPNAKMRTRTQPSRRGKGAAGEASNASVIPSLGNFDRESQPCMQPTHSEQQPVGTMFQRYPNKGEVQKQVQRRSKRQEPSGRENLSRALVPAPVRKSTRRKSRHLQGWLGERFLYSNRLPGAIGIKSYSRGEDGKVALRVESFLPKKYSDLVAQVGMY

SEQ ID NO: 180299 - protein, 87 aa, Triticum aestivum
  Clone ID: PAT_TA_74717.pep
ITRRHAYSIAPTPSQEEIIEMWDMKEVVNRRQGSATSLAEAAEASAREAEGSAADAVTVSDNTTTGVLAAKALMPHETNGCVVCVGW

SEQ ID NO: 180300 - protein, 160 aa, Triticum aestivum
  unsure (1)..(160): unsure at all Xaa locations
  Clone ID: PAT_TA_74718.pep
SASAGSAATPASVPNTVTIPCHHIRMGDILMLQGRPCQVIRISTSAATGQHRYLGVDLFTKQLHEESSFISNPAPSVFVQTMLGPILKQYRVLDLQDGNVVAMTESGEVKTSLPVVDQGGLWERLSRAFSTGRGSXRILVISDNGRELAVDCKVVHGASL

SEQ ID NO: 180301 - protein, 131 aa, Triticum aestivum
  Clone ID: PAT_TA_74719.pep
GRRLAGQAHSGSPSSDGSTPLAPLLLAPSLPVIEAVAITTATSWILLDALSWSRRAGAGRHDESVPRRLSGQYLTMTPVLKLNALISSALPGPCSTPPSSHPLLVNVPIHSMRSPPHNLQSDSSLPQVVVY

SEQ ID NO: 180302 - protein, 124 aa, Triticum aestivum
  unsure (1)..(124): unsure at all Xaa locations
  Clone ID: PAT_TA_74720.pep
MKGAKSNGAVXADTKLAVKSKGAEKPAAKGKNVQAGKDPNKPKRAPSAFFVFMGEFREEFKQKNPKNKSVAAVGXAAGERWKSLSESEKAPYVAEANXKLKGEYNKAIAAYNKGESAAAAAPKK

SEQ ID NO: 180303 - protein, 142 aa, Triticum aestivum
  unsure (1)..(142): unsure at all Xaa locations
  Clone ID: PAT_TA_74721.pep
SVGSGAGTRTPPPPATKKPAMAMVPRRSKPLWLWRSRLAQQPVTRRSRRTMDMAVPACKMGEQPLTEIESSTVSTVEEKEVTKEPEIPMWDSDDXGEFMLKAKAELEELHIACVKSITELDPKSKLLVPTRFCSFNIAGFDL

SEQ ID NO: 180304 - protein, 74 aa, Triticum aestivum
  Clone ID: PAT_TA_74722.pep
SVNLMQSYSNNSPHNLKMYLTVPDHLRKPKELNPILSTRYGKLPQNLEVVVFRLMLYLDLCLLYGKHCYFSCAK

SEQ ID NO: 180305 - protein, 136 aa, Triticum aestivum
  unsure (1)..(136): unsure at all Xaa locations
  Clone ID: PAT_TA_74723.pep
MEDDSGEDSEELGDGEDGPCLAWTKRERRNTARFHLAVCHPLSRRYVLLPTIPEDLAAQPQDRLWAFEPVLAPNTGDDXEEEPFKVICFARYQTKLVLFVFSSTTKQWSMVNSPFAPFVEHTSRFDCVRGCFYWSQ

SEQ ID NO: 180306 - protein, 73 aa, Triticum aestivum
  Clone ID: PAT_TA_74724.pep
ATEPPSHGFSSIPPPGRVSSIKAGEALSQSTSGNSENKSDIELLWFQVIAFGYYRILLETGWLAVQGDDDLVH

SEQ ID NO: 180307 - protein, 53 aa, Triticum aestivum
  Clone ID: PAT_TA_74725.pep
GVLWHMHTVTPCGVLCRHVLWVVGRALVWVSRRQELDRNPQVLDRDGEQVALV

SEQ ID NO: 180308 - protein, 114 aa, Triticum aestivum
  unsure (1)..(114): unsure at all Xaa locations
  Clone ID: PAT_TA_74726.pep
KPNQFPPRNSPGLGQFGLXGFGRNLRGRVILNSVLSRPPNFPVSLINENILGKCFRSCSSFINPRISPLTMKYECPRLSLLIITPIPKANTIGPESYDVSHANVXQSVQPGDPL

SEQ ID NO: 180309 - protein, 248 aa, Triticum aestivum
  unsure (1)..(248): unsure at all Xaa locations
  Clone ID: PAT_TA_74727.pep
SPGCRIRYEALKNWSGKRPRSCSKRDEGEYASLQAIHDAVPSLCPQPLGHGRFESQPSTSFLVTEFLHLTGRSSSKSNPPSLAXKLAKLHTLPAPXPEGCDKPMFGFPVTTCCGXTTKINSYREXWADYYAENRLRSILRSAEQXMGEGTAGQEASQQTAAMVVPRLIGDIISIRQGVCTRRLHGDLWSGNASAGXWYKKGRGCRLVYDSSDMLXHNEFELGAMKFGGFXREFLKESLSCVQDGAVRI

SEQ ID NO: 180310 - protein, 73 aa, Triticum aestivum
  Clone ID: PAT_TA_74728.pep
QHHGAYNISRDVKKLKTQPDATLILNSSKSPANPVHTDPFTMEEPTPHNPFLHLSRRNVVLDTCSISTPRQHT

SEQ ID NO: 180311 - protein, 69 aa, Triticum aestivum
  Clone ID: PAT_TA_74729.pep
LYNRLNSFVFNISFRFVHLQLEEKGMSFAYVFSSFYTCLFAPRCSTQRREHDKHQLWAILQFVLTIWIL

SEQ ID NO: 180312 - protein, 89 aa, Triticum aestivum
  unsure (1)..(89): unsure at all Xaa locations
  Clone ID: PAT_TA_74730.pep
DTGSDSAVFILQNGASISNVIIGANALEGVHCLGSCTLTNVWFRDVCEDAISILGSGHALIQGGGAAQASDXVIQHNGAGTVTIKNYTI

SEQ ID NO: 180313 - protein, 169 aa, Triticum aestivum
  unsure (1)..(169): unsure at all Xaa locations
  Clone ID: PAT_TA_74731.pep
ARGTGVFTTTEKAKAHLKGGAKKVVISAPSADXPMFVMGVNHETXYSSDIEVLSNASCTTNCLAPLXAKVVHDKFTIIEGLMTTIHSYTATQKVVDGPSAKDWRGGRTAAQNIIPSSTRAAEAVGEVIPELNGELTGMAMRVPTANVSVVDLTVRIEKAASYDEIKQAI

SEQ ID NO: 180314 - protein, 129 aa, Triticum aestivum
  Clone ID: PAT_TA_74732.pep
VIVDPRAAEFLRGQAAKRGWEEMASAAYLLAHRRVTPVRAPYGSVDLPDLGHRRGCRLRREKEWSSFRTRGGGAANRAQGRPRWPQIFAGLTTRSCKKTGRRKMSSIVALRTKEEITRLANSQFSFTSC

SEQ ID NO: 180315 - protein, 119 aa, Triticum aestivum
  Clone ID: PAT_TA_74733.pep
IVECDCCSAVLCCAVLCLHPSRSLAAPACVRTCGAEESTLESCSRQTNRKHSDLGDPRDGPKFQFFLTHRIQAIGTHERLKPKQTWEGIGFPPVGWPKGSVARKWKKAPTLANTGGFPQ

SEQ ID NO: 180316 - protein, 52 aa, Triticum aestivum
  Clone ID: PAT_TA_74734.pep
MGRVRTKTVKKSAKVIIERYYPELSLDFETIKRICDEIAIIASKRLRNKIAG

SEQ ID NO: 180317 - protein, 150 aa, Triticum aestivum
  unsure (1)..(150): unsure at all Xaa locations
  Clone ID: PAT_TA_74735.pep
LIVDPRAAGSFYTLGXXQLIVAINKMDTTKWSEARFXEIIKETXRPIIKKVGYNPKQVAFVPISGFNCVDNMLEVSTNAPWYKGWEKEICXGTSSPCKTLLEAIDLHRRTPKAFLTDKAPFRLSLPRELFLTKNLGGYLGNRVGPGSGPV

SEQ ID NO: 180318 - protein, 68 aa, Triticum aestivum
  unsure (1)..(68): unsure at all Xaa locations
  Clone ID: PAT_TA_74736.pep
VASRYAVHATXMVLVASPGLPAGLSRIPAGSSPCEVGGGLCTYGAAPAVASYVGVLSCYPPLAVAATC

SEQ ID NO: 180319 - protein, 168 aa, Triticum aestivum
  unsure (1)..(168): unsure at all Xaa locations
  Clone ID: PAT_TA_74737.pep
MPNATNSTTFMIPIVGAGADPWMFRHEDYYYMTYTNNVNITLWRSMSLTSWDAAESKTIFVPEPDXAYSTDLWAPEIHQIDGSWWVIFTADPQLRLPTTRGGDVVRVQXPAVNHRMFTVVGEGEDPWTAEYRYHSELETYDQFAIDGTYFQHADQLYHIYSCWYHKYD

SEQ ID NO: 180320 - protein, 119 aa, Triticum aestivum
  unsure (1)..(119): unsure at all Xaa locations
  Clone ID: PAT_TA_74738.pep
MSLKNDEFPASAAFDXIAQALSASDADRTDAIKNGXSIFAFTLKNKAGTQETWYLDLKETGTVGKGPAPAGKKATATLVLSDEDFGELAAGNANAQKLFMSGKFKVTGNVVSATKLEPI

SEQ ID NO: 180321 - protein, 67 aa, Triticum aestivum
  unsure (1)..(67): unsure at all Xaa locations
  Clone ID: PAT_TA_74739.pep
MARGLKKHLKRLNAPSHWMLDKLGGAFAPKPSSCPHKXQECLPLILIXLRNRLKYSSSTLPGESCKS

SEQ ID NO: 180322 - protein, 98 aa, Triticum aestivum
  unsure (1)..(98): unsure at all Xaa locations
  Clone ID: PAT_TA_74740.pep
XAHPSPSFLXTAPLSXQSTWLAXLSPLPQPETCCAPPARTVXCMSNPHAVLSXGLLLFYLKRSGQAWQLPSSGLTLSSMLFFQRSCTSLELPRXLVLP

SEQ ID NO: 180323 - protein, 222 aa, Triticum aestivum
  unsure (1)..(222): unsure at all Xaa locations
  Clone ID: PAT_TA_74741.pep
MSYTTRKVGAANTLEHRXVYIEKDGQLVSPWHDIPLYANEQQTILNMVVECAPLXTNAKIEISKEEQLNPIKXDTKKGKXLRFVRKLLSPNKGLPFGNYGAFPSNFGEGPQTGFFQPQGRTQRAKGVXTNDPLDVCEIGELVAKPGEVIQVKVLXVHGSLDEGETDWKIMVINVXDPXAPKLNDSRTSSATLPGFSGHNEWXRIFRSRREPRNSCFPGVETR

SEQ ID NO: 180324 - protein, 34 aa, Triticum aestivum
  Clone ID: PAT_TA_74742.pep
QWLPPADPATSGTCYQLEPPRPRFDILEEGVVPA

SEQ ID NO: 180325 - protein, 193 aa, Triticum aestivum
  unsure (1)..(193): unsure at all Xaa locations
  Clone ID: PAT_TA_74743.pep
CTRAVVCRDIVEAHYKACLYSGIKISGTNAEVMPAQXEFQVGPCTGIEMGDHLWMARFLLYRVAEEFGAKVSVHPXPIPGXWNGAGLHSNFSTKEMRVEGGMKHIEAAIKKLEGRHKEHILVYGEGNEARLTGRHETGSIDQFSYGVANRGASIRIPRETAAQGFGYFEDRRPASNAYPYQITGIIMETCFGA

SEQ ID NO: 180326 - protein, 117 aa, Triticum aestivum
  unsure (1)..(117): unsure at all Xaa locations
  Clone ID: PAT_TA_74744.pep
TRGIGPEACRPGKDANRSPWRKKAGRQRAAYQSKGTSVNRGRVGGARCNQRTRELPPFARFAARKTXGRRTKQGXVGEPAKSAHRRRHEPRRRGEGTENHQEFVERTVAGVLGREPC

SEQ ID NO: 180327 - protein, 158 aa, Triticum aestivum
  Clone ID: PAT_TA_74745.pep
YEGQLSLTLIVLAINYSVAMVVAPQYATWGPQTYCDMKTNSLDQQPDCSHHKDLIMPCSELATNPSAQQVCTPSVLITFINRVTINFPFFGVVLFWAQFAFLGVYLVVFLTTLFKAPSLDQEQVDRDLEEEEEEGLLASTGRRFGATWSDVTGRARKP

SEQ ID NO: 180328 - protein, 128 aa, Triticum aestivum
  unsure (1)..(128): unsure at all Xaa locations
  Clone ID: PAT_TA_74746.pep
GMMALAMGSVKRSLLEILESVESVQKKKPSVKNSPVWGAVLTNKPNTRNHGDVRIMDKAAAYVKKKNLEIPTTFKGAIMEKRELHSCKTKLLFASVECFCDDAQASLLQRCILLLDKRRXELMRIAWK

SEQ ID NO: 180329 - protein, 58 aa, Triticum aestivum
  Clone ID: PAT_TA_74747.pep
KPQEKQADRSISSCSLLASRRPRSTSSHVDPSHDPSISTCSGHWRTDHPQVKSGARGS

SEQ ID NO: 180330 - protein, 100 aa, Triticum aestivum
  Clone ID: PAT_TA_74748.pep
HSSFWQLPPSSGAAYAAPKPPPGPNVNPWTGKDRYVVQSYGKKLDQTIGSFTAQNDTLNAARTRTVAHKISTFTWVTTRDGLSLIPQAIKEARQQKKGPK

SEQ ID NO: 180331 - protein, 127 aa, Triticum aestivum
  unsure (1)..(127): unsure at all Xaa locations
  Clone ID: PAT_TA_74749.pep
MARAQXMLMAVALVXMLAAVPRAAVAIDCGHVDSLVRPCLSYVQGGPXPSGQCCGGSRASITGASKXXRKPLTCLKGDSARGIPQILQTGXEQTARSLRPPSCGLFNLPNTNNSSSSEHSNWQTSCC

SEQ ID NO: 180332 - protein, 92 aa, Triticum aestivum
  Clone ID: PAT_TA_74750.pep
LHEVQGRKEQERRRLAGVPYYQSQVTNLRRPQTALTDRSWWPHKRKAYGLRIIHMSLSVAHASAVAATAHQNGPYTRLSKERKVRASPIMEV

SEQ ID NO: 180333 - protein, 58 aa, Triticum aestivum
  Clone ID: PAT_TA_74751.pep
WHEARQWVEPLTEFAAKIGGAPQYRGFKYNEYMQRFMKSRTDPQARPEDAFSVSHYAI

SEQ ID NO: 180334 - protein, 127 aa, Triticum aestivum
  unsure (1)..(127): unsure at all Xaa locations
  Clone ID: PAT_TA_74752.pep
RHEGRSNKEQLPAPQDGQVQLDIIINNAGVAGNXLLENVDCEDFARQFNINVRGPLLLVKAATQYLPNDRSGRIVNLSSVSSSLGYKGQSIYCGTKAALESMTRTXSRELAERCTVNAINPGPVATD

SEQ ID NO: 180335 - protein, 65 aa, Triticum aestivum
  Clone ID: PAT_TA_74753.pep
ASPDDALHCTAEDDDKQRSTLVITGIKSTFQPHLHHRSMLQHLSTERTDHHHLPSSNPSRPSFFW

SEQ ID NO: 180336 - protein, 161 aa, Triticum aestivum
  unsure (1)..(161): unsure at all Xaa locations
  Clone ID: PAT_TA_74754.pep
MSQGKWTPENFGWIAVPRNRSNVPSAEDVKEMNNDFYSDPMDAWPVTDVTDKAREYAQHFLSKETFNHSMRVFCYGIYIIQHYFPEYHSSALXETWALTCLFHDIGTTDENMSNTHMSFEFQCGLLALTKLQEFGAHKIQAESVAEAIIRHQDPGETGTVS

SEQ ID NO: 180337 - protein, 127 aa, Triticum aestivum
  unsure (1)..(127): unsure at all Xaa locations
  Clone ID: PAT_TA_74755.pep
RGPVITSGSPGLQDFGTRVRWQRLRPSAGLPHLAHAVKFAELVTKIDRRSGKEIEAAPKFLKNGDAXALVKMIPTKPMGCGDLATYPPLFRFAVRDMRQTVAVGVIKGVEKKDPTGAKVTKAAIKKK

SEQ ID NO: 180338 - protein, 109 aa, Triticum aestivum
  unsure (1)..(109): unsure at all Xaa locations
  Clone ID: PAT_TA_74756.pep
ELERRHEWGSPDDQSLKPQGYXTVLDAKAAVDKDPQCRYKVSCADILALAAREFVVQSGGPYYQVELGRYDGKVSTKISVMLPHVDFNLDKLNGFFSGLGLSQTDMIAL

SEQ ID NO: 180339 - protein, 70 aa, Triticum aestivum
  Clone ID: PAT_TA_74757.pep
SGSPGCRILSRGLAHDCNAWHVVGPGDTCWTISQLYDLALDQFYQWNPAIQDECATGFWLDYAYCVGISA

SEQ ID NO: 180340 - protein, 188 aa, Triticum aestivum
  unsure (1)..(188): unsure at all Xaa locations
  Clone ID: PAT_TA_74758.pep
MGKEKMHINVVVIGHVDSGKSTTTGHLIYKCGGIXDKRTIEKFEKEAAELGKGSFIYAWVLDKLKAERERGITIDIALWKFETXKYYVKLVNSTPPGHXGDFHSRTLIHLGLPSPGRIALFLIIAAVLGEFEAGISKDGQXTREHALLXAYTLGVKQLIVAINKMDTTKWSEERYQEIIQRPPIHQEV

SEQ ID NO: 180341 - protein, 69 aa, Triticum aestivum
  unsure (1)..(69): unsure at all Xaa locations
  Clone ID: PAT_TA_74759.pep
TRIRSTDREKKRXLAKASLAYNCKSKNXCPHFRKLFPEYVEKYNQQQEKEQTGAEPEPQENHTPAPSHA

SEQ ID NO: 180342 - protein, 234 aa, Triticum aestivum
  unsure (1)..(234): unsure at all Xaa locations
  Clone ID: PAT_TA_74760.pep
FTRQGQSGPETLLKKRKSQEKARAEKATEIENKKKANKEKRSVIFKRAEKYVKEYRXDAEREQIRLHRVAKQEGHFHFPAEEKLIFVVRIKGINKIAPKPRKILQLLRLIQINNGVFVRVTKATMEXIKIVEPWVAYXYPNLKTIKELVYXRGYGKINKQRVAITDMPSLXDNLGKYGIVCVEDLIHXIYTVXPNFSRAPNFLWPXKLRNPHLWFRPRRFKXFIRVVTWAPGDR

SEQ ID NO: 180343 - protein, 136 aa, Triticum aestivum
  unsure (1)..(136): unsure at all Xaa locations
  Clone ID: PAT_TA_74761.pep
SSPTLLVSSPSSLRPLLLLLPSPTITPLSMQFWATSAPXMEKTSGTSETSPSRLLQFRRTSATVLHLSRRTKRPARHLLRVWNDXSSQEEPSSDQGGRSLEGLVWDSQXDLRDFFEKRLHGKRFLIMDFDSSHNLV

SEQ ID NO: 180344 - protein, 127 aa, Triticum aestivum
  unsure (1)..(127): unsure at all Xaa locations
  Clone ID: PAT_TA_74762.pep
DPRAPALYQVMLSRRLVLMLAAVPRAAVAIXCGHVDSLVRPCLSYVQGGPSPSGQCCGGVHILHNQAQSKSDRQAXCNCLKVXRSWIHNLKRTNGPAASPPKLRVLTFPITNNSSSSKIRNATVVVN

SEQ ID NO: 180345 - protein, 102 aa, Triticum aestivum
  unsure (1)..(102): unsure at all Xaa locations
  Clone ID: PAT_TA_74763.pep
LNFAKMGLNGSISPSIGKIATLQMLFLSDNKHXTGTVPKELAELPALRKVDLSNNNLYGKLPXFARHVEVILDGNPNFGKPAPPPWNPGGSSNDTISPGGNW

SEQ ID NO: 180346 - protein, 44 aa, Triticum aestivum
  Clone ID: PAT_TA_74764.pep
RRRGPSWGRSEQGQCWHKAAARMSENCIVIRPACAYVLLNFELF

SEQ ID NO: 180347 - protein, 153 aa, Triticum aestivum
  unsure (1)..(153): unsure at all Xaa locations
  Clone ID: PAT_TA_74765.pep
RRQSRRRSIRTLLGPRGMDKXIRSGRGETIITNDGDTMLKGMSVMHPIAKMLVNLSAAQDVKAGDGXSSVVVICGALLGAAERLLGKGIHPSVLSESFQRAAAAAVQVLHDMSQPVSLTDTAVLLQADNTSLSSKIVSQYSGLLGQMAVNSVT

SEQ ID NO: 180348 - protein, 77 aa, Triticum aestivum
  unsure (1)..(77): unsure at all Xaa locations
  Clone ID: PAT_TA_74766.pep
PLHDPTIAVSAASSRGHRRHLRRASFVFFLLXVGATVGARAGEERGEQPAAVLILAVEPVGAVLKLAGLGLGASDPR

SEQ ID NO: 180349 - protein, 191 aa, Triticum aestivum
  unsure (1)..(191): unsure at all Xaa locations
  Clone ID: PAT_TA_74767.pep
LARGFKKVIEGLREVEYKWLSAFLLMRAYNSIVFWSSPVLVSAATFLTCYLLKIPLDASNVFTTVATLRLVQEPVRXLPIVIAVAIQAKVAFTRISKFLDARELNGQVRKKYRVGTDYPIAMNSCSFSWDENPSKPTLNNINLVVKAGEKIAICGEVGSGKSTLLAAVLGEVPKTEGTIQVCGRIAYVSQT

SEQ ID NO: 180350 - protein, 97 aa, Triticum aestivum
  Clone ID: PAT_TA_74768.pep
QSNCCFADRTDGNRCKWQSDLFMVLGSSDLATICCHSSVLVISNNLYRSYNPTSNSLSNECDRLMTCLLSLTLSRTNLADPSMTAYERKVLPFFPNI

SEQ ID NO: 180351 - protein, 151 aa, Triticum aestivum
  unsure (1)..(151): unsure at all Xaa locations
  Clone ID: PAT_TA_74769.pep
YEATYNFKLSTHPSITSNYPSQLNCQHGPSSWRTRRLHRPTHCQRRHQRRLHHPTQCQRRRQRLHRPTWRRQWRLYRPIYHSPLFLPLSTETRQRDTACSCITPNDYRXMPSQLITAFTSIIPFYTITRGFVQVLTPIDKYADTSRLKALL

SEQ ID NO: 180352 - protein, 146 aa, Triticum aestivum
  unsure (1)..(146): unsure at all Xaa locations
  Clone ID: PAT_TA_74770.pep
MLTNRRSTMMVPPNRMPSWHPHSKGTMPQQPSSTPLAIDTEAPQSRTPAVLTSTTPDLPGHRVIRVLGAVHGTTSATRKDPKSFIKNIAGSFNSSWGEAKSVTSIVYQARDQAIDRLVKEAISXGANAIVGLDIRESEIMGCVVVS

SEQ ID NO: 180353 - protein, 178 aa, Triticum aestivum
  Clone ID: PAT_TA_74771.pep
VFARILDLYLPSDATEVKEYAHKMARLALNPSVLAHATDAETNHPVLRPLTTFGEENRNDPLWTTNGWQRLKFIGYQQGVVAVAYDYSHTSINRRIYAFALNHLWSCTGTMTGCPMSMTDGAAALMHKHSNDPDGNQPGRKRVFDESFRRLTSRDPAFAWTSGQWMTERTGGSDVSGT

SEQ ID NO: 180354 - protein, 119 aa, Triticum aestivum
  unsure (1)..(119): unsure at all Xaa locations
  Clone ID: PAT_TA_74772.pep
MVRTSVLHDALNSINNAEKAGKRQVLIRPSSKVIIKFLTVMQRHGYIGEFEEVDDHRSGKIVVQLNGRLNKTGVISPRYNVRLADLEKWVVKLLPAXRQFGYVILTXTSAGIMDHEEAR

SEQ ID NO: 180355 - protein, 46 aa, Triticum aestivum
  unsure (1)..(46): unsure at all Xaa locations
  Clone ID: PAT_TA_74773.pep
QNTLKLHCKITGDYTTNCXRFTLQIFXLCTRKLHWKSTTDYNENXV

SEQ ID NO: 180356 - protein, 65 aa, Triticum aestivum
  Clone ID: PAT_TA_74774.pep
LAAHSPVLASAMAASAVHLLQLGELLPPLPRLGRRRRLLSAAKRDLQPHCPHHAAATLVSVGTGG

SEQ ID NO: 180357 - protein, 85 aa, Triticum aestivum
  Clone ID: PAT_TA_74775.pep
SLIMSFSIRNTIALGAFSALAAAQIVPPKLDATCADMVIFMARGNYAPYHDGRTFPFVEATCGKLTAQGKSCDYIDIQFDVTLGG

SEQ ID NO: 180358 - protein, 60 aa, Triticum aestivum
  Clone ID: PAT_TA_74776.pep
LLTKFNVYCTPFILLWLQTLSNYHVYWLDFGLLLMLDQAGCFRCCLFKLVGCSVHVICGL

SEQ ID NO: 180359 - protein, 33 aa, Triticum aestivum
  Clone ID: PAT_TA_74777.pep
LRSSWRSSPYSFSTMTRFFHLKRSLRPCPRASL

SEQ ID NO: 180360 - protein, 145 aa, Triticum aestivum
  unsure (1)..(145): unsure at all Xaa locations
  Clone ID: PAT_TA_74778.pep
FIHHMLSLMSTMYAMLSGEAHVYIYMGLITETTTPGINLRWXLVYMNKFTIVVYILPYFNLPKLILCPLVSSRFLDVAGMKNSKAYLVXGVAMVITWLVARIILFMYLFYHMFVHYDQIKKINTFGYFLVLTAPCIIFVMNVLWF

SEQ ID NO: 180361 - protein, 56 aa, Triticum aestivum
  Clone ID: PAT_TA_74779.pep
PTTPNKNHTFDSVDASASLIYPMQCSALRKNGFVLIKGRPCKIVDMSTSKTGKHGH

SEQ ID NO: 180362 - protein, 66 aa, Triticum aestivum
  Clone ID: PAT_TA_74780.pep
MKRIRGCLDSADAKKLVDVSAAPALPMIWRKTERRGLTSGGRANLSAPIETNAHRSVNTNYLVGQV

SEQ ID NO: 180363 - protein, 130 aa, Triticum aestivum
  unsure (1)..(130): unsure at all Xaa locations
  Clone ID: PAT_TA_74781.pep
PVQKRLFHVITAFITSIAFISYFAMATGDGLSWHSSVVNTTKSGVVEDIVKRQVFYARYVDWALTTPXSWLLDLALIAGLNGSDIIITVFADLVMVLTGLFAAFGSTPTQVWGWYTIACVAFLVIVWQIG

SEQ ID NO: 180364 - protein, 136 aa, Triticum aestivum
  unsure (1)..(136): unsure at all Xaa locations
  Clone ID: PAT_TA_74782.pep
ALQRISHVDISTEKSSNAMGELGKLRQLTRLCVVHRKEAKLWKPFCXSLDELSNSLRYLMVVDASEKVEELKFLAYLKNPPLSLQSLHLVGRLTRLPGXVSSLSNLASLSLRQTYQLAKDSFEVLAKLPSLVSLKL

SEQ ID NO: 180365 - protein, 158 aa, Triticum aestivum
  Clone ID: PAT_TA_74783.pep
DLQEIVNRRKHEALTVQTFGTRIEKLHREKYLQLCDSVDMDEVDSSSTIMDEEDDVVRSLRASPVHPVEDRTSIDDFEIIKPISRGAFGRVFLAEKRTTGDLFAIKVLRKADIIRKNAVECILAERDILITVRNPFVVRFFYSFTSRENVYLVVEYLN

SEQ ID NO: 180366 - protein, 34 aa, Triticum aestivum
  Clone ID: PAT_TA_74784.pep
ENTHQRLGNRCLSQFREISRFHFQTFGESTLGPL

SEQ ID NO: 180367 - protein, 115 aa, Triticum aestivum
  Clone ID: PAT_TA_74785.pep
VILCVLTVWDNMQFFGLSLCLKFQSSLGCTATIFADNPSTHTRPFAGTLSDLRYILLFITFASSHRMHACFSTQVSLSSVLIFFGVYFLLINHVYVQQNRKKHMLLIDSELSYGR

SEQ ID NO: 180368 - protein, 76 aa, Triticum aestivum
  Clone ID: PAT_TA_74786.pep
RCWNRCLSVLETVHMKAGTSIFFCYYYLGFAGLLNFATTVFNFCWNQQSFCYHYLCVFAGTRPNLASIAFDFCWNQ

SEQ ID NO: 180369 - protein, 154 aa, Triticum aestivum
  unsure (1)..(154): unsure at all Xaa locations
  Clone ID: PAT_TA_74787.pep
ARGPSYLTGEFPXTXDGTPRGSRPTPRTSARTGELEVIHCRWAMLGALGCVFPELLARNGVXFGEAVWFKAGSQIFSEGCLDYLGNPSLVHAQSILAIXACQVVLMGAVEGYRVACGPLGEIVDPLYPGGSFDPLGLAYDPEAFAELKVKEIKN

SEQ ID NO: 180370 - protein, 134 aa, Triticum aestivum
  unsure (1)..(134): unsure at all Xaa locations
  Clone ID: PAT_TA_74788.pep
RPSYLTGSPRHYXWDTXGLSADPETFAXNRELEVIHCRLAMLGALGCVFPELLARNGVQFGEAVWFKAGSQIFSEGGLDYLGNPCLVHAQSILAIWACQVVLIGAVKGYRVACGPLGEIVDPLYPGGSFDPLGL

SEQ ID NO: 180371 - protein, 125 aa, Triticum aestivum
  unsure (1)..(125): unsure at all Xaa locations
  Clone ID: PAT_TA_74789.pep
RVPRPADPCDRENFYPFPPFMSGLXYALSWDLXVRXVARSEVSRRDRVGPEDMWTGRWLNVACEAKNRYDGAPRMYNYLGSSPANCFRRGFRPDTIAVHMLEDACRXAETLAYFNATAALPPSGL

SEQ ID NO: 180372 - protein, 117 aa, Triticum aestivum
  unsure (1)..(117): unsure at all Xaa locations
  Clone ID: PAT_TA_74790.pep
HEETLEGMDGVTGVDVVPRENRVTVTGYVDAAKVMRRCLRARPGKRVEPWPYVPYDVVAHPYAXPGAYDKRAPAGYVRDVMANPGGANASFARATSTETRYTGAFSDENPNAACAIM

SEQ ID NO: 180373 - protein, 158 aa, Triticum aestivum
  Clone ID: PAT_TA_74791.pep
LRTNRVCMLTIPRALNKLPRVIQVLDFGDGKLDEVNCVDLINLRHINSGSSEFQFRNISRLTSLQTIACAFGIRDAPRYEVKQLRDLNELRGSLEINGLEIVKSKEEALESKLAAKERLSELKLQFGHSSPEVQAEVLEGLCPPVGLQTLELRSYDGS

SEQ ID NO: 180374 - protein, 134 aa, Triticum aestivum
  Clone ID: PAT_TA_74792.pep
MVPLCANERTSRQRGLEGLDALQSYPVHIFSCASNAQFTSQMCLALYGRKRLFQESTRLCSPWFLGVLLDAILFSDQFKKLSWMTMSSDSLTRPGEPLLWKMLLPGYCVHEHPRHSIGTGNSCMTTAASFNPRA

SEQ ID NO: 180375 - protein, 162 aa, Triticum aestivum
  unsure (1)..(162): unsure at all Xaa locations
  Clone ID: PAT_TA_74793.pep
HEDDVSAHINELYPKAEKERANEPIFQAQXTRYACXGLVIGTACHHQVADGQSMSVFYTAWASAVRTDSAVLTSPFVDRSATVVPRSPPTPAYDHRNIEFKGELSWSHSYXVLLMDRIKNLAVHFPDEFIANLKARVGTRCSTFQCLLAHAWKKITAARDLA

SEQ ID NO: 180376 - protein, 136 aa, Triticum aestivum
  unsure (1)..(136): unsure at all Xaa locations
  Clone ID: PAT_TA_74794.pep
AILSGEGNEKVQDLLLLDVTPLSLGLETAGGVMTVLITRNTTIPTKKEQVFSTYSDDQPGVLIQVFEGERTRTRYNNLLGKFELXGIPPAPRCVPQITVCFDIDANGILNVSAEDKTTGQKNKITITNDEGRLSKD

SEQ ID NO: 180377 - protein, 143 aa, Triticum aestivum
  unsure (1)..(143): unsure at all Xaa locations
  Clone ID: PAT_TA_74795.pep
TARKKIQKDKGVEPSEFEDTVAQAFFDLENGNQEXLRSDLKDLYINTAIQMDVVGNXXKAVVIHVPYRLRKPFRKIHVRLVRELEKKFSGKDVVFVATRRIVRPPEKGSAVQRPRTRTLTAVHDGILEDVVYPAKIVGKRVRY

SEQ ID NO: 180378 - protein, 117 aa, Triticum aestivum
  unsure (1)..(117): unsure at all Xaa locations
  Clone ID: PAT_TA_74796.pep
ARGWPPNNGNYLLAEFVDPQEVKRKLEPPXPPPPAATAVAVPISPATTPREAPLQQGQANQSVPRRAAATPREQLPPPPPLVKPPTSXPREKLTPTPKNAEPPVVTLDDLFRKTQSS

SEQ ID NO: 180379 - protein, 137 aa, Triticum aestivum
  unsure (1)..(137): unsure at all Xaa locations
  Clone ID: PAT_TA_74797.pep
SFLARVSSPVSGSSSSSGRLRPGENPGKKKMITLKSSDGEEFEVEEAXVAMESQTIRHMIEDDCADDGIPLPNVDSEILSDVIEYCNKHVQAKPAYRAAARAGAGASDAAPVAPAEDLKNWDAKFVEVDQATLFDLI

SEQ ID NO: 180380 - protein, 136 aa, Triticum aestivum
  unsure (1)..(136): unsure at all Xaa locations
  Clone ID: PAT_TA_74798.pep
NARGKNMITGTSQADCAVLIIDSTTGGFEAGISQDXQTLKHALLAFTLGVKQMICCCNXEMDATTPKYSEARYEEIVKEVSSYXKKVGYDPDEVPFVPISRFEGDNMIERSTNLDWYKGPTLLEALDQIDEPKRPS

SEQ ID NO: 180381 - protein, 136 aa, Triticum aestivum
  unsure (1)..(136): unsure at all Xaa locations
  Clone ID: PAT_TA_74799.pep
MAASALTRRPASSAPPRGANNLVRSVGDFGGRITMRRTVKSAPXSIWYGPDRPKYLGPFSEQTPSYLTGEFPGDYSWDTAGLSADPETFAKNRELEVIHSRWAMLGALGCVFPEILSKNGIKFGEAVWFKAGAQIF

SEQ ID NO: 180382 - protein, 110 aa, Triticum aestivum
  unsure (1)..(110): unsure at all Xaa locations
  Clone ID: PAT_TA_74800.pep
LHIAALQPVEVDPEAVRPPKRRNVRTSKXDPQSVAARLRRERISERIRVLQRLVPGGTKMDTASMLDEAIHYVKFLKSQVQSLELAAAATGAAAHRAAAFAYPAMQHAPW

SEQ ID NO: 180383 - protein, 87 aa, Triticum aestivum
  unsure (1)..(87): unsure at all Xaa locations
  Clone ID: PAT_TA_74801.pep
WIPRAAGGVGLHGHGSSSLASLLLGSGAXGACDHLGLFHAMQSVVSDATAYEMHQQHQTQVDQLARGYGYGAGDANGSQIPHQALAA

SEQ ID NO: 180384 - protein, 36 aa, Triticum aestivum
  Clone ID: PAT_TA_74802.pep
GGSAGCSSLAQHCVTVHSFHWSRVLLQVASFELVSS

SEQ ID NO: 180385 - protein, 65 aa, Triticum aestivum
  unsure (1)..(65): unsure at all Xaa locations
  Clone ID: PAT_TA_74803.pep
MDQMHGGGAGRRVKVVGKVERLDGQSLTYXEFVDRFMKPNLPVVLTGLTSSWPSCEDWTFAGPDD

SEQ ID NO: 180386 - protein, 66 aa, Triticum aestivum
  Clone ID: PAT_TA_74804.pep
HIRFSLFRPLPECSSSIKWFIRLRGRIYIIEVSKNPNDLPHENQEITKHFNHQWTYYVWYLRTQTA

SEQ ID NO: 180387 - protein, 41 aa, Triticum aestivum
  unsure (1)..(41): unsure at all Xaa locations
  Clone ID: PAT_TA_74805.pep
SPELHHALQVQKMSEQAATHSFKEXTYIRQELKNPLNGMQF

SEQ ID NO: 180388 - protein, 41 aa, Triticum aestivum
  Clone ID: PAT_TA_74806.pep
RRTRTSGNAPRSRTPRQRRGTGQDTVRGILRPLAGAGVLRG

SEQ ID NO: 180389 - protein, 184 aa, Triticum aestivum
  Clone ID: PAT_TA_74807.pep
MDVDPTPPPRQSVKVARPAAARTSVPSKANETARAPTKAAAQQDESDDEELSDLDSDADEIQDTVNVGGGEEDDDEEEDEEEDEELGGDDEEDEEPRELDSDDEGSDGGSPDLDKMTKRQRARFVDDDDCALLKLSDEVQAKKVFTAEELSMRRAEMARRRRNLSEKRNEEVQMETIHKLLHKQ

SEQ ID NO: 180390 - protein, 151 aa, Triticum aestivum
  unsure (1)..(151): unsure at all Xaa locations
  Clone ID: PAT_TA_74808.pep
MVKYSKEVDNSVKAAKARGTHLRVHFKHTREIGHAIXXLKLSKAKAYLENVLLYKEAISFTKYTGGIGRHAVGKQYNAPGDKVSWPQKATKTFLDLLRNIESNAEVXKLELDKVYITHVYCNQAPKMRRRTYRAHGRINAYMSSPAHVEII

SEQ ID NO: 180391 - protein, 71 aa, Triticum aestivum
  unsure (1)..(71): unsure at all Xaa locations
  Clone ID: PAT_TA_74809.pep
GSKDTVPQKLDASAASSLDIEKKTYINDEANFRXFDFNEDQMAVEKLREGISKFAADAVTLKDIIKKKVQA

SEQ ID NO: 180392 - protein, 138 aa, Triticum aestivum
  unsure (1)..(138): unsure at all Xaa locations
  Clone ID: PAT_TA_74810.pep
GARVIFIEXQKAPLIVVKRDGGFNYASTDLAXLWYRLNVEMXEWIIYVTDVXXQQQHFHSFFSAARLAGWLPDXXEEKYPKVSHVGFGFVLGAEGSRFRTRSSDGVVRLVDLLDEAXSXSLAQLIKRLTENGQIADWT

SEQ ID NO: 180393 - protein, 41 aa, Triticum aestivum
  Clone ID: PAT_TA_74811.pep
WCPAFYNSRSLPLYSRETSDDALPTTSTTGDGLGVATGGMA

SEQ ID NO: 180394 - protein, 203 aa, Triticum aestivum
  unsure (1)..(203): unsure at all Xaa locations
  Clone ID: PAT_TA_74812.pep
ARGERLSSAETLVPRNQDAGLAELPATVAALKNPNSKIFHGCTGHKXIFDQYNHERYPPGDPSKRAFAYFVLSGGRFVYASLLRLLVLKFVLSMSASKDVLALASLEVDLSSIEPGSTVTVKWRGKPVFIRRRTDDDIKLANSVDVASLRHPEQDAERVKNPEWLVVIGVCTHLGCIPLPNSGDFGGWFCPCHGSHYDISGRI

SEQ ID NO: 180395 - protein, 230 aa, Triticum aestivum
  unsure (1)..(230): unsure at all Xaa locations
  Clone ID: PAT_TA_74813.pep
GTREESSINSPATDVFEVVPTESGDKENQSALVAEDSEEVSCGDKAALADAEEDVEVEETKTMIEEDKKDSAAAIEGGEKENPEVVELKAQLIAKEMEVAVLTXDNAELKKQADEAGXAVKRADEEAVAKAFLIEQELKENAAREXARMGEQLRAVLSAXAAEALDAEMRXLRVHDRAVCARLAEAGRCVFFGGDAHLVGHHGLAGNGSNGLGGPREDSGRGTTRVRQAS

SEQ ID NO: 180396 - protein, 150 aa, Triticum aestivum
  Clone ID: PAT_TA_74814.pep
LTSLSSPGSPVWWTTRHGEAIVVLDSHAMSGVRHDATTTTTAAAAAGGTARVRRTDGATASAAPSPGALVTVSARMVRTAPAIARAARAGGVEVLDLMSLRRLRTRSCWAQAPLVLKGASPWSSSRCAAAAWSARAHRGLHAGAPRRVSR

SEQ ID NO: 180397 - protein, 54 aa, Triticum aestivum
  Clone ID: PAT_TA_74815.pep
ARGFLWYIKSKVIYWSTSEDCLLIYGAIAVVVCFICALISLAFAFLVIPRQVMP

SEQ ID NO: 180398 - protein, 188 aa, Triticum aestivum
  Clone ID: PAT_TA_74816.pep
GTRLVGRLNGLKQMSFACGVWVDRRRALRPEFTATSASRYAATAESVDFVSGAEQARRRVNGFVADATKQRIRHILPPGSVDSSTAVVLANALYFKGAWPEPFDVFTEPFHTPGGATVRVPAMTTGRSQYIALYPGFRALKLPYRNDGDRSAAFHMLILLPDSGGLSLSNLYDKVVSSPEFIRKHTPE

SEQ ID NO: 180399 - protein, 114 aa, Triticum aestivum
  Clone ID: PAT_TA_74817.pep
ARGDYTVAPQAVKKIQANIKLSSTNLGIIISRIVYETSDAMESSEVILKDMFINIADYMTPATCTDVAFHNMWAECCCKVKLKVNTVLHDEKEFVYFIIKSTNMTCLTPMSVLD

SEQ ID NO: 180400 - protein, 67 aa, Triticum aestivum
  unsure (1)..(67): unsure at all Xaa locations
  Clone ID: PAT_TA_74818.pep
ARIPRASRNXRRXGTLTPKYTTTPPTAPTHRQPPYADASRXTKRLLQKLPCDLHLYTYQATGQSTPR

SEQ ID NO: 180401 - protein, 122 aa, Triticum aestivum
  unsure (1)..(122): unsure at all Xaa locations
  Clone ID: PAT_TA_74819.pep
HXYLSTDNXNKDTGLVVNXSEEXRLLVGSRALGHKTXRSRSHTSSHGNLVTMVIQISTGCKXSLVSQAQHSXAQHSLYPAMGTSAQQSPHEAQQAQQATQTQHNMYTSQPFKHGFKEFSVDA

SEQ ID NO: 180402 - protein, 50 aa, Triticum aestivum
  unsure (1)..(50): unsure at all Xaa locations
  Clone ID: PAT_TA_74820.pep
LIVIDQSSRLEVXFLSRSHXIQSSHLVSXQDLIGRSRLISLVVEMSSWIR

SEQ ID NO: 180403 - protein, 109 aa, Triticum aestivum
  unsure (1)..(109): unsure at all Xaa locations
  Clone ID: PAT_TA_74821.pep
AGREASAAASRSGQVXDSKLAPCVXAYVDXLWRPTIQQGVAATGVQGLNGLARSSPDRKIACRCLKSLATSIKSINMGKVSGVPGKXGVSVPFPIQHSPPICNNVQLSI

SEQ ID NO: 180404 - protein, 48 aa, Triticum aestivum
  Clone ID: PAT_TA_74822.pep
RHEAGGDCKLCLEAAIGKLLARGCAKEGGMVLGGSCSLRYDLYPIFDS

SEQ ID NO: 180405 - protein, 33 aa, Triticum aestivum
  unsure (1)..(33): unsure at all Xaa locations
  Clone ID: PAT_TA_74823.pep
XTXTGPIIVVPLPMYVYVYLVVYLVCIDAXMFL

SEQ ID NO: 180406 - protein, 117 aa, Triticum aestivum
  Clone ID: PAT_TA_74824.pep
TEALTNHMLGTMPPQHAPELKDVRTSRGGDPHPASRPTMPETFLRASLVCKPWCSLLIRPWLPQPLPGLPQDSPMLGLFHSDVPLRPLHLHHQVSTRAIPGTTIPIVWPTAATAHPL

SEQ ID NO: 180407 - protein, 100 aa, Triticum aestivum
  unsure (1)..(100): unsure at all Xaa locations
  Clone ID: PAT_TA_74825.pep
NPPRFFPLGEIGERKKGKRGLSPGGETYWGPRGFPRGLGPGKGDKGGQDAEGPRAXQGAVDRGQHSRAEHTAGSNTRARQRQPGQRSQGGXTTAPAPAAQ

SEQ ID NO: 180408 - protein, 164 aa, Triticum aestivum
  unsure (1)..(164): unsure at all Xaa locations
  Clone ID: PAT_TA_74826.pep
DFDEASTSCLVQSPLRPXSRRIQIPEKSLAPPSCLGXLPASHPLLYACAFRDSALVAELAHDXGRWGRRHRRPAXFAAALAASAPPHHCYVHPLHGGAGARASPTARRSRSPRSRSRRSSRRPTSCSSSAACDASPSSGCAKXWLRLALRLPFPNEEALAREAA

SEQ ID NO: 180409 - protein, 148 aa, Triticum aestivum
  Clone ID: PAT_TA_74827.pep
PGGALFLIFFYFWRFFSGKRGPSSPGGADEESSSTDSSPATSPRASRRLRDPDQPDIPSSLPMSVFDSSSEAAGKAAADCAVCIVEFRDGDLARLLPRCGHRFHAACVDAWLHLHSTCPLCRASVVAPEPAATEPKNDPKDDGAECPV

SEQ ID NO: 180410 - protein, 57 aa, Triticum aestivum
  unsure (1)..(57): unsure at all Xaa locations
  Clone ID: PAT_TA_74828.pep
AMPQGSGAACPLVDGRQXQAAGTCARRSSWXSSERGPAHSHCGRGLADSSPSCTASI

SEQ ID NO: 180411 - protein, 129 aa, Triticum aestivum
  Clone ID: PAT_TA_74829.pep
FDEAEQQALQPGSAVQSIQTRAQGNRGAGRNATAARRFLARETPKEDMQCPGWSAAAGRSDVPVRWPGGLKRSAVRSRRSEAKQKNRQLACMCDQGNKLSATSGGGLSFKDPSNASTAIDRWELSSRSM

SEQ ID NO: 180412 - protein, 258 aa, Triticum aestivum
  unsure (1)..(258): unsure at all Xaa locations
  Clone ID: PAT_TA_74830.pep
WTRHAPSPPLLDPLILSLSLARLHYQIRPLRRLAQSLPDPAVRAPSHLRHAKLVALELPLGQLPPPASPSSVSSPAPRLEQLALQGWPPAARRCLELPTTSKQSLPWPSSHACLHLPVHPASLDWNFSCLRLLLPGCAICTSACPADLLYSAPRKLPCCLLFMAADTHLSTLCTLSYRRWDSLLLRSPRLQWPHQPKDLTAPHQPAPLVVAKTTDQDTPRQTFVSPSSIKPTCTSYRRCXYFPSSSTTAQXXVQYADR

SEQ ID NO: 180413 - protein, 34 aa, Triticum aestivum
  Clone ID: PAT_TA_74831.pep
RHRTGRTWASAAGTSSTQARGGEHSKGAWSNPIA

SEQ ID NO: 180414 - protein, 65 aa, Triticum aestivum
  Clone ID: PAT_TA_74832.pep
AYLGITYLTFISLFSIESLLSIPSLGILYLLSNVSSLCCPALTCVLYSAVALKSPLGAALRALSS

SEQ ID NO: 180415 - protein, 96 aa, Triticum aestivum
  unsure (1)..(96): unsure at all Xaa locations
  Clone ID: PAT_TA_74833.pep
CDLANHCLSPGVFDFXQTTPAASSVYVDHKVCRARGQGQSEVCLGRHKEAHAWHTKHTAKELCLTSAPAFSPSRQHSAMWPEVRAARKSCPRGSXV

SEQ ID NO: 180416 - protein, 141 aa, Triticum aestivum
  unsure (1)..(141): unsure at all Xaa locations
  Clone ID: PAT_TA_74834.pep
AGSSKNKSWFQQEQISLDLPALVDVVQHLSGFQHRRTATAALVPEPSPVGCSKNGSWFQHRRLPELRPVTAVVAHGAPRCQXRPRCWRSPLSLVIVFTHTRPPRIAARGHLRGSAPVCGCGTWCTSVSHHGGRAMACGRME

SEQ ID NO: 180417 - protein, 82 aa, Triticum aestivum
  unsure (1)..(82): unsure at all Xaa locations
  Clone ID: PAT_TA_74835.pep
PPVPGECLTFFFQTLKLWALLARGPGVXPQRFKGRKTPPFPFRPPEKFSPLAPRDPPPRGGEILLHLLKFFSLRNXRAPRGP

SEQ ID NO: 180418 - protein, 125 aa, Triticum aestivum
  unsure (1)..(125): unsure at all Xaa locations
  Clone ID: PAT_TA_74836.pep
QSRHTVKATSXXAACKAISTRRATVKARGNSELQLPLXASSLTGSVLXXXXDXQXPKRRGDNHMLHQSDXDSHQESETGHRLRGXQLAGSRGXGGGGSGPXGGCCGLSWRRPAWLRRRRQVSVFV

SEQ ID NO: 180419 - protein, 106 aa, Triticum aestivum
  unsure (1)..(106): unsure at all Xaa locations
  Clone ID: PAT_TA_74837.pep
PGRKFWHGGGTKPSKGARAVRSKVISPFELWALLPGKVSGGNPTQSLTNWAHPVPIVRMVPPLGFPNPGWNLFPISKGNQXXDSTRGYPFPPRAWMNLWLGPVVSF

SEQ ID NO: 180420 - protein, 52 aa, Triticum aestivum
  unsure (1)..(52): unsure at all Xaa locations
  Clone ID: PAT_TA_74838.pep
CCVMGNTDLEDITMFDLKSYMLRHHINTSKAWAVSTWFLCSKLSHNKQHXVC

SEQ ID NO: 180421 - protein, 62 aa, Triticum aestivum
  unsure (1)..(62): unsure at all Xaa locations
  Clone ID: PAT_TA_74839.pep
GVKQSDVMRFVQRVRMLGVHGSSLAIVXRITRXTRPDRARRLGFNAKQGYVVYRIFVSAWWH

SEQ ID NO: 180422 - protein, 156 aa, Triticum aestivum
  unsure (1)..(156): unsure at all Xaa locations
  Clone ID: PAT_TA_74840.pep
RRRSDPGEHGDSRLRXXGWTAARWWRCPRPGEAAAAVEARXLLRGSAATGRLAQPXGLPRASGGPXRSRGRGRRXRTAVTRKRKIFGXLAHVATHRSERGXKNXXLFSFPRCARASSSXPGQAXSGNHSXSQEDAAMAHAWRDRERRRGPVERASC

SEQ ID NO: 180423 - protein, 77 aa, Triticum aestivum
  Clone ID: PAT_TA_74841.pep
LKLRLERESPGLGRTSNDLFGFGFEARLVRVAISPAVNLQNLTAGGELRLGAAKWRRGRCGEADSRAVWEEAANASC

SEQ ID NO: 180424 - protein, 194 aa, Triticum aestivum
  Clone ID: PAT_TA_74842.pep
GRLDWWARTPRLYTDQSGANVTATFAIAGEHYDAGYSHGASLKRIDMQSIIRTAVVAYPDPLPLDPYNGVYLVLSSPDVQVEEFCRAMCGFHYFTFASVVGVTVPYAWVGNSGSQCPGRCAYPFAAPEYGASGQGVLRPPNGDPGVDGMVIVLGHELAELATNPLVNAWYAGDTPTAPTEIADLCLGVYGDGGG

SEQ ID NO: 180425 - protein, 202 aa, Triticum aestivum
  unsure (1)..(202): unsure at all Xaa locations
  Clone ID: PAT_TA_74843.pep
QQQHLMQMNQSMMGGYASSTTVTTDLIQQYLDENKQLILAILDNQNNGKXXECARNQAKLQQNLMYLAAIXXTFXPPQTASLSQYPSNLMMQSGPXYMPQQSAQMMSPQSLMAXRSSMMYCXMXVPCLAPAAAAASTAGLLHWPAGDVLRCDHLGSTSSTAGQHAGAGAPGKQHDELPGVFSDYACGCACQGVDLAVGRLLA

SEQ ID NO: 180426 - protein, 56 aa, Triticum aestivum
  Clone ID: PAT_TA_74844.pep
GKPYRVLGESTPPPGGPCKCRNKCSLRGVLGLRKVKQGKARKETYFPPPLYPGVIP

SEQ ID NO: 180427 - protein, 72 aa, Triticum aestivum
  unsure (1)..(72): unsure at all Xaa locations
  Clone ID: PAT_TA_74845.pep
KKPHRLPPGHRRASARSASTIXASELAHPQATPIQRLGAGDRAGLQGRTSGFQXXPPCRRSRRPPRRTWWAC

SEQ ID NO: 180428 - protein, 38 aa, Triticum aestivum
  Clone ID: PAT_TA_74846.pep
HSTEELQARGEGLTGGRVQHLVDNLRMRPSARERSLVP

SEQ ID NO: 180429 - protein, 215 aa, Triticum aestivum
  unsure (1)..(215): unsure at all Xaa locations
  Clone ID: PAT_TA_74847.pep
MTRGYPPDQQRLIFAGKQLEDGRTLADYNIQKESTLHLVLRLRGWYARIFVKTLTGKTITLEVESSDTSTTSRPRSSDKEGIPPDQQRLIFAGXQLEDGRTLADYNIQKESTLHLVLRLRGGMQIFVKTLTGKTITLEVEXSQTPLDNVKAKIQDKEGIPPDQXRLIFAGKQLEDGRTLXDYNIQKESTLHLVLRLRGWHADLCERPSSGKTISP

SEQ ID NO: 180430 - protein, 35 aa, Triticum aestivum
  Clone ID: PAT_TA_74848.pep
MMMRFHRDDITRPIILIYLILDNMRYNTIMIRYYD

SEQ ID NO: 180431 - protein, 41 aa, Triticum aestivum
  Clone ID: PAT_TA_74849.pep
RRWDAARVGAVVEVRRVEGERRRNDLGRAAPERGRAAAPAR

SEQ ID NO: 180432 - protein, 73 aa, Triticum aestivum
  unsure (1)..(73): unsure at all Xaa locations
  Clone ID: PAT_TA_74850.pep
GNCLYALXRHAEAKEEFLLXALEAAEAGNSQSADILPQIHVNLGIAMEAAGMVLGACEHYREAAILCPSHARA

SEQ ID NO: 180433 - protein, 140 aa, Triticum aestivum
  Clone ID: PAT_TA_74851.pep
DLSNRYTTRTESPRPAVLSSIKAHPNRPRYLQQHNHFITSSSPICVSPSSSSPSLLALPSLCPILFHKATQAPAQRTTAVSAARCAQAAQSVWGGQAPIPPRGRDAPAAVAKHLMLEFFCIGRRVCHIIARLTGSILVVI

SEQ ID NO: 180434 - protein, 75 aa, Triticum aestivum; identical to SEQ ID NO: 106874
  Clone ID: PAT_TA_74852.pep

SEQ ID NO: 180435 - protein, 83 aa, Triticum aestivum
  unsure (1)..(83): unsure at all Xaa locations
  Clone ID: PAT_TA_74853.pep
EGPHRRGHQPLREEGLLPQRSEAPERGEVVQPEASTTPDLSTYQSPSSARELSRKYIQYXQSPESVSYRVLERREQKKQFSRH

SEQ ID NO: 180436 - protein, 88 aa, Triticum aestivum
  Clone ID: PAT_TA_74854.pep
CCRRSCNRRVVELEPASAGAEDVFFAGTNFLLAGTCYYSFATSTTFWILFHVIFAGTRCALHRRSSFFAGTSFMFSWNLLHFCYIDFF

SEQ ID NO: 180437 - protein, 92 aa, Triticum aestivum
  unsure (1)..(92): unsure at all Xaa locations
  Clone ID: PAT_TA_74855.pep
NYAHPVTLMPCHENNHVHCVKHNVLCDNHVHKIMCKCVCAMVHHTHTTGDXLTPISCFHAKSIEYHPSIGFISILNXTNPSCPTDAKTAPPP

SEQ ID NO: 180438 - protein, 34 aa, Triticum aestivum
  Clone ID: PAT_TA_74856.pep
HPCCHVILLVLQMYPLWNLNVENSNRFWNLKFQG

SEQ ID NO: 180439 - protein, 236 aa, Triticum aestivum
  unsure (1)..(236): unsure at all Xaa locations
  Clone ID: PAT_TA_74857.pep
MLRVAGRRISSHLAWRPAAAASAGSSPLAGGLPGDDFPRDQNPRFAIESPFHVAARGFSAESLVPRDQDVELAELTPTTAALKNPCAKIVYDEYNHEXRYPPGDPSKRAFAYFVLSGGRFVYASLLRLLVLKFVLSMSASKDVLALASLEVDLSSIEPGTTVTVKWRGKPVFIRRRTEDXVKLATAVDVTSLRXPQEGLRVRVRTLKWLVRLGCPGPHLGCFPFPTXGDLWLGSWP

SEQ ID NO: 180440 - protein, 63 aa, Triticum aestivum
  Clone ID: PAT_TA_74858.pep
TPEQQVDEEDYQLAGSQVTMVVALGPGMVLRLCCASRALRVFPGDLLSTLPAPVTDSCCSARC

SEQ ID NO: 180441 - protein, 93 aa, Triticum aestivum
  Clone ID: PAT_TA_74859.pep
LPPQTCSAPQLRDGYLFHDQLRTKATAAPRRRCCVPLPSTSPEHCSHQPPSPARNSAVSEPQRSCTRILAITPGAFLPRFNLFGMKIPKGPCC

SEQ ID NO: 180442 - protein, 35 aa, Triticum aestivum
  unsure (1)..(35): unsure at all Xaa locations
  Clone ID: PAT_TA_74860.pep
NXVLLATICWIRLPDAQALASTYWSSKTGLRVGQL

SEQ ID NO: 180443 - protein, 35 aa, Triticum aestivum
  Clone ID: PAT_TA_74861.pep
NTDPLRVVANEGQSRCRFVEERLQPRLLRTARLSV

SEQ ID NO: 180444 - protein, 199 aa, Triticum aestivum
  Clone ID: PAT_TA_74862.pep
TRVLSWLLPKSKRKTKSDMSPSTAECENMSQLLKEWGVFSVESLKKELAEANEHRDAALQEVGEMRSSLGELTSKLLSLEAYSTELKKALKKATSTKNAQSHSKRSARSVGVSRDDSLPVSQEVMVEGFLQIVSEARLSIKQFCKVLLQQVEDADNGLADKLNLLLQPYQLTLADKHSKVILYHLEALMNQAMYQDFEN

SEQ ID NO: 180445 - protein, 37 aa, Triticum aestivum
  unsure (1)..(37): unsure at all Xaa locations
  Clone ID: PAT_TA_74863.pep
MAGGXLEGGTPSYAPSRLHSAPAXLLHQRDTQVGEKQ

SEQ ID NO: 180446 - protein, 171 aa, Triticum aestivum
  unsure (1)..(171): unsure at all Xaa locations
  Clone ID: PAT_TA_74864.pep
FGYARADRKXMGRESIAAXLVADLITEAGAHRVLACELQFGQXSSANFDIPVDHVYGQPVILDYLASKTICPNDVVVVSPDVGGVARARAFAKKFSDAPLAIVDKRRLGHNQAEVMNLIGDLRGKVAVMVDDMIDTAGTMHKGAELLHREGARSVYACSTHAVLSPPAVER

SEQ ID NO: 180447 - protein, 66 aa, Triticum aestivum
  Clone ID: PAT_TA_74865.pep
FISTTTAIIADHNNPDLQFGPQQHLHISLDRKLLRLLMNMNQSVSVRRLQEVRRRRAGCRGRRERR

SEQ ID NO: 180448 - protein, 45 aa, Triticum aestivum
  Clone ID: PAT_TA_74866.pep
RWPWCLCSDALLWYGAGATHGRAIMVVMLPVLRCVAGMPVARPTA

SEQ ID NO: 180449 - protein, 167 aa, Triticum aestivum
  unsure (1)..(167): unsure at all Xaa locations
  Clone ID: PAT_TA_74867.pep
GSPGLQSLAPFVLMTAMAVPKVRPSRWXVAGKGDKDWRLFFNTLFWNLNYWDCASTMAGEVERPEQTFPRALALAVVLIASSYLLPLIAATGAIDAPPDAWVNGYFADAAGIIGGPWLKYWTGAGAVISSIGMFEAQXSSGAFQLLGMADLGLLPAVFSRRAARTGT

SEQ ID NO: 180450 - protein, 183 aa, Triticum aestivum
  unsure (1)..(183): unsure at all Xaa locations
  Clone ID: PAT_TA_74868.pep
CRNPQWLLHRAEVWGGVSIGYLYMNRFAELMVXXPGAGAASRLLAALLAPLAWAISAATGAYYRXAIPMREHGMEPGHGFARCVSSCLISMLPDGFYYKVKEGSVVFARSRSFGFCHDGLVLDGAGAEKRVVPADVVVLATGFRGDEKLKNMYASPRVKDIIAGSSNSDTAVPLYRESVHPRD

SEQ ID NO: 180451 - protein, 162 aa, Triticum aestivum
  Clone ID: PAT_TA_74869.pep
KSCRLRWVNYLRPDLKRGKMTPQEESTIVQLHSLWGNRWSTIARSLPGRTDNEIKNYWRTHYKKGKPSKNIERARARFLMQRREMQQQQQQQKLLLGQVKDVELPGATVSDDVDEKMDGAVGPAATALADHGHEELIMQDVLDFLCPMSCALLHSAGQTGSC

SEQ ID NO: 180452 - protein, 182 aa, Triticum aestivum
  Clone ID: PAT_TA_74870.pep
QSRSTHRREASKMPTTTVEDLPADVLAYALRRLDGPSLAAAGCATAGLRALAADPGTWRALCLAQWPSLGLETEQQRNILGSAAVSPQRLFADAFPFPSTSTSTDAAAADQCFPGELISAVDIYQKAKGAPRPLFSRLVETSTSSSWFLTSPFRVDAVQCENPVPVRAASFSSAELELSWIV

SEQ ID NO: 180453 - protein, 144 aa, Triticum aestivum
  unsure (1)..(144): unsure at all Xaa locations
  Clone ID: PAT_TA_74871.pep
MAASALHQTTSFLGTAPRRDDLLXERFGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDY

SEQ ID NO: 180454 - protein, 151 aa, Triticum aestivum
  unsure (1)..(151): unsure at all Xaa locations
  Clone ID: PAT_TA_74872.pep
DQPRGATAIAGSVXVSLLCQGAGXLNTTGSVYKXPDNVSPPEITGSPTEKALLSWAVADLGMDADALKRSCKVLHVEAFNSDKKRSGVMIKDNAAGAVVAHWKGAAEMVLANCSMYMDTDGAARELGAEQRRNLEKVINDVAVGSLRCIAF

SEQ ID NO: 180455 - protein, 194 aa, Triticum aestivum
  Clone ID: PAT_TA_74873.pep
PGLQGEEGLASASRRGIACSLSLSLPDGHGVEGLLGAGGGEKGSSSDKAGGGAGEPDEVVELSLGLSLGGCFGANSGRDAKKPRLVRSSSLAAMCSLPGTSDDLAAATPPPAPLMRTSSLPTETEEERWRRREMQSLKRLQAKRKRLERRTSMNSGKSGGSSSRDDAQEPLYPSAFQLRRSVVDQGNTSSSMPE

SEQ ID NO: 180456 - protein, 175 aa, Triticum aestivum
  unsure (1)..(175): unsure at all Xaa locations
  Clone ID: PAT_TA_74874.pep
MAPAVMASSATTVAPFQGLKSTAGLPVSRRSGSAGLSSVSNGGRIRCMQVWPIEGIKKFETLSYXPPLSTEALLKQVDYLIRSKWVPCLEFSKVGFVFREHNSSPGYYDGRYWTMWKLPMFGCTDATQVLSEVEEVKKEYPDAYVRVIGFDNMRQVQCVSFIAFRPPGCEESGKA

SEQ ID NO: 180457 - protein, 119 aa, Triticum aestivum
  Clone ID: PAT_TA_74875.pep
CHLRRHLPLLRQQFDSVSPREFDDFEDMYKLYEGGLKIPDIPALDELFKSFPPLRSIMPAGGDFLLKMPMPHVIKEDKLAWRTDEEFAREMLAGLNPHIITRLNVFPPRSTLEGYGDQT

SEQ ID NO: 180458 - protein, 65 aa, Triticum aestivum
  Clone ID: PAT_TA_74876.pep
LLLPSRRWRWRWRPMWRVSGGVAAEGVRMEARSRWRLPKPLESVLTGGRSRSNSPAISRNGVDSG

SEQ ID NO: 180459 - protein, 74 aa, Triticum aestivum
  unsure (1)..(74): unsure at all Xaa locations
  Clone ID: PAT_TA_74877.pep
LASMIIHHYKMREDVESFNLGXMGCSAGLIAIDLAEDMLQANPNSYAVVLNTDNITLNWYFGNHRSLLLSNCIF

SEQ ID NO: 180460 - protein, 94 aa, Triticum aestivum
  Clone ID: PAT_TA_74878.pep
HHFTEDDETNCRAVFKVRSKGALFPGILILEGHTSEDFKGRFTNLYVRGIGSSRSITSSKPFHHFFHIKFVRGRLLVITRCVGRIHSVEHFHPA

SEQ ID NO: 180461 - protein, 109 aa, Triticum aestivum
  unsure (1)..(109): unsure at all Xaa locations
  Clone ID: PAT_TA_74879.pep
KRANGEEGGDDIDHDRRLLTSSDGSQRSXSEDGSVHGMMSEFGDNDFVVGNWESKEVLSRDGHMRLSSQVFFASIDQRSERVAGASACTSLVAVIADWFQANQNLMPIQ

SEQ ID NO: 180462 - protein, 93 aa, Triticum aestivum
  unsure (1)..(93): unsure at all Xaa locations
  Clone ID: PAT_TA_74880.pep
VFGDRPRTRSGGRRKKPGTALSGPHRRSSSRRRSKSPFINMVTARTLNDGKTWRKYGQKYIQXSTSPRSYYRCSHKPDQGCQATRQVQESDSN

SEQ ID NO: 180463 - protein, 158 aa, Triticum aestivum
  unsure (1)..(158): unsure at all Xaa locations
  Clone ID: PAT_TA_74881.pep
GSEDEDYCILCLFLVVLSVANAIPVKNIEDFGGGFADGVEIVIHDXVTECVADAQVTFDDFEAAMTDLEDGFKNKSLTALTRGIEELGAGIEEVALVLTACDVGTIAQDINAXAQQLKSGPEGILDFIVQESINIFHHGHDVTTDFKAAIAAWKSGDF

SEQ ID NO: 180464 - protein, 83 aa, Triticum aestivum
  unsure (1)..(83): unsure at all Xaa locations
  Clone ID: PAT_TA_74882.pep
GNVFGFKALRALRCGXDLRIPPTYSKTFQGPPHGIQVERDKLNNVVVDPLLGCTIKPXLGLSAKNYGRACYECLRGGLDFTKD

SEQ ID NO: 180465 - protein, 58 aa, Triticum aestivum
  Clone ID: PAT_TA_74883.pep
PPRPHVPPRPPPRPPPPLRLPARGVSPRSPPAAGGASSSTCPRGSPSRLSTACGYPRP

SEQ ID NO: 180466 - protein, 49 aa, Triticum aestivum
  unsure (1)..(49): unsure at all Xaa locations
  Clone ID: PAT_TA_74884.pep
QIPLFLLRKXLEPQCASADEAGLLLTSMVTGLVKELCPFKMIDGAFPAV

SEQ ID NO: 180467 - protein, 82 aa, Triticum aestivum
  Clone ID: PAT_TA_74885.pep
DLVRTYDFSLKDVVTWNCPGLGISEGPGCTALASGKALLPLPGGSGTWCPTPFGAGGLVDQHPLLNLRRCRREVSQAQARCV

SEQ ID NO: 180468 - protein, 37 aa, Triticum aestivum
  Clone ID: PAT_TA_74886.pep
VTSSPWPAMSSFVGLAIKFMALRVLLRLAGFSKVLRY

SEQ ID NO: 180469 - protein, 166 aa, Triticum aestivum
  Clone ID: PAT_TA_74887.pep
GAGERKPVPTIRVKARLAGKTHEIYVSAEATFGDLRRRVAERAGAHPEDLRTLYKGKEQDPKAFLDMAGVRDRSKVAVVDDPEARARRLLEELRLGSLRKAAGAVAAVAAEVDKIAPKVSALEASVRKGEKVAEKDVATVTELLMNELLKLDAVVAGGDVKAQRRV

SEQ ID NO: 180470 - protein, 35 aa, Triticum aestivum
  Clone ID: PAT_TA_74888.pep
SFSRFSGRRRSRNERNGGRLLLGGGSSAFGARGCP

SEQ ID NO: 180471 - protein, 82 aa, Triticum aestivum
  Clone ID: PAT_TA_74889.pep
MAGAQSYSTYRAKPHFNICTIGHVDHGKTTLTAAITKVLADTGLAKFRDYQSIDKAPEEIRRGITINASHVEYETDQRHYGH

SEQ ID NO: 180472 - protein, 169 aa, Triticum aestivum
  unsure (1)..(169): unsure at all Xaa locations
  Clone ID: PAT_TA_74890.pep
MAPAVMASSATTVAPFQGLXSPAGLPVSRRSSGSLGSVSNGGRIRCMQVWPIXEASRMFETLSYLPPLSTEALLKQVDYLIRSKWVPCLEFSKVGFVFREHNSSPGYYDSRYWTMCKLPIFGCTDTTQVLNXVEEVQKEYPDAYFRVIGFDDLRPVQCVSFIAFRPPGC

SEQ ID NO: 180473 - protein, 71 aa, Triticum aestivum
  unsure (1)..(71): unsure at all Xaa locations
  Clone ID: PAT_TA_74891.pep
IAHFDGQLLHVSNIGDSGFLVIRNGEVHAKSKPMVYGFNFPXEIEKGVDPLTLVENYTIDIEEGDVIIAAT

SEQ ID NO: 180474 - protein, 159 aa, Triticum aestivum
  unsure (1)..(159): unsure at all Xaa locations
  Clone ID: PAT_TA_74892.pep
NQASYFSLCVFLGAALSVTALPVLACILKELGLLGVPFGETAMAAAAVNDVXAWMLLALALAVSGGSREPKGPALAPVYILSSGALFVAFTFFALRPLMARLARRAGPSSSDGDLTCSCAVPCALLAGAVTDAIGVHPVFGAFVFGLAMPREDGVAERI

SEQ ID NO: 180475 - protein, 134 aa, Triticum aestivum
  Clone ID: PAT_TA_74893.pep
NLPHISDQKRSSGTGGDPIYTTSASVPCSSPSPLPEVTAGRSPCGGGGGGAFPCTLSRQDRRWRLSMRRLTAPPARVGSSAGACGVHIHPDRGQAKLFAIQVCAIKYSRKLRSRSMAAASLGSLSGCDAHYTRH

SEQ ID NO: 180476 - protein, 76 aa, Triticum aestivum
  Clone ID: PAT_TA_74894.pep
ARTNSERATEDITKCYRRHGYIRCKCRSSLEELRTNGEIKENNASAIVDTRTNSERATEDVPKAERWAIHKWKFNF

SEQ ID NO: 180477 - protein, 78 aa, Triticum aestivum
  Clone ID: PAT_TA_74895.pep
ALCSQLQTIDLQDNQIDQLTVGGTQYNKKLILLGNPICNRGNNEQYCKTATQSNPAAPPYSTSKNCSGLPSTCLPSQL

SEQ ID NO: 180478 - protein, 135 aa, Triticum aestivum
  unsure (1)..(135): unsure at all Xaa locations
  Clone ID: PAT_TA_74896.pep
MAASLQXAATLMPAKIGGRAFSGXRPSSHVARAFGVDAGARITCSLQSDIREVASKCADAAEMAGFALATSALLVSGASAEGAPKRLTFDEIQSKTYMEVKGTGTANQCPTIDGGVDSFPFQAGQYEMKKFCLEP

SEQ ID NO: 180479 - protein, 109 aa, Triticum aestivum
  Clone ID: PAT_TA_74897.pep
TEGVDTAMRWFEEMRRRSCAPTGVSFNTLMRGYFREGRYKEGLKVAYEMLQLGAGLSVASMEILIGGLCRGGEALRAAEVFAEFAVDAVVPEGLDCLDLVESLCHVGRV

SEQ ID NO: 180480 - protein, 75 aa, Triticum aestivum
  Clone ID: PAT_TA_74898.pep
MADAADALSARSKVQGFLEAACSGDLEALRKFGSALDEEGKGAAAVAAGVRDANKRTALHFAAREGQTEVCKFLV

SEQ ID NO: 180481 - protein, 121 aa, Triticum aestivum
  Clone ID: PAT_TA_74899.pep
FESVGERAGQRRGRAHRRRWPATSPPTSHQPSPPYWSFARSTRPPASAPSRSPARPTSPPASAPSGSSAQAKHRPPWAGPPISAPATLSTRHAIENDCLINWSIALLSKFSTIIFVHKITY

SEQ ID NO: 180482 - protein, 107 aa, Triticum aestivum
  unsure (1)..(107): unsure at all Xaa locations
  Clone ID: PAT_TA_74900.pep
VYKARLKDGSVVAIKKLIHYTGQGEREFXTAEMETIGKIKHRNLVPLLGYCKXVGDERLLVYEYMKHGSLDMVLHDNDDEAMVKLDWAARKKIAIGSARGLAFLHHS

SEQ ID NO: 180483 - protein, 140 aa, Triticum aestivum
  unsure (1)..(140): unsure at all Xaa locations
  Clone ID: PAT_TA_74901.pep
SDHERLRALKAFDGTKAGVKGLVDAGVTTXSPAIFHHPPESLADAPHHHRGHHQFAIPVIDLAGLGTPSERASVVGVMKAAAATVGFFQVTNHGVPDSAMSKVLAAVRRFNEEPAEAKAPYYSRDPKRRARYQCNFDLFR

SEQ ID NO: 180484 - protein, 53 aa, Triticum aestivum
  Clone ID: PAT_TA_74902.pep
NLQGDDDEYSDGAEEAGGELLGVMEEPSGAGGRANHQGLLQRTATLSPSTAPM

SEQ ID NO: 180485 - protein, 62 aa, Triticum aestivum
  unsure (1)..(62): unsure at all Xaa locations
  Clone ID: PAT_TA_74903.pep
GYARFVNVRDDTGATPLHLAARQVWRRCVHVLLENGAVVSASSGAFGFPGSTPLXLAARGGS

SEQ ID NO: 180486 - protein, 59 aa, Triticum aestivum
  Clone ID: PAT_TA_74904.pep
TAVNPSAGSPVLGARASLAATHDQEAKKTSRETLIQERARRTNVYSVLYSTMCVASALS

SEQ ID NO: 180487 - protein, 84 aa, Triticum aestivum
  unsure (1)..(84): unsure at all Xaa locations
  Clone ID: PAT_TA_74905.pep
PDCXAELLGRISPPPTRPIRPLDREKLRRAALAASTLPPPSAVLYHDGSCSYLLQDPIFKSIELFKYDQLPTAANLWYLSTILR

SEQ ID NO: 180488 - protein, 158 aa, Triticum aestivum
  unsure (1)..(158): unsure at all Xaa locations
  Clone ID: PAT_TA_74906.pep
MAASACTRRPAFLGTAPRRDDLVRSVGDFGGRITMXRRTVKSAPQSIWYGPDRPKYLGPFSEQTPSYLTGEFPGDYWWDTAXLSADPETFAKNRELEVIHSRWAMLGALGCVFPEILSKNGIXFGEAVWFKAGAQIFSEGGLDYLGNPYLVHAQSILA

SEQ ID NO: 180489 - protein, 56 aa, Triticum aestivum
  Clone ID: PAT_TA_74907.pep
KGCLSRKIQNKIVFVYVRLTDESISFQVSTQQPSCTYMFCFRDARVHWPAYHTSLH

SEQ ID NO: 180490 - protein, 186 aa, Triticum aestivum
  Clone ID: PAT_TA_74908.pep
MAGVASLNAVSLSAPSPQAPGATSARVSLEARNPTPAPTEALTLLNGEWILAYTSFSQLFPLLGSGRLQALVKVDEISQTIDSENFAVQNCIKFSGPLASTSVSTNAKFEIRSPKRVQIKFEEGIIGTPQLTDSIVLPEKFELFGQNIDLSPLSGIFTSIENAASSVAKTISGQPPLKIPFRSESA

SEQ ID NO: 180491 - protein, 59 aa, Triticum aestivum
  Clone ID: PAT_TA_74909.pep
HDGEHEEVPYARVDPEEEPPWPPATASARPGSRRSPATADGALASDPEGLRGTGRRRRR

SEQ ID NO: 180492 - protein, 176 aa, Triticum aestivum
  unsure (1)..(176): unsure at all Xaa locations
  Clone ID: PAT_TA_74910.pep
SDCGDCLAAAARSNAXGLPNRCPGSTTVLAWFDPCLVRYSNTNFFGKAEIGEIYALNGPRAIWEPMRYRDDVVRNLNESXGAAVASSQRFAASSTDPYTLVQCTWDLPPDQCKQCLDVLTANASKDWTSMAVDCKRRSYSCSVRYGNTSFVVVPFGGAPTSQSVDQASRPATQSSG

SEQ ID NO: 180493 - protein, 126 aa, Triticum aestivum
  unsure (1)..(126): unsure at all Xaa locations
  Clone ID: PAT_TA_74911.pep
PEGDIRLSVDDWIDRDYDYFEYLTPNMRNSSLQXLQGPCYPIIFPSINVYWSCQFIARPSNVSLKHWQQIGGVSIDENMLIDQTIHNTINYESSVLKRYVADIGKSWPVLIVCGGLLPLFLSLIWL

SEQ ID NO: 180494 - protein, 118 aa, Triticum aestivum
  unsure (1)..(118): unsure at all Xaa locations
  Clone ID: PAT_TA_74912.pep
MLEMKPCTAIALVLVVTRQCAALATXAGPRVIIVGAGMSGISAGKRLSEAGITDLLILEATDRIGGRIHKTKFAWVNVEIGANWVEGVNGDEMNPIWTMANGTGGLNLRTFRSDFDHL

SEQ ID NO: 180495 - protein, 164 aa, Triticum aestivum
  Clone ID: PAT_TA_74913.pep
AFRYLFGARPAAVQRAIPQPDRQLLGSLPADEFSAEATDRLRHMLHYNVLGGKLNRALTVFTAMKACLHPAQPTEQQIQDGLVLGWCMELIQAAFLMADDVMDNSDLRRLKPSWHKEVGPMAINDAFIIEGIVYHMIRKYFRSRSWYIDVLEMIQKITLVTELG

SEQ ID NO: 180496 - protein, 136 aa, Triticum aestivum
  Clone ID: PAT_TA_74914.pep
MRALGFSSIPLITAESAELGLTGAVYHSYLYRRRPGGGGRRSLATGTFCVALQNADPTALQAGLSWACGQGQADCSAVQPGGACYKQNNVAALASYAYNDYYQKSASTGATCSFNGTATTTATDPSSGSCVFAGST

SEQ ID NO: 180497 - protein, 74 aa, Triticum aestivum
  Clone ID: PAT_TA_74915.pep
CRRALTALEIPTDRPAFYHSFKSFGVPAAATAVRLVTPPTETRTSRPECISIYMPPSPPEMVYFAKRFAYAYIT

SEQ ID NO: 180498 - protein, 157 aa, Triticum aestivum
  unsure (1)..(157): unsure at all Xaa locations
  Clone ID: PAT_TA_74916.pep
CAATVFLSVVSLVILASLLSRRSKKKRSPGPWCLPLIGNLLHLLTSQPQAALRDLARKHGPVMSLRLGQXSTPVVISSPAAAQEVLRDKDLTFASRPSMLTSDIILYGNMDIAFAPYGPYWRMLRKLCMVQLLSAHKVRQLAPVRDGETRSLMRKVG

SEQ ID NO: 180499 - protein, 173 aa, Triticum aestivum
  unsure (1)..(173): unsure at all Xaa locations
  Clone ID: PAT_TA_74917.pep
MAASLQAAATLXPAKIGGRASSARPSSHVARAFGVDAGARITCSLQSDIREVASKCADAAEMAGFALATSALLVSGASAEGAPKRLTFDEIQSKTYMEVKGTGTANQCPTIDGGVDSFPFKAGEYEMKKFCLEPTSFTVEAEGIQKNEPPAFQKTKLMTRLTYTLDEMEGPLE

SEQ ID NO: 180500 - protein, 97 aa, Triticum aestivum
  unsure (1)..(97): unsure at all Xaa locations
  Clone ID: PAT_TA_74918.pep
MPRATLIPAKIGGRASSARPSSHVARAFGVDACARITCSLXSDIREVASKCADAAKMAGFALAXTSALLVSXASAEGAPMRLTFDEIQSKTYMEVKG

SEQ ID NO: 180501 - protein, 130 aa, Triticum aestivum
  unsure (1)..(130): unsure at all Xaa locations
  Clone ID: PAT_TA_74919.pep
ARGPDRVLYLGPLSGEPPSYLSGEFPGDYXGWNPAGLSADPETFAKNRELXEVIHCRWAMLGALGCVFPELLARNGVKFGEAVWFKAGSQIFSEGGLDYLGNPXLVHAQSILAIXACQVVLMGAVEGYRV

SEQ ID NO: 180502 - protein, 144 aa, Triticum aestivum
  unsure (1)..(144): unsure at all Xaa locations
  Clone ID: PAT_TA_74920.pep
FPPYSSSASSPVTKLLLLHRKATAQRGFTGFAPPFQKLVLEGLPWLSRRCSSALRASIVLLITFFQGPVVSAITFTFANRCTDTVWPGLLSGSTSPXXETTGFALSPGQSRSIYGPTGWSGRFWARSGCNFNGGKGTCVTGDCG

SEQ ID NO: 180503 - protein, 87 aa, Triticum aestivum
  unsure (1)..(87): unsure at all Xaa locations
  Clone ID: PAT_TA_74921.pep
LLLHPTSLRGPHGIGDLXDQAIAFLDWLHGARCTLWQVLPLVPPGRKSGEDGSPYSGQDANCGYTLLISLEELVQDRLLMENELPDP

SEQ ID NO: 180504 - protein, 174 aa, Triticum aestivum
  unsure (1)..(174): unsure at all Xaa locations
  Clone ID: PAT_TA_74922.pep
MAASLQAAATLMPAKIGGPGLLPRRPSSHVARAFGVDACARIXTCSLQSDIREVASKCADAAXMAGFALATSALLVSGASAEGAPKRLTFDEIQSKTYMEVKGTGTANQCPTIDGGVDSFPFKAGKYEMKKFCLEPTSFTVEAEGIQKNEPPAFQKTKLMTRLTYTLNEMEGPL

SEQ ID NO: 180505 - protein, 185 aa, Triticum aestivum
  unsure (1)..(185): unsure at all Xaa locations
  Clone ID: PAT_TA_74923.pep
RLARDGYVGGAGPGGWMATLATSGASSRGGEGRSFREREIQXAAFGAFGRGCKASSNSDLGDTQLKEGKATATIAMVVEDLMVPEYTPVADLVSNWGEKEAVSSAFNLLVNGEFGDSSVSCAKLKPRVIRFDVVTNFEEGDDYFKGTEHDFGPQTLATASSCSAVRSFQGSMSSQDYPAAQAGKN

SEQ ID NO: 180506 - protein, 150 aa, Triticum aestivum
  unsure (1)..(150): unsure at all Xaa locations
  Clone ID: PAT_TA_74924.pep
PEPGGTRREEGKGREEETTEPSARTRQQAPRSRAGAEXGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNE

SEQ ID NO: 180507 - protein, 140 aa, Triticum aestivum
  Clone ID: PAT_TA_74925.pep
LPRRRATVPKVASPPHASTRLRAHSCCRPPSLSRARHRAPRTHGAIEEDRLASSGGDDRQIEAAEEEKVFVAVPAEPRAGQSTLAWALRHLYGGAATTTIIVTHVHVPSQIIPIMGVKFHADKLSPEPVRAFRRAERERA

SEQ ID NO: 180508 - protein, 111 aa, Triticum aestivum
  Clone ID: PAT_TA_74926.pep
REGREIQRKHAEKRRLRHGFDGKAAELRAKAGGSNSANYSPPEHHWAAPQRKESQSPAVEADEDEPPPPPPASARRPLIAGRERAALLGFGFRGRARAWVLDLGELRGGEG

SEQ ID NO: 180509 - protein, 95 aa, Triticum aestivum
  Clone ID: PAT_TA_74927.pep
MAPTKGEGPAIGIDLGTTYSCVGVWQHDRVEIIANDQGNRTTPSYVAFTDSERLIGDAAKNQVAMNPINTVFDAKRLIGRRFADAPVQSDIEMWP

SEQ ID NO: 180510 - protein, 40 aa, Triticum aestivum
  Clone ID: PAT_TA_74928.pep
VLNYCHCHVQSWSLDAWPKVLVKMLTQLCCTRKIVTEQKS

SEQ ID NO: 180511 - protein, 40 aa, Triticum aestivum
  Clone ID: PAT_TA_74929.pep
RVAERKARKQSERRTYLVAAVMSSLGVTSMAIASVYYRFA

SEQ ID NO: 180512 - protein, 147 aa, Triticum aestivum
  unsure (1)..(147): unsure at all Xaa locations
  Clone ID: PAT_TA_74930.pep
TQALRQVVSWVTVEDVTGIWRDGEEPYAAACGGDEGPTFRFSDQCGRVTWTNVAFNRAVSGREGADAAMAPSAAASEVRVVLAAXDGAPVPAWGSCAGFTCRVHVPYACPRRGSLVAPCDVWRLDSCGYLWRLDLQATLSLSLGGFI

SEQ ID NO: 180513 - protein, 161 aa, Triticum aestivum
  unsure (1)..(161): unsure at all Xaa locations
  Clone ID: PAT_TA_74931.pep
LRARNAKLPRKFQLRRRMSTMWSRLSKRLIHDASHCYFEQAQAAFATADVDGSGTMDALEFHRMLNAELCEPISKAKAHEVMRQLDVDGSGVIDFNEFFLWYASEKCQDYPAXAQTERIRALLKTKRRAKATALAALTASVSNGTKLRDTMARHHKEQQLR

SEQ ID NO: 180514 - protein, 171 aa, Triticum aestivum
  unsure (1)..(171): unsure at all Xaa locations
  Clone ID: PAT_TA_74932.pep
AHAQQEAIAVDCILLKHAKQXWTTLAEQGQSHTKRIXSAVEARAAKRLKAKDEEVERIRTMNWALDERLRNLLMEAQMWRDVAQSHEATANVLRGDLQRVLDAQAVRGSGSGDGQEDDAXSCCXGENQVPLGAEEEVGTPXVEERPATGTRMCKACHDGXAVVLLLPCRHL

SEQ ID NO: 180515 - protein, 127 aa, Triticum aestivum
  unsure (1)..(127): unsure at all Xaa locations
  Clone ID: PAT_TA_74933.pep
HSKPDKGKQSSRVSAGKGRETAVTEMKKGDWLCPNCNFLNFARNRQCLECKVDXPKKIEAATSEMKMGDWICPECAFMNFSRNKMCFKCEGQRPKRQLNPXEWECPSCDFVNFRRNQECKKCSHDRP

SEQ ID NO: 180516 - protein, 143 aa, Triticum aestivum
  Clone ID: PAT_TA_74934.pep
TRGGIAKLFAQHLEGDVTIVMPATLAQYSKIIQNPSYSELQKAASQVRRCTWEKLSAIRANCAIELALDECVALLNHMRRLKRSAERAAASQGYGATIRLCPSRRIPSWNLIARENSTGSLDEEMLTCPTVTSHQAVGGTAGP

SEQ ID NO: 180517 - protein, 113 aa, Triticum aestivum
  unsure (1)..(113): unsure at all Xaa locations
  Clone ID: PAT_TA_74935.pep
SYSWSCPSKMPRRRAGRRTVPCGSGKETHQAGENETAGEPRSENAGLNQPKPTDHAQQRXSSPTKNPQEEDACLHDAHEQKRPPVSQEGDPDDAVQTEQEQEQPSPSQNATSS

SEQ ID NO: 180518 - protein, 124 aa, Triticum aestivum
  unsure (1)..(124): unsure at all Xaa locations
  Clone ID: PAT_TA_74936.pep
TARGVVGLPLVRSPGAPFTCDDDVSAGCHLHLLRHRVPQGMDVVHTFADTELGQGDEPCTSPPPXSPCKAGVVYIVADTTHRQASFAPSLGSTRLLATPTSFLSGRYCPSLLQHPHQCTSSTLS

SEQ ID NO: 180519 - protein, 41 aa, Triticum aestivum
  Clone ID: PAT_TA_74937.pep
RTRATRSTEEAEGVKHGVQWSSCVCSPACCCYPRSHQLSKL

SEQ ID NO: 180520 - protein, 77 aa, Triticum aestivum
  Clone ID: PAT_TA_74938.pep
THEGGHDEGDHCAELAFRCLQQNSEMRPPIREVLDGLRGIQEGGAKAKKYDVVVVPRSPNTVHAPWDSMSTTPSISL

SEQ ID NO: 180521 - protein, 37 aa, Triticum aestivum
  Clone ID: PAT_TA_74939.pep
EFCFELDGGRSPGTARPFSHLVILIHRKVSKHMQSMQ

SEQ ID NO: 180522 - protein, 105 aa, Triticum aestivum
  unsure (1)..(105): unsure at all Xaa locations
  Clone ID: PAT_TA_74940.pep
STRLQDNFFASFALGWLITNGAGLAXSYPIDTVRRRMMMTSGEAVXXYKSSLDAFQQILKKEGAKSLFKGAGANILRAIAGAGVLSGYXQLQILFFGXKYGSGGA

SEQ ID NO: 180523 - protein, 119 aa, Triticum aestivum
  Clone ID: PAT_TA_74941.pep
MPNVQGYEAKYYAVGSPAANVLRVEINRPEKLNAFIEPMWLELGVLMNEVSHDPHYRAVLITAAGERAFTAGLDVQAASQSGVLAGNSGMNPARTATGVRRHIAQFQDCISSVEKCEKP

SEQ ID NO: 180524 - protein, 52 aa, Triticum aestivum
  Clone ID: PAT_TA_74942.pep
HHSQQHWCCQGTPRTAYCAFVFRHCFEWTAYFFSLSNSHLDVFWMSHLSSHK

SEQ ID NO: 180525 - protein, 67 aa, Triticum aestivum
  unsure (1)..(67): unsure at all Xaa locations
  Clone ID: PAT_TA_74943.pep
PETEEQGKLFIELNFPMSDYVGCDPADELXSIPETLNGASVVSVHKSLTTTDFIVELSSGKEVADLL

SEQ ID NO: 180526 - protein, 113 aa, Triticum aestivum
  unsure (1)..(113): unsure at all Xaa locations
  Clone ID: PAT_TA_74944.pep
MLDKLWDDVXAGPRPETGLDKFRRAAATQPLAINTAAGEAIKQSPSMPTTPTTPVTPSSSTPPRGGSVWRSVFHPGSNLATKSLGANLFDRPQPNSPTVYDWLYSDETRTRSN

SEQ ID NO: 180527 - protein, 202 aa, Triticum aestivum
  unsure (1)..(202): unsure at all Xaa locations
  Clone ID: PAT_TA_74945.pep
HILAAATYTLQEQAGEEQQQQDRAGTVSLFSVDAXAEDESRRLRLLHTVETAGVFDMKWSPTAPLLAQADAHGRLVLRRLEHEDGSDEGVVLTDVVAGNISSSMCLYVDWNQNADSLAVALSDGSLSVVPMREDRLEVSEQWTAHQYEVWTCYFDRARPHLLYSASDDCSFGCWDLRESLSNAVFRNXKTHTMGVCCIAQNP

SEQ ID NO: 180528 - protein, 174 aa, Triticum aestivum
  unsure (1)..(174): unsure at all Xaa locations
  Clone ID: PAT_TA_74946.pep
PNQATGLVAASQANFMRVIVSSTAPGLEQHQGTDLLCLVRALLKKIRRRVLVGDRVLVGAVDWTDRRGMIEDVFERRSEVVDPPVANVDRLVVLFSLDQPQPEPATLTRFLVEAESTGIPFVLAFNKVELVYNQIISYXRDRLKSWGYDPLFLSVDQRSGLSALEEMLEGQTTV

SEQ ID NO: 180529 - protein, 195 aa, Triticum aestivum
  unsure (1)..(195): unsure at all Xaa locations
  Clone ID: PAT_TA_74947.pep
ARGSFEDTQQFGYVFKMTRKTFSYICSLVMKPSMEDMNNYTFVDGRVLSLEDRVAVALRRLQSSELPESIGSSLGVSESTLLLVTESFIVAVDKRAGHHSRWPDSSEMDXVKSMFEKIHNMHNCCGVICTTHIPFGQCWDREKNETILVQLVIDPAMRFRTIWWGRISSMDQXSILHESYFFKECEKGARLNGSK

SEQ ID NO: 180530 - protein, 101 aa, Triticum aestivum
  unsure (1)..(101): unsure at all Xaa locations
  Clone ID: PAT_TA_74948.pep
MGAYKFVXSELWRRKQSDVMRFVQRVRCWEYRQQPAIVRITRPTRPDRARRLGFKAKQGYVVYRIRVRRGGRKRPVPKGIVYGKPKHQGITQLKFQRNKRS

SEQ ID NO: 180531 - protein, 188 aa, Triticum aestivum
  Clone ID: PAT_TA_74949.pep
TRPQHQHQQQQQQVLQQQQQQQQQVLQQQQVLQQQQQQVLQQQQQQQQQQQQQQQLQQQSQPQSSSQHNQHNTTLKNQQQAARTPVSLTQKPDSPATLQATNMQLVDIASADSASGESSNRLLSERSIHDLLAQIDPSERLDPDVEDVLIDVAEDFIESVGTFACSLAKHRRSTTLEAQDVLLHAERS

SEQ ID NO: 180532 - protein, 53 aa, Triticum aestivum
  Clone ID: PAT_TA_74950.pep
LSFTHYSPPKEGWVKLNTDGSFMNSNEARAGMILRNDQGEIIFSACRALYSCR

SEQ ID NO: 180533 - protein, 51 aa, Triticum aestivum
  Clone ID: PAT_TA_74951.pep
MAVPALLTLLLLLLTLALSSASGAPVGEDYVRPPARPRAGQRKALLGLFPW

SEQ ID NO: 180534 - protein, 36 aa, Triticum aestivum
  Clone ID: PAT_TA_74952.pep
KFEVEGPLAVYSYGQIKKATMNFSDKIGEGGFGSVF

SEQ ID NO: 180535 - protein, 156 aa, Triticum aestivum
  Clone ID: PAT_TA_74953.pep
TRLKKMVKFMCRLKFLSLRGHHEIKRLPSSIGDLRQLQTLDVRHTSIVTLPVNITKLHNLQYIRAGSATAVKKAPTQLSNHSGVRRPVGVVVPRGIGKLTALHTLGVVNVRASATKAFLEDIKKLTHLRKLGVSGINESNGSEFFLAITVLVHLES

SEQ ID NO: 180536 - protein, 156 aa, Triticum aestivum
  Clone ID: PAT_TA_74954.pep
MSPQTETKAGVGFKAGVKDYKLTYYTPEYDTKDTDILAAFRVSPQPGVPPEDAGAAVAAESSTGTWTTVWTDGLTSLDRYKGRCYHIEPVAGEDSQWICYVAYPLDLFEEGSVTNMFTSIVGHVFGFKALRALRLEDLRIPPTYSKTFQGPPHGIQ

SEQ ID NO: 180537 - protein, 126 aa, Triticum aestivum
  Clone ID: PAT_TA_74955.pep
MHKEKLCWRGEWKLSDMRIKDGLFRIDKQALYDADVDGMAEDFKKYIELLNPYYVVVEQSSSYSPPYWEILQTDTMVIPDPSKDPKAFRRSLKYMSAHFAFMPPVSIYQFLCLLYSTCDGLKANSD

SEQ ID NO: 180538 - protein, 141 aa, Triticum aestivum
  Clone ID: PAT_TA_74956.pep
HEGNRKRSTTTTAVGQRRLAHCDDRQAAQPGSSGGDMGRRVTRAEVGLPDGADCRLVESVIVSIVDFFNVRYITGLSFVLGPRRRKETTNTTTDGSCGNDDHDDLEKVLDLGYIATRSADRVILPVQHHEQYQRLLQGFHV

SEQ ID NO: 180539 - protein, 123 aa, Triticum aestivum
  Clone ID: PAT_TA_74957.pep
SWWAYAWSIGREDLRRAIHALKVGTALTLVSLSYILEPLFKGVGKNAMWAVMTVVVVLEFTAGATICKGLNRGFGTVIAASLAFIIELVAVRSGKVFRGFFVASSVFLIGMHRVKLEFRMALV

SEQ ID NO: 180540 - protein, 156 aa, Triticum aestivum
  Clone ID: PAT_TA_74958.pep
MAATTTMALSSPAIKLAGASYALGGGGRITMRKAAPKASASNSPWYGPDRVLYLGPLSGEPPSYLSGEFPGDYGWDTAGLSADPETFAKNRELEVIHCRWAMLGALGCVFPELLARNGVKFGEAVWFKAGSQIFSEGGLDYLGNPSLVHAQSILAI

SEQ ID NO: 180541 - protein, 75 aa, Triticum aestivum
  Clone ID: PAT_TA_74959.pep
WIQVADHKSSPHVLLTHCAKQENSSALKHQNLDNLRRRPPAARGGSSSRCRRQPSSPLWISLSYHGRCQGWVLCK

SEQ ID NO: 180542 - protein, 98 aa, Triticum aestivum
  unsure (1)..(98): unsure at all Xaa locations
  Clone ID: PAT_TA_74960.pep
LSQNYMQLFGVLLSNATWDRPPCVPALVRLLRAFLRKIPNELIQEGRLPNILVIFRSLVSRRQHXDSAFYMLDTLVENVGLDIINPHMSEIWSALFTR

SEQ ID NO: 180543 - protein, 82 aa, Triticum aestivum
  Clone ID: PAT_TA_74961.pep
RAQSIERNARVREDGDAHTATIFLLFSTATKRSFYDQELIGEQQLHRVTQLDVLALCFLETTQCTCPRHQPWAGRTGWQRVC

SEQ ID NO: 180544 - protein, 134 aa, Triticum aestivum
  Clone ID: PAT_TA_74962.pep
QPHVRASHVLPLRAPYLPWYDRWKHLGDVLVIKMLKVLDFLPCYMRFLPSRHGDDFFSLLFSYYTGRYIYLLGGCFAINWDPGFRVFSCLVKMSKLFEPFRRSQFRRIMILSVFYFFTNSLSVNSSGESRKQIT

SEQ ID NO: 180545 - protein, 101 aa, Triticum aestivum
  Clone ID: PAT_TA_74963.pep
VFSSGGGSWLLDSGATNHMTRSKDLVVDVHKVLSMPTNVEWGDASSSKVLGLGKVVISHDLTIEKVMLVESLAYNLLSVRQLAIMGFATFFDIDTVALLWS

SEQ ID NO: 180546 - protein, 162 aa, Triticum aestivum
  unsure (1)..(162): unsure at all Xaa locations
  Clone ID: PAT_TA_74964.pep
NGRSLDRPPRGRDRAADVAHKSAHDSRGDLHQKAGLTRSIYGSRKRAPAQNQKRTLQPSECHDTSTYRGAVHPLCFTDEVLDHEFPEGFKPMNIEAYDGTTXPGVWIEDFILHIHMARGDDLHAIKYLPLKLKGXARHWLKCLPENSIGSWEELEDAFRANF

SEQ ID NO: 180547 - protein, 64 aa, Triticum aestivum
  Clone ID: PAT_TA_74965.pep
AARYHYRGGQSGFGHSGDQMGRGGHLGGAGDEPKLLVESDCARGRPESVPTASEAAAGARVCSG

SEQ ID NO: 180548 - protein, 135 aa, Triticum aestivum
  unsure (1)..(135): unsure at all Xaa locations
  Clone ID: PAT_TA_74966.pep
RAHVPAQELRMISITWSFEVWGLDMVGPFKISRDKKTHLLVAVDKFTKWVEAEPVSKCDAAMAVQFMKKVIFRFGFPXIITDNGTNMSKGAMEEFCQCEHIXLDVSSVAHPQSNGQAERENQEILKGLKPRLWFP

SEQ ID NO: 180549 - protein, 163 aa, Triticum aestivum
  Clone ID: PAT_TA_74967.pep
APIVQPPDWNLPFKIMCDVSDYVVGASLGHIVDKKLNVIHYASKNLDSAQRNYATTEKEFLAVVFACDKFRSYIVDSKVTVHTDIAAIKYLMEKKDTKPRFIRWVLLLQEFDLHITDRKGAEYPVANNLSRLENVLDDPLPIDDSFPGEQLALINASRNTPWY

SEQ ID NO: 180550 - protein, 55 aa, Triticum aestivum
  Clone ID: PAT_TA_74968.pep
SCTFTLLHTRLWFACCSLSSAAYQLGHFYCLSSKLTRFEDFLNNPLFTPPPLVNN

SEQ ID NO: 180551 - protein, 77 aa, Triticum aestivum
  Clone ID: PAT_TA_74969.pep
VIKSAMCELSCYLHKSYRGMFQRLPPPLPPPQSYQDWVHNLSCLPCVIYHFICMEVTVVCYNDFPHPYPHRLSYQDW

SEQ ID NO: 180552 - protein, 78 aa, Triticum aestivum
  Clone ID: PAT_TA_74970.pep
WILASLIGCLSAQPGENVRIPWLFAFVTTRGRRPLLNVEAKERIIYEATGHYPANTWSVKKNPPCKRRRQHTRRTHRH

SEQ ID NO: 180553 - protein, 61 aa, Triticum aestivum
  Clone ID: PAT_TA_74971.pep
WISHIELNETITIICCVIFSLFFPLGLKKFWQHIKHYAPHIFPTGFLKESLIKMMILHEQV

SEQ ID NO: 180554 - protein, 39 aa, Triticum aestivum
  Clone ID: PAT_TA_74972.pep
GMPKEMATIQTKTNLWVMTKILVEVLVAHDLADIGKKMY

SEQ ID NO: 180555 - protein, 43 aa, Triticum aestivum
  unsure (1)..(43): unsure at all Xaa locations
  Clone ID: PAT_TA_74973.pep
GELHIFFSVKLGRXRFCFLHRIRAHLKESSFLEPNHSTVEFVK

SEQ ID NO: 180556 - protein, 38 aa, Triticum aestivum
  Clone ID: PAT_TA_74974.pep
AASAALIHPVHIESSVCLSLLYYFERIIYHLNKSSDIY

SEQ ID NO: 180557 - protein, 78 aa, Triticum aestivum
  Clone ID: PAT_TA_74975.pep
MQHGGDWDSSNVHADHIDFLCKTRRMPGEDQVRVHLAPKKEITPAPEEGERVIFCSHFLRGLGLPASAFFHSFLSLSP

SEQ ID NO: 180558 - protein, 39 aa, Triticum aestivum
  Clone ID: PAT_TA_74976.pep
WSWSWRLLLLLSFGFTLAHLPCLAQCGGALWLRLPVHRL

SEQ ID NO: 180559 - protein, 44 aa, Triticum aestivum
  Clone ID: PAT_TA_74977.pep
MDSHIELNETITIICCVIFSLFFPLGLKKFWQHIKHYAPHIFPT

SEQ ID NO: 180560 - protein, 107 aa, Triticum aestivum
  Clone ID: PAT_TA_74978.pep
SGLLPIVLLGLVSSGLHCRSGGDNLCHLSLHVSVSFFKFDVEETCPDLRVPPTTGNWPRSLFPVASSLPTCNWARSVFDPFFCFSRKSSLDSQLSPNFFLSQLQAHP

SEQ ID NO: 180561 - protein, 81 aa, Triticum aestivum
  unsure (1)..(81): unsure at all Xaa locations
  Clone ID: PAT_TA_74979.pep
IPMAGSQQRKNPRVLVGGGNSKDGVCVRIAFRLGANYHGTVLILERYLRDGKLGREILPTXSDGRTCWDGLLKPNDEQKKK

SEQ ID NO: 180562 - protein, 80 aa, Triticum aestivum
  Clone ID: PAT_TA_74980.pep
FSKGISFLCTRTAHEAAGDDQYFSMLDVLFSRWVFIHLSLHESVAVIGMPRPEMKNKFTLCSQIINSLGSVGMEGTRGYS

SEQ ID NO: 180563 - protein, 48 aa, Triticum aestivum
  Clone ID: PAT_TA_74981.pep
TFNQLLDSDHAGTNSQPGVQDSYHHTINTCPGGRSERGRSEGDTCNTR

SEQ ID NO: 180564 - protein, 67 aa, Triticum aestivum
  Clone ID: PAT_TA_74982.pep
LLARGVPVFWLMLEVLLVWHCRSRFRLGRFSCDVFSIRAKHPLLVCSGHHVHACVRSCHELYPSLYS

SEQ ID NO: 180565 - protein, 88 aa, Triticum aestivum
  Clone ID: PAT_TA_74983.pep
GFEPQPSAPHCHDGHDLALPPGSAQKAAKVSAPTLSSEPTAPIEAGWLDTASGAAIPTAIEPNTSLVLRAAQNSKVLDSFLDSEPSAP

SEQ ID NO: 180566 - protein, 48 aa, Triticum aestivum
  Clone ID: PAT_TA_74984.pep
WNGVHPFILPYPPAGFLTPGHATHVSDRYLQRYVYYIFVNLIFWCRPV

SEQ ID NO: 180567 - protein, 20 aa, Triticum aestivum
  Clone ID: PAT_TA_74985.pep
IIISNNMISSKTKNTYDLLC

SEQ ID NO: 180568 - protein, 55 aa, Triticum aestivum
  unsure (1)..(55): unsure at all Xaa locations
  Clone ID: PAT_TA_74986.pep
ENSTYGKLXFERDRLKVAQSRQKSYADSKRKETVYETGDRVYLRVSQLRGVERFG

SEQ ID NO: 180569 - protein, 62 aa, Triticum aestivum
  Clone ID: PAT_TA_74987.pep
SRFQYELLVHTPNTDVNRRILECRFTHFAPYVVHIEHKVETLILGRREYIFAMIFLRNRYLL

SEQ ID NO: 180570 - protein, 74 aa, Triticum aestivum
  unsure (1)..(74): unsure at all Xaa locations
  Clone ID: PAT_TA_74988.pep
MKNSLRAVGIGYDMIHVCKRIIVYCXRKDYANLSECSKCTSSRWKDGDAMKRIPHNVLRHFPVTPRLQRLFHDA

SEQ ID NO: 180571 - protein, 54 aa, Triticum aestivum
  Clone ID: PAT_TA_74989.pep
CGTLDTTMKILRDWPSCQSPDKKFWVSRSPSSFLNHWIKIQWTIHIFDRPLMFL

SEQ ID NO: 180572 - protein, 100 aa, Triticum aestivum
  Clone ID: PAT_TA_74990.pep
SPFLPLVGPNTRPFPPFCGMPGLVSIGYSIQAGWLPMNNTCSVASRRTRRIPLPRHEHDDDTVSPFQPSHNYVHKPWPYVCASRRSRPRLYVRTWPYLLS

SEQ ID NO: 180573 - protein, 62 aa, Triticum aestivum
  Clone ID: PAT_TA_74991.pep
YSGLAYLACIFMTTCGGLVFKKAIATPTVADSFSPHDGLHHDHSLLHFHSSLTIAHPLFKLH

SEQ ID NO: 180574 - protein, 44 aa, Triticum aestivum
  unsure (1)..(44): unsure at all Xaa locations
  Clone ID: PAT_TA_74992.pep
WTPAAGYGTRPNLFEVMKLIMLSYGHHYKVPLYFFLXNLRPVLM

SEQ ID NO: 180575 - protein, 67 aa, Triticum aestivum
  Clone ID: PAT_TA_74993.pep
GGTSVREAMDLVGPHCHTLQVKLSPRGTVSAARPASRCRRLLRLQTTKVPYVRPSVAHINDTRCPRR

SEQ ID NO: 180576 - protein, 58 aa, Triticum aestivum
  unsure (1)..(58): unsure at all Xaa locations
  Clone ID: PAT_TA_74994.pep
ILLVIFRFIFXTNRSVTRIHKSYQIVCTWLHMGHPKQPFAFKGCTNLRYSHFAYGCSI

SEQ ID NO: 180577 - protein, 42 aa, Triticum aestivum
  Clone ID: PAT_TA_74995.pep
TAAKPPSGRVAHHSVRFLNLGEYWTAAKPPSGRVAHHSVGFF

SEQ ID NO: 180578 - protein, 120 aa, Triticum aestivum
  unsure (1)..(120): unsure at all Xaa locations
  Clone ID: PAT_TA_74996.pep
ETFRRMGLTDKNLKQSNTVFHGVVPGKSAYPVGKIKLEVAXGDEYASRAEKLTFEVVKIXGPYHALFGWPAYAKFVARPCYVYLQLKMPGHKGTITVHGNRKIALKCEEGDAAYAESVLQ

SEQ ID NO: 180579 - protein, 94 aa, Triticum aestivum
  Clone ID: PAT_TA_74997.pep
GGSAHAYCAPHTLWACCTDRFRILPHGLHTRKNCRIIKRLYDWVAIQVNSTVIVTCHPSSSPLSARYLMCCTVRQPTGSSLGTIFFITPFDILY

SEQ ID NO: 180580 - protein, 68 aa, Triticum aestivum
  Clone ID: PAT_TA_74998.pep
ERIHLWISRPPSWRRLPSSRPHLLGLGRTLLLYLSFDCVCDFWILCCYSSGCVIGYCWSEFLFVISWC

SEQ ID NO: 180581 - protein, 74 aa, Triticum aestivum
  Clone ID: PAT_TA_74999.pep
GAPGTQLAEIYLWSHSHDIIIYIGIFFLLPLICTCHVVFLGLAFCFAVARARAYYKESIREARTSEWAGLYNIF

SEQ ID NO: 180582 - protein, 47 aa, Triticum aestivum
  Clone ID: PAT_TA_75000.pep
GTTAHPSGTTAGGAEHGTQNAVAVLPPDRSGTTSHQGGTTAYRWNCR

SEQ ID NO: 180583 - protein, 142 aa, Triticum aestivum
  unsure (1)..(142): unsure at all Xaa locations
  Clone ID: PAT_TA_75001.pep
ISAYPLERILRSPNSAXRVAEWNIELQAFQLEFSTTRVIKGGALADFVAEWTDAPTLEEGEDRSTSPGSEPPDGWIMYFDGDFIHQGAGAGAVLILPTQDKLYYVVQLCFXHGEKVSNNIVEYEGIIVRLKAAAALGVKRLT

SEQ ID NO: 180584 - protein, 72 aa, Triticum aestivum
  Clone ID: PAT_TA_75002.pep
VDHGLGWRSQAAAAEESPAPAEEPPALDEDPGWRRGRQDGPAARSTPRRCPGRRPRRGPSLPWCAASDLQPG

SEQ ID NO: 180585 - protein, 128 aa, Triticum aestivum
  unsure (1)..(128): unsure at all Xaa locations
  Clone ID: PAT_TA_75003.pep
STVLVVEXEIDGHKFPLQKPVYYVSTVLTLCKSRYPHYQKISYAVFMASRKLRPYFQECXLVASEVPLNDIINNRNATGQIAKWAIELLPFDITYKPXRAIKSQVLADFVAEWTKAELPKEYGAYSIG

SEQ ID NO: 180586 - protein, 65 aa, Triticum aestivum
  Clone ID: PAT_TA_75004.pep
PYLNRVLFLFSFRVYIASNVARTENKILSKSCYFVSGFHCLDYASTLTRTLFFYHCCRKSFVVQA

SEQ ID NO: 180587 - protein, 83 aa, Triticum aestivum
  Clone ID: PAT_TA_75005.pep
IQKRCLAHMKQVFSVQDYLFGVLVRDTAGTLQDALIIHLWLAMLLARWWSVRHKLLSVHLAPMHFSTGQGPTGTFDAYGALDD

SEQ ID NO: 180588 - protein, 76 aa, Triticum aestivum
  Clone ID: PAT_TA_75006.pep
PKPNWTRGPAPLSSFSSLSFLLPLLLPFLLLVGVGKGSPTPTRRRTPPPGAPYRGRPALPSCSFIYGGRGTSRHTS

SEQ ID NO: 180589 - protein, 33 aa, Triticum aestivum
  Clone ID: PAT_TA_75007.pep
GTWGRVTYLESYFFIIPNQAIHAMTGIASLYTT

SEQ ID NO: 180590 - protein, 100 aa, Triticum aestivum
  unsure (1)..(100): unsure at all Xaa locations
  Clone ID: PAT_TA_75008.pep
MSAARASMAARDARDEEPXGVSEGVAVRPSRLMDGCWDDACCSFPAGPVAAWTAGDGERRGRPPTGAVWATQEARAARRSARARRVSDMNAMVGEEQGDE

SEQ ID NO: 180591 - protein, 123 aa, Triticum aestivum
  Clone ID: PAT_TA_75009.pep
VMASSLSAPMSPEFEVLHFKQRQGENLKDAWYRMMESYCNCTRDVNFRILLCNIYVGVNMSHRQLLDCIAKGNFIEIDPSIVHEIIEGIVGTLPQKGGSHPTHEETQVFGKICEVTKILQKSL

SEQ ID NO: 180592 - protein, 185 aa, Triticum aestivum
  Clone ID: PAT_TA_75010.pep
ALFQIGPLKAPGPDGLPARFFQRNWDLLKVDIVKAVMKFFQTGVMPEGVNDTSIVLIPKVDNPCELKDFRLISLCNVLYKVVSKCLVNRFRPLLGEIISESQSAFVPGRLITDNALLAFECLHFLEHGATPQNSYCAYKVDLSKAYDRVDWKFLEEAMHKMGFAHRWVQWIMSCVTTVRYSIKLM

SEQ ID NO: 180593 - protein, 112 aa, Triticum aestivum
  Clone ID: PAT_TA_75011.pep
INKGLPNRVPLYKGLHERRMRANKAQFYSFLKSYSVLNTFFARSFFKLSSSLLQMNNVLHSSRIQHNGDTGADVQQGPVARILFRLRPCVNLFYCLLLIHIPPVSYHNRGGG

SEQ ID NO: 180594 - protein, 119 aa, Triticum aestivum
  unsure (1)..(119): unsure at all Xaa locations
  Clone ID: PAT_TA_75012.pep
MACAVATVAYRSRRSVRSLRHRRSLAVRRRVTCMAEPTHAEDMRACRALLRNGSKSFFAASLLLPRAVREPACSLYAFCRIAXDLVDDSQADENAVAHLRWRVEQACAGHPHPEPADRT

SEQ ID NO: 180595 - protein, 172 aa, Triticum aestivum
  unsure (1)..(172): unsure at all Xaa locations
  Clone ID: PAT_TA_75013.pep
EPGLQKRFERHRAYEMFQELKLVFQTQAHVERYETSNKYFAYKMEENGSASEHVLRMSGXYNRLNQVGVNLLDKIVIERVLXSXSPSYXNFVMNYNMQXMTKTIPELFAMLKSAKVEIKKEHQVLMVDKTSSIKYPRATTNTSKVHNNLYIRYTLAILLIHQMFGVVPLLVT

SEQ ID NO: 180596 - protein, 64 aa, Triticum aestivum
  Clone ID: PAT_TA_75014.pep
RSGSGWTRQRVRTRQRRSPLAMKAKTMKERRAKTLSRPVKRPASLSLIVPQAMRRVLARPCGRR

SEQ ID NO: 180597 - protein, 113 aa, Triticum aestivum
  Clone ID: PAT_TA_75015.pep
LKDAMTRVDAELWPQAELSQDFESLMTRLNQIPGRVQEWKKSSACCGADIALSLVRVHCKEAKEDKLAALKVVNTKKHSFQTFMDTFLEAATRIVDSIDLDSFCDPASPSPAE

SEQ ID NO: 180598 - protein, 103 aa, Triticum aestivum
  unsure (1)..(103): unsure at all Xaa locations
  Clone ID: PAT_TA_75016.pep
QSDRAGKIPNVMRFQAASLFSRHVTLGPRWDDVGLRLSNGSDRIDRNYYFSRLIYKLPNNIAYLFQQIGVIFLPHVQPYNNRVSXKENYKINDFGLPNVVFPL

SEQ ID NO: 180599 - protein, 123 aa, Triticum aestivum
  Clone ID: PAT_TA_75017.pep
RACALRLSCASSWPCLVASRHWCLCCVYSLWFPRALSWPRLAAGRNCCSRRVGTVVPMFLSTTGARFSGGTPSSSEIPHRLCQRPPPTGCHIQDAARIHNLVSWHDSLVRRRRCAHPLWWLRR

SEQ ID NO: 180600 - protein, 56 aa, Triticum aestivum
  Clone ID: PAT_TA_75018.pep
TPSTVRPGGYYTCTPETRPAKKQRGPSVMDGPRRLLALAVLLASAFGADAAGLFAR

SEQ ID NO: 180601 - protein, 176 aa, Triticum aestivum
  unsure (1)..(176): unsure at all Xaa locations
  Clone ID: PAT_TA_75019.pep
GTYCFVRMPFGLKNAGSTFARVVHVAFEPQIHRNVEAYMDDIVVKSKDKATXIQDLEETFANLRKINLKLNPEKCVFGVPSSKLLGFFVSQRGIEAYPDEIKAIEQIEAPKRVXEVRRLAGCVAXLSRFISXSAECALPFFKILKKAGPMKWTPEAEAALQDLKRYLSSTPILVAP

SEQ ID NO: 180602 - protein, 113 aa, Triticum aestivum
  unsure (1)..(113): unsure at all Xaa locations
  Clone ID: PAT_TA_75020.pep
STDKQAFIVQETRKLEAAGAFREVRYPEWLANPVMVLKKGGKEXMCVRFTNLNKACPQDPFPLPRTDQIIDSTAECDLXCFLDAFSEYHQIKMAMEASVFLPSCRPKAMCISR

SEQ ID NO: 180603 - protein, 147 aa, Triticum aestivum
  unsure (1)..(147): unsure at all Xaa locations
  Clone ID: PAT_TA_75021.pep
MSPVNADLRAGDPEVRPAFGRCVMSLNSGMVALDDQXGGKVLMVTINGDRPPVSPDDLVKALGIAHGIQISDLLVEVCSPPADFFVRFRTTFDCSRVFESSPRLFCDGALVSFXRWHPGWGSVPSELEFLTKLTFHGMPRRDLEQRV

SEQ ID NO: 180604 - protein, 105 aa, Triticum aestivum
  Clone ID: PAT_TA_75022.pep
KGPVSLCVLANTYVSYCLCQQTLKHKGPIIAPTPSVINSPFDRVPEKASRWDRGKTKACGAKKVFWVALCWFGNMCEFIGLKIGQPELRGAHKLRGRAYPLERAL

SEQ ID NO: 180605 - protein, 69 aa, Triticum aestivum
  Clone ID: PAT_TA_75023.pep
IFVFQLVFVYICVCLTCFFTNVPIMWVVTVSLKHITYVDAYNTYIHPCGIHAHNLVLVGDGHTIPHHST

SEQ ID NO: 180606 - protein, 148 aa, Triticum aestivum
  unsure (1)..(148): unsure at all Xaa locations
  Clone ID: PAT_TA_75024.pep
NSQIPSPPHTDPTKTASIGAQFNPAVNAALREFLHDNRDIFAWHPSDMPGIPHRLAEHSLDILKGFPPVKKTLRRFSEPKRQAMGEELAXLLEAGFIREIKHPDWLANLVMIPKKDKSWRLCVDFQDLNKACPKDPSPLPRIDQIINA

SEQ ID NO: 180607 - protein, 73 aa, Triticum aestivum
  Clone ID: PAT_TA_75025.pep
LFVCLVPGDEHPEQQVRRVNPGRSTSKRYRTSESAGGSSSAPPPPVGASSSANPQRQKKLANRPKPRAKTVTE

SEQ ID NO: 180608 - protein, 96 aa, Triticum aestivum
  unsure (1)..(96): unsure at all Xaa locations
  Clone ID: PAT_TA_75026.pep
MEVFVRNFTSTYKRPPKPRXLSLCVQGXSESTRDYVTRXAELRNSCEGVHEVQAIEYFTAGCREGTLLKHQLLCDEPATLDELLVIADKYATAAPR

SEQ ID NO: 180609 - protein, 85 aa, Triticum aestivum
  Clone ID: PAT_TA_75027.pep
CGMMGWYPPLNELSDSTWHMFTHVVESNQHSLHDIYVHGRLYPTHACTRCELILMHVYDCCRSLSWSLPSLLLAFTCTKREYCLC

SEQ ID NO: 180610 - protein, 58 aa, Triticum aestivum
  Clone ID: PAT_TA_75028.pep
MAQDNTKLCDFSNTNNNDFISTPIAPITDAETCEINAALLNLVMKDKFSGLPSEDAAT

SEQ ID NO: 180611 - protein, 54 aa, Triticum aestivum
  Clone ID: PAT_TA_75029.pep
YISSSSQVMQVHSCLFYIAPIYLHFDDYLFCQQPSKKGEIVGAMKGPLCLEVCR

SEQ ID NO: 180612 - protein, 101 aa, Triticum aestivum
  unsure (1)..(101): unsure at all Xaa locations
  Clone ID: PAT_TA_75030.pep
ESALIKFIRENRDIFAWKPSNMPGVPRELAEHNLNIDPXFKPVKKFLRRFNEERRKAIGEEVARLLAAGFIIEVFHTEWLAYPVLVLKKNGTWRMCVDYTG

SEQ ID NO: 180613 - protein, 56 aa, Triticum aestivum
  Clone ID: PAT_TA_75031.pep
FIFLVKAIYSRIDFNNPYPASSSSTRQRRPALLEGPCMVNRRDLLGSNILRRERIG

SEQ ID NO: 180614 - protein, 95 aa, Triticum aestivum
  unsure (1)..(95): unsure at all Xaa locations
  Clone ID: PAT_TA_75032.pep
NRLHKIDRTIQRINCFNKSSYKVDXIGKMKRTPMGFESCVSLEVVARHTGLESCPSGGLGVALLARLRTLARVLTWGVLSFVLFVREVDEELRVT

SEQ ID NO: 180615 - protein, 51 aa, Triticum aestivum
  Clone ID: PAT_TA_75033.pep
VMMVFSACIRDSSSRAVTEEAWGSRDAHVPSIAMHQHEAAGCWGARHSALA

SEQ ID NO: 180616 - protein, 84 aa, Triticum aestivum
  Clone ID: PAT_TA_75034.pep
KCFFGKNHEQTMRGLQFKFNPLPAKPVEICLFHERWMKTFDIQPFGKLCIKYGLIFYKIDLVQFCNNYLVGSSQKKHFCHSKND

SEQ ID NO: 180617 - protein, 63 aa, Triticum aestivum
  unsure (1)..(63): unsure at all Xaa locations
  Clone ID: PAT_TA_75035.pep
FEEGDLVLWRVQWAKNSNKLTPKWEGPYQVIRVTRSGAVRLETEDAIPVSNSXNIEHLCKFYL

SEQ ID NO: 180618 - protein, 53 aa, Triticum aestivum
  unsure (1)..(53): unsure at all Xaa locations
  Clone ID: PAT_TA_75036.pep
DAKIKTVQTDXWGGEYRRLSRYFQKEGIAHRVSCPHTSQQNGIAERKIVNRRD

SEQ ID NO: 180619 - protein, 111 aa, Triticum aestivum
  unsure (1)..(111): unsure at all Xaa locations
  Clone ID: PAT_TA_75037.pep
KTVEAYVDDVVIKTRHVESLIDDLRLTFDNLRTYDIKLNPEKCXFGMPAGKLLGFIXSNRGIEANPAKIRGSVXQWAIPTDFKQIQKLTGCVAALSRFISLLGEKTLPLSL

SEQ ID NO: 180620 - protein, 106 aa, Triticum aestivum
  Clone ID: PAT_TA_75038.pep
PPNLSCMRTQARCISWLLPSGLSHSFLHTAGHTRSISLSLSESHLTSFSFTHKCYISLFGPRSTYSILSHADCLSRSVCRHHHSFDLMVGHAHSISLSLSVSVCLD

SEQ ID NO: 180621 - protein, 59 aa, Triticum aestivum
  unsure (1)..(59): unsure at all Xaa locations
  Clone ID: PAT_TA_75039.pep
GCLEHVVILYPFMPPVAIMECSSMNCSCSTCAIKCSWQNXNKLINIAMVFASDPCILFS

SEQ ID NO: 180622 - protein, 53 aa, Triticum aestivum
  Clone ID: PAT_TA_75040.pep
LPHEVFALTWHADVGNIMHIVPCSAYCIHQRCHLLSLDMLCVNAICLVSLSYI

SEQ ID NO: 180623 - protein, 130 aa, Triticum aestivum
  unsure (1)..(130): unsure at all Xaa locations
  Clone ID: PAT_TA_75041.pep
TKKAERIYCXAPLPEDLAGPLLTKMLVQAPYKAPKKKAKKEAKETRGGLRRKGTLDVMSKDAEAHSSAKDDEEEEEDEERHSPLQGGRKKRTTSMRLEAKASKKGKASLPDDSTAVTDSSSEWTPRVKPW

SEQ ID NO: 180624 - protein, 46 aa, Triticum aestivum
  Clone ID: PAT_TA_75042.pep
VHFLSCHYEFPVWGVVGCGSYPPLCCFLLLRCRVMLTVDCGSASCI

SEQ ID NO: 180625 - protein, 82 aa, Triticum aestivum
  Clone ID: PAT_TA_75043.pep
LNTSMLYDNRKSRSHSLFLLFSAVAFFHIDCYRGVHPQPMYAQRTGSRNSQPFAPRLRKRFYSLSLPNVISFFDQKDRSLFI

SEQ ID NO: 180626 - protein, 78 aa, Triticum aestivum
  Clone ID: PAT_TA_75044.pep
SRTYKIDLHGSRGRALTRDNCYLFGRDKPSHARADNHIRTPSELRRDAAQYRGAAHPLCFPDKVMDHEFPEAFKSFPY

SEQ ID NO: 180627 - protein, 113 aa, Triticum aestivum
  Clone ID: PAT_TA_75045.pep
RHLSLMLHRTQILINLLLYCLSGNRGARIITYPFLPPRFSHLSSVLPGFINETSGSPLIPPSFLPIFFFLLPTRRPSQALPPSTSAFVFNSCRCITLNGPENHGTSPPSYQHR

SEQ ID NO: 180628 - protein, 95 aa, Triticum aestivum
  Clone ID: PAT_TA_75046.pep
ATGRGKKVITNRWIHKHQDFLTSHKIRLKTIMIERYVANRANTRCVTFFLLNARLLLSIRLKFISSMVLTDGYVEEQKKEFQVGKRASERAGLLR

SEQ ID NO: 180629 - protein, 46 aa, Triticum aestivum
  unsure (1)..(46): unsure at all Xaa locations
  Clone ID: PAT_TA_75047.pep
GTQSQIMVSGHPLLARFKCQPXQPQCTKDISAFQILGYYKYNIKYY

SEQ ID NO: 180630 - protein, 98 aa, Triticum aestivum
  unsure (1)..(98): unsure at all Xaa locations
  Clone ID: PAT_TA_75048.pep
LLQPLVFLLQPPKPALSCRMLLPPVAGCAAAEASPPPTIPTASQALRRDAASHAGFHCRVVPFLGLTVVHRHGALRTAWSAWXRNDFHRKSTVRGEAD

SEQ ID NO: 180631 - protein, 123 aa, Triticum aestivum
  unsure (1)..(123): unsure at all Xaa locations
  Clone ID: PAT_TA_75049.pep
NGXEIKVGIMVQEIAEDARERMPEEAPAPLLKKLPSLRSLILQAGHNISEEVKMASIVTLVRVRSALIIDSTQGMVSSXTRKPWRMEPCSRSSVKWWIFSFEAFFRREAVSLARFWREDMSHP

SEQ ID NO: 180632 - protein, 138 aa, Triticum aestivum
  unsure (1)..(138): unsure at all Xaa locations
  Clone ID: PAT_TA_75050.pep
GEGKDGGAGTHEEGDGGGERQEDESGIFVTLGAAVRLDPGRDPISASAGRLDELAESGLIVHIAARLPEGETEPQPRPGECVLLATHVDRGSSLPSAXFFQGFLNFFGAQLHHFSPNTITYLAAFVSMCENFLGCRTH

SEQ ID NO: 180633 - protein, 57 aa, Triticum aestivum
  Clone ID: PAT_TA_75051.pep
CRHGAAGTLCELLLVKLGIAGGPCWPPAIHACSPSIKVGIMAVIVGPRLVSHLLLDY

SEQ ID NO: 180634 - protein, 70 aa, Triticum aestivum
  Clone ID: PAT_TA_75052.pep
HSRTSGRHHRKGFKRNATVGRRGDITERALKEMPQSDVGATSQKGIYSQVNNTHKNIQFMIINRLVHPQE

SEQ ID NO: 180635 - protein, 57 aa, Triticum aestivum
  Clone ID: PAT_TA_75053.pep
DTSNLSHIIQQSQEIVHHFWARFLLVMSKVKDYREEDAISLFCKNCTDKGMLNAISR

SEQ ID NO: 180636 - protein, 53 aa, Triticum aestivum
  Clone ID: PAT_TA_75054.pep
QSSIKMLFFVSLRLIGEELYLLQNHYLNWCEYHTWTDGAGGRRSGASQDVGKS

SEQ ID NO: 180637 - protein, 91 aa, Triticum aestivum
  Clone ID: PAT_TA_75055.pep
RKEDAAAVPPSVEKRGDNTRTSPARSPSRGQEEQRQEESAPVAPQALEVPAPGSADEVPKAPEPLIFPGSSNNVASSSCSAFGPQVLLLPQ

SEQ ID NO: 180638 - protein, 60 aa, Triticum aestivum
  Clone ID: PAT_TA_75056.pep
EREREEESNPEDTNYAYHEHMALASRKFSSKKNTRPNFKQNNSSGTKVKQRVRTCYIVAM

SEQ ID NO: 180639 - protein, 123 aa, Triticum aestivum
  unsure (1)..(123): unsure at all Xaa locations
  Clone ID: PAT_TA_75057.pep
PFLPRPSLLLPPSFLCFLPPPSFLHSLXPHRRRRRPPRSPPPSPSSHIDAAISIPPISPPPEEGEDLHFFQMFGYSINFVFKCWHVVVLKVHDDDVVVHDDVXIYDVILQKNIKLAYFVNLET

SEQ ID NO: 180640 - protein, 75 aa, Triticum aestivum
  unsure (1)..(75): unsure at all Xaa locations
  Clone ID: PAT_TA_75058.pep
ALFIVXMAGNGNVRERPASPDHWITDQEHKHRYSSKPRISMNGECTLNLYHLRLVNKEKRFKSHLYYMALFIVET

SEQ ID NO: 180641 - protein, 84 aa, Triticum aestivum
  unsure (1)..(84): unsure at all Xaa locations
  Clone ID: PAT_TA_75059.pep
HLLNRLGLFVSRWLLFMLTNETSMAGARSSCSCAXRSANGRIPRSSSGCTMNDEQDLXSHVFVPLFFYPWWGLHEREPVLLPWR

SEQ ID NO: 180642 - protein, 119 aa, Triticum aestivum
  unsure (1)..(119): unsure at all Xaa locations
  Clone ID: PAT_TA_75060.pep
IDDVPLPDPVRTGLAEFSNAPPKARXSLRPQGPQEEDTREVHFLMSRIKILAKLGLTIVEVMAICIMQECNRCNIGGSPCGITTGKTMPPTVVKVRTPPLLPAGYCPISTKGKKKNSFI

SEQ ID NO: 180643 - protein, 67 aa, Triticum aestivum
  Clone ID: PAT_TA_75061.pep
DPVTFVDDIPVTTDGRELRLLVRLIQRAGKWFSSSLALGTNVVADITDMVLSDMPCYHDRVRCHCSC

SEQ ID NO: 180644 - protein, 102 aa, Triticum aestivum
  Clone ID: PAT_TA_75062.pep
QPCHPGPPCSSSRRSCDARDDGASFAISRTRRMRTHHRHQPSGLRLEVSFGSDEGRWDGRRKGRRLRSWVLDRSMEAFLLPIGSRVRLFLRDRNSPCRGVQV

SEQ ID NO: 180645 - protein, 182 aa, Triticum aestivum
  unsure (1)..(182): unsure at all Xaa locations
  Clone ID: PAT_TA_75063.pep
RVNHSKSSIFFSKGVPDSTRLEIKTLLNVPNETLNEKYLHAIFFLRHTYMPYDISNSKNGAFKYLKVCLWSKLQGTTGKEVLVKAVAHAISXYSMXCFKLPRWLCEHLNMLIRKLWWGSKDGKRKXHWVPWETMTKPKGMEGLGFKDFELFNLAMLERXLXQILQDPESLSARILKSIYFPP

SEQ ID NO: 180646 - protein, 88 aa, Triticum aestivum
  unsure (1)..(88): unsure at all Xaa locations
  Clone ID: PAT_TA_75064.pep
HLPPNHRPLHQISVGLSHXVTHYSQDLKEHLAAEKKIAAARADEVAMAAIRADPQILEEHLTVEATVDASHADAATWLVALNDSSCRX

SEQ ID NO: 180647 - protein, 48 aa, Triticum aestivum
  Clone ID: PAT_TA_75065.pep
WKGKRDYQIKQNNGEENGDYTQLLGVYTSHGTAEHGIQGRRASTQPFR

SEQ ID NO: 180648 - protein, 87 aa, Triticum aestivum
  unsure (1)..(87): unsure at all Xaa locations
  Clone ID: PAT_TA_75066.pep
SQGGWQPMKDIIFTLNEQINFLQSKIYDLQNQVFEYEVRFKGMSLAADCRTRETYSSSYDGGPLPWKPEDKISSSSPPPSSXSPKEN

SEQ ID NO: 180649 - protein, 69 aa, Triticum aestivum
  unsure (1)..(69): unsure at all Xaa locations
  Clone ID: PAT_TA_75067.pep
PTGGFTVLKCNKSSDHADRKTSVMPNTLGLWVFWAXSSQGFLSLKGFGGGLLSNDKSRVLTLSSNQFMV

SEQ ID NO: 180650 - protein, 151 aa, Triticum aestivum
  Clone ID: PAT_TA_75068.pep
EMLVEYLRALEAAFDCMVDDLVAAHMDSVHGCAANRRELLHTAPPLTFLSSTTSHSPTILATARRLPTTEEFNQDIAPTPVRSTPLVVPTPIHAALPIRPTRIRIIPPTAPAPLAQHNVSSLEPISEEEVDSLASLRLTLGRPREILTVSD

SEQ ID NO: 180651 - protein, 117 aa, Triticum aestivum
  Clone ID: PAT_TA_75069.pep
REPREQGEEEDERIQCHVGTVLSWACDGERRRGSGRRGRGVQGNDDDERKTLDMLTRAKPTGGREAEAQMTPWTRPLRTERVHKHANCAVTTRQCTGRSRGNCKPRLVASPSRVEHL

SEQ ID NO: 180652 - protein, 102 aa, Triticum aestivum
  Clone ID: PAT_TA_75070.pep
DSGGARHLRERNQSNSLDIFILGDMLNPMWYLVLTLYMSSQSWYSCGFFCLLWLVNVPVLSNLVCAGSFHPKPTQDHKVSICIKIMSMRSSCLCTYCCKKDS

SEQ ID NO: 180653 - protein, 42 aa, Triticum aestivum
  Clone ID: PAT_TA_75071.pep
IFTCNDSFPGLILNQPVLLWFRLPPSPCRLRQPLHATGLSPS

SEQ ID NO: 180654 - protein, 79 aa, Triticum aestivum
  unsure (1)..(79): unsure at all Xaa locations
  Clone ID: PAT_TA_75072.pep
AQDLVNDPSVAVGSTLEPISNLNLGSDLPMGLVPSEESATIMPGKDLDIESGPDPNLSSNMDXTSSTDPISPTVGLESN

SEQ ID NO: 180655 - protein, 75 aa, Triticum aestivum
  unsure (1)..(75): unsure at all Xaa locations
  Clone ID: PAT_TA_75073.pep
GGRTTSQIPPDLISLRKLFTSFQIIQEISFSSSIFFAQIRTSXTTSIWCDHVMAMKETSNFLKYWQYLFLLGAGY

SEQ ID NO: 180656 - protein, 64 aa, Triticum aestivum
  unsure (1)..(64): unsure at all Xaa locations
  Clone ID: PAT_TA_75074.pep
LPQCSASTVLLFVKPNDDIEDTAGTLIYKPNAPRTIXIPKGVPKAHAATATSALTIPRSANSDS

SEQ ID NO: 180657 - protein, 34 aa, Triticum aestivum
  Clone ID: PAT_TA_75075.pep
LLALMRYMWLRSFSRTQRKIGAYNFSPQPFTSRV

SEQ ID NO: 180658 - protein, 60 aa, Triticum aestivum
  Clone ID: PAT_TA_75076.pep
NEKGRVKIDRDSSIRYRIIQDMPFVERSRGCHARLGLMHKILMQKNVTLYCPLHVNLYYA

SEQ ID NO: 180659 - protein, 73 aa, Triticum aestivum
  unsure (1)..(73): unsure at all Xaa locations
  Clone ID: PAT_TA_75077.pep
LSVFMNIIIIFFNITRXMFITRLSFSIKNRNIIIIFRRFFYXRFTRGMQSPIIFFFFLLEGLGASVLIRYESF

SEQ ID NO: 180660 - protein, 107 aa, Triticum aestivum
  Clone ID: PAT_TA_75078.pep
KLGNFFVRNWLNGMSSNLVEGSYCGTPAQSNRFTLHCRPKDRVFWQYTTTWYRNNLFIDTSGIHSSDITSTCEDKRHTRCCWTVCTLFNEHGWGLDHTKLHDSGRTT

SEQ ID NO: 180661 - protein, 77 aa, Triticum aestivum
  unsure (1)..(77): unsure at all Xaa locations
  Clone ID: PAT_TA_75079.pep
LGETNSSTSXISQDWVKAVVIRRSNAIKLLILFYPEVSPSYVKNAMGIAPSLMNSXRSDTSRHHYLLLDFVVSQPEC

SEQ ID NO: 180662 - protein, 133 aa, Triticum aestivum
  Clone ID: PAT_TA_75080.pep
PSPCQRTHAAPSLWPGMRRTCSLPPTCRTAVPSGTGRNHPCRAKLDAGMAPVLRLDDAQTSNPTVQPQRHRNRSPDLSVHGNRLGPAINSASELALAPAQLHHLTRPRLASGRASKGPSSSTPTTFVRLGLRA

SEQ ID NO: 180663 - protein, 137 aa, Triticum aestivum
  unsure (1)..(137): unsure at all Xaa locations
  Clone ID: PAT_TA_75081.pep
RSTGLQFKIFKLHLLQVWTRFIKFGEIHSKPSPKIPSKIRQPLGALSGHLTKLQLQKNSSHCXILLSNTCSALSVSXSEKFREHCSGLLSFSSEKDVDLAXATASPCSSSPPSCSCTARTPGALRALKTSSRRCAAP

SEQ ID NO: 180664 - protein, 86 aa, Triticum aestivum
  Clone ID: PAT_TA_75082.pep
EIEELLEHDRMAGEQELLERDRLAEEQRIADLRRQQDMEQQRTDALSRKQSALQLGRQRGGRRLAISPRGCRARTRSRRLVLLPAR

SEQ ID NO: 180665 - protein, 40 aa, Triticum aestivum
  Clone ID: PAT_TA_75083.pep
ILIGGPGPLMTGGARVAYDNWDRPKAWSSLSLSLCLSLNF

SEQ ID NO: 180666 - protein, 164 aa, Triticum aestivum
  Clone ID: PAT_TA_75084.pep
FNYSKEALHLCMDVYMHSSWQGLFLSLTCRYKHKHYRTQRWIGEITLFELKFGVLPTNLRLKKYNPLFVFPPSSTTAEGGKDEKRSTQAGAHTGLVRARRARPDKTGSGEAAEEEHGGRHDPFWSPPPEPARSLDLSASGVIHQSSAGRLLEVRRRHQENTPPR

SEQ ID NO: 180667 - protein, 60 aa, Triticum aestivum
  unsure (1)..(60): unsure at all Xaa locations
  Clone ID: PAT_TA_75085.pep
DIWTQNRCKFLGRPXKLALSVANTQQPRGYHNFFRPEGPGRTXREHMSYTILCQKQYFNT

SEQ ID NO: 180668 - protein, 67 aa, Triticum aestivum
  Clone ID: PAT_TA_75086.pep
DSHSLINCNYYTYKLLNNEVNALKLLQGCSALDLCNYVCTTLLTFMVIGESYRCSLENDGSFADDNR

SEQ ID NO: 180669 - protein, 100 aa, Triticum aestivum
  Clone ID: PAT_TA_75087.pep
LIETARSLKKQKQSIKSMQNMLNSRWNKLLDTEENYGGNRRTKSYPKRKLLSEFGDEALELTQPKNKTADQPDRPPRGRDRATNYDVHKSAHDLHEDHRF

SEQ ID NO: 180670 - protein, 156 aa, Triticum aestivum
  unsure (1)..(156): unsure at all Xaa locations
  Clone ID: PAT_TA_75088.pep
AGRLGRGSYSYAPQCSNLSRVCGTLNLTXGAPGRGASKLLFHRLTRRRPATPWLTLVEPVLSAEPLSPLTSPKQRQSAGLPVVLHHPPPMPXPARQGTSKQALLLHPSVWRERRNRHPVADPRPARHPMLITARRTHMLRCSWCVSSCATPSRWPA

SEQ ID NO: 180671 - protein, 110 aa, Triticum aestivum
  Clone ID: PAT_TA_75089.pep
SASMLQQRSSSLCCKERGLGRYSSWMCDGSPPPSPSSLRRKPGGLRGPLTIRTSAVGSLLSHSDAVSMEPVEQAIESIVGLDCRDLWGGRLASHRVPHPPLEPRPTGTLS

SEQ ID NO: 180672 - protein, 137 aa, Triticum aestivum
  unsure (1)..(137): unsure at all Xaa locations
  Clone ID: PAT_TA_75090.pep
RCAEQGQGIDILLDIHQGKCRHHAAPRSLVAKAFRHGFYWPTALQDTESLILKCEGCRRFSKRSHQLASALHTIPIAWPFMVXGLDMVGPFKTARGGMTHLLVAVDKFTKWIEARPIKKLDGPTTIQRAGRAGQCLT

SEQ ID NO: 180673 - protein, 107 aa, Triticum aestivum
  unsure (1)..(107): unsure at all Xaa locations
  Clone ID: PAT_TA_75091.pep
ELYGLKQAPRAWYEHLTELLQDRGFEIGKINPTLCTKKVEGELFVCQLYVDYXIFGSPNKAFNEEFAALITTRNMSTCDLHYWPLKGQCFSFATFFDRKQKVKSWRS

SEQ ID NO: 180674 - protein, 170 aa, Triticum aestivum
  Clone ID: PAT_TA_75092.pep
GGQCVPLGVRPSSHRDLVDDKNRIANGSKFDTLLELKIWLDNYSVTHYRSHKVVNSDVNVRYMVACACEDEICPWIVRARPWKGGPTCHVVSCVPTHLCQGKMVDGKIVSQDHKQLTSEFIAYRLSNSISTLPTMSVQHVIDLVKAIFHYKVKYGKAWKAKQAAFKMLYG

SEQ ID NO: 180675 - protein, 86 aa, Triticum aestivum
  Clone ID: PAT_TA_75093.pep
RWHRDKDNQQERPARGRDKKEEDDGHDEDDKSGEHDFQKATEAMCVNGGASLHTSHRQLKQWAREVTAAEPSFGTQRPLKWSGTPI

SEQ ID NO: 180676 - protein, 110 aa, Triticum aestivum
  unsure (1)..(110): unsure at all Xaa locations
  Clone ID: PAT_TA_75094.pep
PSSFFFFLLHSAYWLAADEVNSSSIXSTSISPDGRRDISKLIWSCPAPPKVLSFAWRAATNSLANWLNKKRRPLKVFSTCPVCGREEEDSFHVLCXCDNAQRQWKAMSKI

SEQ ID NO: 180677 - protein, 115 aa, Triticum aestivum
  Clone ID: PAT_TA_75095.pep
EGSSTEKLFWSQYVGAEHAKPLSDQLKQLVELHRAAEVAMKDLIVRIWPGELLPTSYFGLIKRMVDSCPRLEVIKRSVCIEGARRALTLAKVHWGKMDAEKLVKDGPPEGKPHRV

SEQ ID NO: 180678 - protein, 91 aa, Triticum aestivum
  unsure (1)..(91): unsure at all Xaa locations
  Clone ID: PAT_TA_75096.pep
LSKVLNITHFQSINHTTINQIYLFIITFQNLEFWDVTPSGEPIPKGKIGSGEANGKTKVVPCWRSSIQSEPXRGPHNTQPGKERKIQEHNA

SEQ ID NO: 180679 - protein, 74 aa, Triticum aestivum
  Clone ID: PAT_TA_75097.pep
LVQLQNSHTPVGDRTRNMINRKSTNLDISLQSSSGVEGHLTGLMHHFHLPHHKVQLKKSFLGGRRWVVRGFDKQ

SEQ ID NO: 180680 - protein, 126 aa, Triticum aestivum
  Clone ID: PAT_TA_75098.pep
MRDDRHARYTKSKSGRAEHCWQDSFELRRNIAQNRGVAQHLNPTDEVMDHQIPEGFKPVSIESYDGTTDPAVWIEDFLLHIHMARGDDLHAIEYLTLELKGPARHWLNSLPAESIGCWEDLEAAFL

SEQ ID NO: 180681 - protein, 113 aa, Triticum aestivum
  unsure (1)..(113): unsure at all Xaa locations
  Clone ID: PAT_TA_75099.pep
RSVDELHLQCLHQYFVLVYLDNILVFSKTXEDHAKHLRLVXLDXLREHKFYAKFSKCEFWLDEVLYLGHIISAKGIAVNPEKVSAIVNWEPPQNMKQLRSFLGLASYCRRFVE

SEQ ID NO: 180682 - protein, 68 aa, Triticum aestivum
  Clone ID: PAT_TA_75100.pep
RGRLEHTTCIVSHVWRPPPQFTPLITFSRCLGEALRGSHHHHRHHAVVLTKLIYYLDTLWIKKVRDVT

SEQ ID NO: 180683 - protein, 56 aa, Triticum aestivum
  Clone ID: PAT_TA_75101.pep
VGVIYDRMPPRSASRTGSLCFPPMWAKHILSPPVSHPSYLLSRLGSSPPRQAGLLA

SEQ ID NO: 180684 - protein, 119 aa, Triticum aestivum
  Clone ID: PAT_TA_75102.pep
ILRLQRILHERVAGNTVATLHSICILICMSCTSQILKETTTRARTGFSGSEDIGLSNGSSTGLSHLNMLKRMPSSAHGVTVYTAPWCQRARLKPLSKNYILAWSEDHSLKMPTHLLCYG

SEQ ID NO: 180685 - protein, 199 aa, Triticum aestivum
  unsure (1)..(199): unsure at all Xaa locations
  Clone ID: PAT_TA_75103.pep
LLQALSTEMSDHFPLLLSCDADFNPFXRFRFENHWVHLEGFPXTILESWQQIPNCNXACSRLHMKLISTGRALRXWNSCMIGDLQXRAAVSGELIFMLDQAMDKRMLSDNERQFRVVLKVNYLGIAALQHSMCRXRSKITXIREGDASSRFFQGKATTRRRKSFIHRLTIDGVLVTIPVGQEHAMFDFFSQLLLHHLRF

SEQ ID NO: 180686 - protein, 73 aa, Triticum aestivum
  Clone ID: PAT_TA_75104.pep
ENVVKNITPQPGSLLLPLPPPAHVRGKRPVNPYIGVLAQKDACMTTKSRLKRRSGGSMAYVVTLGSHGPTEGN

SEQ ID NO: 180687 - protein, 43 aa, Triticum aestivum
  Clone ID: PAT_TA_75105.pep
LGIQLRTFDHRSYSSFKNKWGYHFYIKCCCVHTIRVALAQFLE

SEQ ID NO: 180688 - protein, 130 aa, Triticum aestivum
  unsure (1)..(130): unsure at all Xaa locations
  Clone ID: PAT_TA_75106.pep
MRWATVFPSPRLPCVQARQPTPAVPSGDNTRNPSMSQFDNISVVKKANVYFDGKCVSHSIQFADGTKKSXGVILPATLTFNTGAPEIMEGVAGSCRVRLKGETEWKTYGAGESXNVPGNSSFDIEVSGEP

SEQ ID NO: 180689 - protein, 122 aa, Triticum aestivum
  unsure (1)..(122): unsure at all Xaa locations
  Clone ID: PAT_TA_75107.pep
LDLASVAHPKSNDQVERANILILSGIKPRLVEPLERSAGYWLDELPTVVWSLRTTPNKSTGFMPFFLVYGAEAVIPTDIEFDSPRVTMYTEAEAKEEXVDLLEEGRLLALSRSAIYQQSLRR

SEQ ID NO: 180690 - protein, 146 aa, Triticum aestivum
  unsure (1)..(146): unsure at all Xaa locations
  Clone ID: PAT_TA_75108.pep
FKDGTVANGALAVGQTLXLGGFLMTACSAAAPTMTSRVIESNLHVNLEFAEQLDPMELSSLNELLDRIAAMGVATDYDQIGPKPGLREINSPQVTHHVAVVEGQCGDPLSILRLARRLTLSSGLSDVLPSAGIWLGGIGNPESYLQ

SEQ ID NO: 180691 - protein, 70 aa, Triticum aestivum
  Clone ID: PAT_TA_75109.pep
STGGAVGTDMSSPHCPRLVIHGASSSHILSGRPHRLPFAIKGKGPHHAGMSRIAAYKSPLFRSPYRSLLI

SEQ ID NO: 180692 - protein, 56 aa, Triticum aestivum
  Clone ID: PAT_TA_75110.pep
VGLTPLSSMFQTSSTRDMLTLITKTTKGALVLSISPFLVIDYNIHQSFRTNSEGRD

SEQ ID NO: 180693 - protein, 147 aa, Triticum aestivum
  unsure (1)..(147): unsure at all Xaa locations
  Clone ID: PAT_TA_75111.pep
AXRGAGWSVTGMIVTRXRIALSTWWTMFPHVLXLHDAXRCASVTMSAVGLNPFDHPVDFNELRLPDMVSFFTXISEELSRIRVMVGAELDKEGLQAAVSIAGRILSGLGHRNPVVPLDAVLTELALVDRERALRAVAPYITEVPLLL

SEQ ID NO: 180694 - protein, 70 aa, Triticum aestivum
  Clone ID: PAT_TA_75112.pep
HKVKARSFEEGDLVLQCVQSAKNSNKLTPKWEGPYRVRRVTRPGAVRLETEDGIPVSNSWNIEHLRKFFP

SEQ ID NO: 180695 - protein, 71 aa, Triticum aestivum
  unsure (1)..(71): unsure at all Xaa locations
  Clone ID: PAT_TA_75113.pep
HRRTRQLSHTLFYGATFMMHTSSETVHGCESCMIRQLTQTFSLLAPFVILXDIAHALHTATVCMLAHVSSL

SEQ ID NO: 180696 - protein, 106 aa, Triticum aestivum
  unsure (1)..(106): unsure at all Xaa locations
  Clone ID: PAT_TA_75114.pep
YVEDKIYALSTFPXIKGERDLEPWFEVLDLSTARVVDGRLQGCSWEELPSPPCFPSPSRLAPHELRYPPMVTVHSYVLVGSYLLISLKSATRHAPMRSTLSRPKWQ

SEQ ID NO: 180697 - protein, 128 aa, Triticum aestivum
  Clone ID: PAT_TA_75115.pep
MRNRKMREEQAMNKVKDVAELYVLADRCARAEEGRKYPGEDGGAETDSTDEDAAVPAKKGRRRNRKRKGKTVLAVEVSGDPVAAKKAKADDLGKEVAGCAACRALAAANKPGASDKQYCKIHRTQGHD

SEQ ID NO: 180698 - protein, 199 aa, Triticum aestivum
  unsure (1)..(199): unsure at all Xaa locations
  Clone ID: PAT_TA_75116.pep
RSFSFDVISRACFGDXHSRGREIFLRLRALSGFMSEPSVIFTIPSLRYLPTAKNRRIWRLTQEIRSLILEIARGRRAAMGDSPGPDFLGSIIDXSGDQPRPDDFVVDNCKNIYFAGHETTAVTATWCLMLLAAHPEWQDRARAEVLDVCGGAAGAADPDFDVISRMKTVGMVVQETLRLFPPSSFVVRETFRDIRLGQL

SEQ ID NO: 180699 - protein, 78 aa, Triticum aestivum
  Clone ID: PAT_TA_75117.pep
PEDDILRYPPFYLSVSSLPPAPLVPSHSPPTPVFSIILLHLSPILSSPSPSLPFPLHYTRRSRTEDVPSDETSSLSLS

SEQ ID NO: 180700 - protein, 46 aa, Triticum aestivum
  Clone ID: PAT_TA_75118.pep
GMLLARDSIVGISIPSSISLSASLFTRSIIHHLTTNSLVAMLARLY

SEQ ID NO: 180701 - protein, 162 aa, Triticum aestivum
  Clone ID: PAT_TA_75119.pep
KFKPVKQFLRRFNEERRKAIGEEVARLLAAGFIMEVFHPEWLANPVLVLKKNGTWRMCVDYTDLNKSCPADPFALPCIDQIIDATAGCERLSFLDAYSGYHQIKMAVKDQEKTAFITPFGAFCYVSMPFGLKSAQATYQRCVQNFLHTQIGRNVHAYFDDIV

SEQ ID NO: 180702 - protein, 81 aa, Triticum aestivum
  unsure (1)..(81): unsure at all Xaa locations
  Clone ID: PAT_TA_75120.pep
LVTPQPTAPTENIEYEIPXGMIEQLLANPYAGYGTEHPDMHLIYVDEICGLFKLAGLSGDETRKKVFPXSLKGKALAWYRL

SEQ ID NO: 180703 - protein, 118 aa, Triticum aestivum
  Clone ID: PAT_TA_75121.pep
PQAGGRSHPCREGEGRRVAAHRRGAEAEVHRPRQLRRGGLSSSTLSSSAASSSILVYRFRPRRLETPHPLTSAEPAFSVDSTTGTKEWGLKVPHPLVPVRHESALKCHHVAQARPGCV

SEQ ID NO: 180704 - protein, 131 aa, Triticum aestivum
  Clone ID: PAT_TA_75122.pep
LQKTRPSTFAHTDRPLEADDWLRDIERKLIIAQCSDNEKVLYAPHYLTGAAAAWCENFLHMHPSEHNITWEEFKEGFRGAHIPRSIIKIKKREFDDLKQRGILVPVPGRPGIFPSSCSLSCARRGHNEIAG

SEQ ID NO: 180705 - protein, 95 aa, Triticum aestivum
  Clone ID: PAT_TA_75123.pep
GLTTRSSPLTFHGRALNSGPLHPVVSGQLRGTPGSNIQAKPTATSPPCRPDASVFALQVPAAVPSVRGPRPGDACHLFEHATTPPGCGRSSHRNT

SEQ ID NO: 180706 - protein, 93 aa, Triticum aestivum
  Clone ID: PAT_TA_75124.pep
YHLGQLINSLKPTHVLQEMPMDKSFKYNSMQPLVHRECHQLPKPHMGAPHVLSAAMQVSALNVLENSHHRAMMNNSYNYMHIWLVEALSLIFA

SEQ ID NO: 180707 - protein, 117 aa, Triticum aestivum
  unsure (1)..(117): unsure at all Xaa locations
  Clone ID: PAT_TA_75125.pep
MRSSSAAAPPPVRSGTWDGSEVHEDHIEFLLRTRRLPGEDRVQVRLAPXGEISPAPREGERVIFRSHCLRGLGLPASSFFRSFMEFYGLQPHHLXPNTVVLLSAFVALCEGFLGVLP

SEQ ID NO: 180708 - protein, 112 aa, Triticum aestivum
  unsure (1)..(112): unsure at all Xaa locations
  Clone ID: PAT_TA_75126.pep
FGDNGTDIVMIAGILMGRPEEEVPDHQVDLLQGLSQVHEQAQLAMRSVAKALWPSASPPGSMEELVELFKGARRRIRLXKISTCREGAREAWAMVKTRCTKLDPNHMARVGP

SEQ ID NO: 180709 - protein, 147 aa, Triticum aestivum
  unsure (1)..(147): unsure at all Xaa locations
  Clone ID: PAT_TA_75127.pep
MGFATFFDIDTMALLWSKTLKVAFVGHVKNGLYVINFSEQPTKTATCXMAKVDVGWLWHRRLAHINMRSLQSLLKGDHVHGLTNVSFAKDRVCSACIKGKLHEKAHPPTTIIYSKRPLELLHMDLFGPPSFDSLGGRKYCLVIVDDY

SEQ ID NO: 180710 - protein, 91 aa, Triticum aestivum
  Clone ID: PAT_TA_75128.pep
LLIYIIIRFSYSYILYILVRGSGKTILSSSNVRVSRVEGIERLLRHTSVAEYGPATPVIHGTLHFGIHSGQPIRILYRRNIRCWPHVSVCL

SEQ ID NO: 180711 - protein, 146 aa, Triticum aestivum
  unsure (1)..(146): unsure at all Xaa locations
  Clone ID: PAT_TA_75129.pep
LHGPAGSHLLFAEYSLLFVKANIEXANELSSLLDRYCMASGXXVNLLKSSVFFSXGCSNELRQEVKDALNITXESLSERYLGLPSDVGNSKNGAFKFLKDRVWNKIKGWMEKILSAGGKEILIKSVAQAVPVFSMSCFKLPRELCE

SEQ ID NO: 180712 - protein, 81 aa, Triticum aestivum
  unsure (1)..(81): unsure at all Xaa locations
  Clone ID: PAT_TA_75130.pep
NRLKKKKQKDTRTEKGGMTTGNPNGFQTNKKSTDPKQWPVKVWAQTIHQPLQKKCTNLQAQINELKDRXGPKWIFTELACN

SEQ ID NO: 180713 - protein, 110 aa, Triticum aestivum
  Clone ID: PAT_TA_75131.pep
AFAINLLKDCVPAKVAKFVPIPMAVAIPFYLGPYFAMDMCIGSVILFCWEWMNKAEAQAFAPAVASGLMCGDGIWALPQAFLSLANVNPPICMKFLSRATNAKVDAFLGN

SEQ ID NO: 180714 - protein, 136 aa, Triticum aestivum
  Clone ID: PAT_TA_75132.pep
HPPFFVRPPPAAKRLKGDSAAPLRVISSVVATPSSAGKGGSRARTSPARSSSRGQEGHSSGEPAPMAPLTLEAPALDAVTEGPKAQEVPASQAVITLPSSPPTPPAPISSASSAALDRAAYELSWLRKDLQGANPR

SEQ ID NO: 180715 - protein, 32 aa, Triticum aestivum
  Clone ID: PAT_TA_75133.pep
LPRYGHALVNFQIIWVSLASTYFTKLLSRGGP

SEQ ID NO: 180716 - protein, 52 aa, Triticum aestivum
  unsure (1)..(52): unsure at all Xaa locations
  Clone ID: PAT_TA_75134.pep
YGHLTWEWKRGLRGYLHPLIFAALYKFLAFLHLDXPWFMVITSTDTFLCLFL

SEQ ID NO: 180717 - protein, 86 aa, Triticum aestivum
  Clone ID: PAT_TA_75135.pep
QFRQRDVSFRPGHYSNRFPITSHNAYCEAVSLTRLVKAEIVSPYHGIFINTGMGNPTTPSIVALGKQAIPNRQVGRRTAFGASIRG

SEQ ID NO: 180718 - protein, 71 aa, Triticum aestivum
  unsure (1)..(71): unsure at all Xaa locations
  Clone ID: PAT_TA_75136.pep
RLSATRSEVESAMNHRRRRTVLRDACFSXEALNAFDAGNAHLRAAQDGLTRATEQYVKDIRVSNFNSYLCQ

SEQ ID NO: 180719 - protein, 30 aa, Triticum aestivum
  Clone ID: PAT_TA_75137.pep
HIIRIMNLFIHAIWLVESSKFSFCINLVFP

SEQ ID NO: 180720 - protein, 138 aa, Triticum aestivum
  Clone ID: PAT_TA_75138.pep
GCDAYVKRLQPDKLAPKSKKCVFIGYPKETVGYTFYHRSEGKTFVAKFGIFLEKEFLSKEVSGRKVELDEVTVPAPLLESSSSQKPVPVTPTPISEEANNDGHETSDQVTTEPRRSTRVKSAPEWYDNPVLEVMLLDH

SEQ ID NO: 180721 - protein, 82 aa, Triticum aestivum
  Clone ID: PAT_TA_75139.pep
KRSYILGQREYLITLTAQIYITSIDQSSTEGRQFYKNISQAVVHRVITKEIPRLRSKCFIKRWCMSYALYFYDWVARKAFAG

SEQ ID NO: 180722 - protein, 110 aa, Triticum aestivum
  Clone ID: PAT_TA_75140.pep
ASRHVQPMSKARMSTEKPIEPVAAESKKRKERVKKIVARVLGKASIMEEEEEEEEVAAPAPKAPKLMGDAIKSGGAASKAKPAPKPKPKRNTRSIPAAEKNKAPVLETVA

SEQ ID NO: 180723 - protein, 56 aa, Triticum aestivum
  Clone ID: PAT_TA_75141.pep
LLAVLHLGATVPSCRWFPSTSTHHHCRYRRSKFISKLGYKLDLFVCSLIPILAQQS

SEQ ID NO: 180724 - protein, 29 aa, Triticum aestivum
  Clone ID: PAT_TA_75142.pep
TRQHLRAGVFVFFKGGVFGGFGGVNLGCY

SEQ ID NO: 180725 - protein, 44 aa, Triticum aestivum
  Clone ID: PAT_TA_75143.pep
YWAHNGLLKARRRLVKIEVQHAFWPAKGPWFHLGRNRPVQYSAC

SEQ ID NO: 180726 - protein, 117 aa, Triticum aestivum
  Clone ID: PAT_TA_75144.pep
SKVTPTLGYECGADALEPDNWLPAESTRARDMVFSGPGLLDGCIAAVNTPAKSPTLFLVCEKFRSGPVGGPIMTALDGKNTSGPHSLDGCRRFESRALEMPLSSIRIFSSLCESFFL

SEQ ID NO: 180727 - protein, 84 aa, Triticum aestivum
  Clone ID: PAT_TA_75145.pep
TLHCFGTTALEYSKSYSSQHDTKFDLLKVVICQVPTRSANYKDFRLIAFFNRGLAYLTGHCGKWINLHVHCRIIHRIHSSLSLS

SEQ ID NO: 180728 - protein, 115 aa, Triticum aestivum
  unsure (1)..(115): unsure at all Xaa locations
  Clone ID: PAT_TA_75146.pep
EPEVEKPPDYDNEISISHAETQSGNEHSPSDNEKGNDEVHENTQTNSXEPDNDVEIEPPVDLDNPQPKNTRYDKKDFIARKHGKEREPWVQKPMPFPSKSTKKKDVKNWNALLKC

SEQ ID NO: 180729 - protein, 59 aa, Triticum aestivum
  Clone ID: PAT_TA_75147.pep
SFAWQVSWVIPGTGELSWCVQVRRVYNQKTVDGISPEGLSNPVTRGKWYSLRKRIHPVG

SEQ ID NO: 180730 - protein, 99 aa, Triticum aestivum
  unsure (1)..(99): unsure at all Xaa locations
  Clone ID: PAT_TA_75148.pep
TSFQVYRITNASLLKNYIFGAFTRYKAGTLQDTLIIHLGRAILPARRWSIRHKLLSVHLAPVHFSTGKGPTGTFDTDRALDDFXPWEAIHKPPHQAEVA

SEQ ID NO: 180731 - protein, 50 aa, Triticum aestivum
  Clone ID: PAT_TA_75149.pep
KAFEMNSEKVETWHGIIISPTKHVQQSREGYGKKLDAFRVQNGQSLSKYH

SEQ ID NO: 180732 - protein, 139 aa, Triticum aestivum
  Clone ID: PAT_TA_75150.pep
CSNLKGFARTRNPTFGVPGRGAPKPLLHQQIRQHSAAPMSGDPRADADHWAAWPAGAASPAQEDLNSALQAAQAPRNAAGRGRRGPTPSTLTPRRALAAGRASSYAAATAPHTRREQANMRAALIVARELLRCRLAESS

SEQ ID NO: 180733 - protein, 85 aa, Triticum aestivum
  unsure (1)..(85): unsure at all Xaa locations
  Clone ID: PAT_TA_75151.pep
SSLNPTRPSLTDSYSRCATFLSIYATQTSSSQLHFSPSELNSPVTXKTQVSDQPAGNSPKCCDLVAWRAVVAWNHVSPGSRSHAP

SEQ ID NO: 180734 - protein, 56 aa, Triticum aestivum
  unsure (1)..(56): unsure at all Xaa locations
  Clone ID: PAT_TA_75152.pep
FYKGGKNIKRPQTWSFGTGLKTWGHANRHDWMIHTCIDDNPXNKGDTISVFTTCYR

SEQ ID NO: 180735 - protein, 57 aa, Triticum aestivum
  Clone ID: PAT_TA_75153.pep
GNIRLEVKTRGIRDNGVEKQESCIRKNYSLPGTTVAYITMYTKLKGNDTNLKLVVKQ

SEQ ID NO: 180736 - protein, 132 aa, Triticum aestivum
  unsure (1)..(132): unsure at all Xaa locations
  Clone ID: PAT_TA_75154.pep
GSRLGRARLVAGGAVELRLVARSVFWRLRLPSVLRLAFLLGAGTDHLRRVLXIVRVHPEPLXRRHPAFFSPIRDEDAGVCVVGDRRRTRDEGVFHIYQLRLRPGDCCPVARHAGSAHSQSDCRLAGGRGWSS

SEQ ID NO: 180737 - protein, 105 aa, Triticum aestivum
  Clone ID: PAT_TA_75155.pep
VQPLACPITFDRRDHLTCIRHEGSAALMLDPIINEYHLTRVLMDGGSSLNLIYQDTVRKMGRDPTKISHSNTTFIGSNTLGPEARSTGSLILEVVFDSPDNFRSE

SEQ ID NO: 180738 - protein, 142 aa, Triticum aestivum
  Clone ID: PAT_TA_75156.pep
ICLWLSARCFVNHLVYITAMYFVFMFGGCSMFISLHLDAYLLQIAYRCHILKRLPFLNRISDSYDLYIVFKRFHPLYPVAHLVFQVDARFVHLLSYLAFCIPHRIPHSISSFHHIAWSCPWLIVSLLLVCLWVEPGEEFTTE

SEQ ID NO: 180739 - protein, 76 aa, Triticum aestivum
  unsure (1)..(76): unsure at all Xaa locations
  Clone ID: PAT_TA_75157.pep
IEEEEGEADSAMSEMMVASSLQLIFXALLLRPSNSTTGKVQLCDLMPHCSLLHRWHDWGASPLLLCTVFRYGTWTR

SEQ ID NO: 180740 - protein, 53 aa, Triticum aestivum
  Clone ID: PAT_TA_75158.pep
FMFLFLKLNQVSRNEMDALFMLYEKMICSISDNELIQLVPPKNILPMCSWQLF

SEQ ID NO: 180741 - protein, 78 aa, Triticum aestivum
  Clone ID: PAT_TA_75159.pep
RGHPYKTCIVHIHFLPFSTKPLFQLNPPGLVDSYSNTPCNPTSCISYLYFLPAFHGGLNTYNNLRRSPCTRPFVLTGT

SEQ ID NO: 180742 - protein, 119 aa, Triticum aestivum
  Clone ID: PAT_TA_75160.pep
AGSARGFLSSPMVLGDSDIDLILGMDWLSQHKAQLDCAAREIQLTHSSEDVIIYAARDETIRLFSLNEKGELDTISQVTVICEYQDVFPQELPGMPPHRPVEFVIDVEPGTEPVCQCPY

SEQ ID NO: 180743 - protein, 37 aa, Triticum aestivum
  Clone ID: PAT_TA_75161.pep
SARGALRNVKFLKDHLCGACEAGKITKAKHPTKTIMT

SEQ ID NO: 180744 - protein, 163 aa, Triticum aestivum
  unsure (1)..(163): unsure at all Xaa locations
  Clone ID: PAT_TA_75162.pep
NSVLVLKKNGAWRMCVDYTDLNKACPVDPFALPCIDQIIDATAGCARLSFLDAYSGYHKIKMAVKDQEKTAFITPFGAFCYVSMPFGLKCAQATYXVVYKNCLHKQIGRNVHAYVDDIVVKSIKEETLIDDLRETFDNLRVYKMMLNPAKCVFGVPCMAKLVG

SEQ ID NO: 180745 - protein, 86 aa, Triticum aestivum
  unsure (1)..(86): unsure at all Xaa locations
  Clone ID: PAT_TA_75163.pep
NIIKMSSNGEVFKVRKLXIVKRTNFDXWAIAIRSHFERRSCVRSIQILYSEHYWDNYAPKMASYEKRFYMGCLHLVETIDFDIRNV

SEQ ID NO: 180746 - protein, 126 aa, Triticum aestivum
  Clone ID: PAT_TA_75164.pep
MFFPFCHRLPTFTMPPKAPITCNWMRSNVTNETLADFVKSGYLPKKDIMSYHAPDPSEERPQPKDGEVVIFADHMSRGFASPGSKFFSDVLNFFDLRPQDIGPNSVSNICNFHVFCEVTFEKNLVC

SEQ ID NO: 180747 - protein, 86 aa, Triticum aestivum
  Clone ID: PAT_TA_75165.pep
HQLKQWAREITAVEPSFDARKPLKWSSTPIIFDTEDHPDRSTAVGCLPLLVSPTIRNLKVTRMFVDGWAGLNLISPAMVKKLQIPN

SEQ ID NO: 180748 - protein, 100 aa, Triticum aestivum
  Clone ID: PAT_TA_75166.pep
LFFGLKTQMPTKAQSGRCDGPAFVGGHNEEVQGNRISFDASRRIIGNKSIGVQGFGTVCTSKKSPTTKSKHRTNKLYHTAIQVTAYTNVQQHLKQMYIFL

SEQ ID NO: 180749 - protein, 106 aa, Triticum aestivum
  Clone ID: PAT_TA_75167.pep
KMKQALEKKDQELAAAQKEAREKTTLADKKLASFNKLEEENSKLKIAITESNQEVVRLKKDTENLTDEVGSLKDQKGELEAYLGQLAVKLVLKLEGISFCPTDFSI

SEQ ID NO: 180750 - protein, 126 aa, Triticum aestivum
  Clone ID: PAT_TA_75168.pep
FLRTAPPTPTTAKRSGHTGPSPWRDRKCPDTRVIHSIPPLHNFSLCRTLFIQSTQRPSRRVVERFPGFVGCEFASDGYLPPPYGRRRGAAPTGSKLGGGGPGGAAGQPPRLQAQWGLNPQGLRVRP

SEQ ID NO: 180751 - protein, 78 aa, Triticum aestivum
  unsure (1)..(78): unsure at all Xaa locations
  Clone ID: PAT_TA_75169.pep
MGLGAPTPRKLAPQAGRGGCPRGGAPTSPGYVRGGGRGAQPLSGWXCPLPLAHKGPPTLVGASETPFGHAGYHRVLPD

SEQ ID NO: 180752 - protein, 121 aa, Triticum aestivum
  Clone ID: PAT_TA_75170.pep
GAKFAKVKKPSLQKKMLSIVAEEGGTPRPSPRVAGMNKNLGKRTAEAGGKDDSRCKRLHVTAGPNSDDDDFVLADFVRDGHSGRSKDCGSSKSHPSVPVMISTKMFVVISGEEVDVVPKVC

SEQ ID NO: 180753 - protein, 60 aa, Triticum aestivum
  Clone ID: PAT_TA_75171.pep
NKLQKIQLYSMNNLIINPQFIRSQQTHCKNYIRLISEEIIVLKIQERERERESSHPAATM

SEQ ID NO: 180754 - protein, 72 aa, Triticum aestivum
  Clone ID: PAT_TA_75172.pep
FFFFFVKYGGPSSGSLLSRGGIIIIARNKEALPCCGHGPSCQHSPRIVLFRWKSFLDHIDHAAHKSTQGGGP

SEQ ID NO: 180755 - protein, 76 aa, Triticum aestivum
  Clone ID: PAT_TA_75173.pep
LFSLATYLTRSITKLQFGFEHNCKSENAAAGIVIPSFSLPVRSKTLLQNCYIALCTCNTSELQPERPPALSSSPSP

SEQ ID NO: 180756 - protein, 165 aa, Triticum aestivum
  unsure (1)..(165): unsure at all Xaa locations
  Clone ID: PAT_TA_75174.pep
WTCVHDWLEHLQIRHPYVRATSSSGSFGXSGCWWLRIPPFAGALGWLSSTPRAASTPSGSWSCVPFQLIQLTGRSYGSGPGSLDLRSSPDPGSSRFSAAIAPSVFXERLPNPSXLCGPSALLQVISSGSSPSCGCGFSPRPDFLIFEFCSGGLGLLRLSKDFPWL

SEQ ID NO: 180757 - protein, 66 aa, Triticum aestivum
  unsure (1)..(66): unsure at all Xaa locations
  Clone ID: PAT_TA_75175.pep
AEAKQWLSQQCGITATHLLNFSFYLSGHCFSAASPEEPDXRTYIGEKTKEATCFAHRRKYPGGIYL

SEQ ID NO: 180758 - protein, 59 aa, Triticum aestivum
  Clone ID: PAT_TA_75176.pep
MKAIKEPEPKQVFTEKQKKWAKDFLTTPSQAELNMPDDYGHELRRRAKILKEEKEKKKK

SEQ ID NO: 180759 - protein, 87 aa, Triticum aestivum
  unsure (1)..(87): unsure at all Xaa locations
  Clone ID: PAT_TA_75177.pep
GATXSPRTFSCLNTPXSTEPGENFQVXLAGRPSGLHHSHAAWIRPCGMYVSLLFYVFNLPCWGRLSGDIIRKPLGRDPVARIVHAFT

SEQ ID NO: 180760 - protein, 90 aa, Triticum aestivum
  Clone ID: PAT_TA_75178.pep
LAFQFCVIFFFFKGTGYIIHQIFARIARPKKTKITSRNFRRYPTSITPPTSWTNIFSMPSLLICRLLILHSSFTFFGSKEVDVASLKFLL

SEQ ID NO: 180761 - protein, 62 aa, Triticum aestivum
  unsure (1)..(62): unsure at all Xaa locations
  Clone ID: PAT_TA_75179.pep
GKTVKILDYASRVTRSKVIKFCKVQWSHHTEDEATWEREEVLLKDHPHLXSSQPESRGRDSS

SEQ ID NO: 180762 - protein, 92 aa, Triticum aestivum
  unsure (1)..(92): unsure at all Xaa locations
  Clone ID: PAT_TA_75180.pep
PGLQVSRSSQSRPHGQAQPLDRPALYLGPFLRRHFQRSGFFSSVEGERRKTSRLSWGRLVLTVEPGRLPTMDRLXESDGWKTALSPRLDRXA

SEQ ID NO: 180763 - protein, 102 aa, Triticum aestivum
  Clone ID: PAT_TA_75181.pep
MVVNPEDQDQHNAAITRLRDEIAQAKEELNAESAKMVEEQAALDAQSQRIQAESYQLMLDQNASNDVMRRRHQTRLPSVYEARNIFNTPGVGTSNPRGVKLG

SEQ ID NO: 180764 - protein, 84 aa, Triticum aestivum
  Clone ID: PAT_TA_75182.pep
PEGPRVANAKMPRLLAFARHVEMVIIEELKPRSTTLMRCRTLFVMMGISEYSEREPALQCRKQDCAPDSSSLKPSSAATKGVLD

SEQ ID NO: 180765 - protein, 172 aa, Triticum aestivum
  unsure (1)..(172): unsure at all Xaa locations
  Clone ID: PAT_TA_75183.pep
QSQIACCLRLDRTEAGRPLRLPVCCLRPRRLRRSPPLSLHHRPGSARTSRAAPRRPARLXLRDEDVGVGVLNKRRHVLSKLTVHSHQLRPGLNPESGQLGQVQPGIPHLDELQGRPRTRPSCCTLPSLEAADCYLQPVSSPTGGTRHLGISPEGGQHLGPGVLKAAEQQWAS

SEQ ID NO: 180766 - protein, 59 aa, Triticum aestivum
  unsure (1)..(59): unsure at all Xaa locations
  Clone ID: PAT_TA_75184.pep
SGLILAANLGYTKVIIESDSMVGLETIFDTKCVHXNRCFNHCKVHHCRVPSMYRLCLLH

SEQ ID NO: 180767 - protein, 59 aa, Triticum aestivum
  Clone ID: PAT_TA_75185.pep
FPTESISDLPISKLGDTEAVLAPKLVNSVRPSHSSVAPRLLGFHRVPKSVTPISNFRSD

SEQ ID NO: 180768 - protein, 104 aa, Triticum aestivum
  Clone ID: PAT_TA_75186.pep
GTIATFYLSFYKLTLFLILEDVCSSVIQKMIPNKLDPKIAHSEGLGTRIYRPQPGASCQFPEMLSVPGEAIYRGDVPFLLNFNHKGVQFVTPFSMFTMTMYYDF

SEQ ID NO: 180769 - protein, 108 aa, Triticum aestivum
  Clone ID: PAT_TA_75187.pep
AQRERERELYIGSAISATGTSFRVTGIVPGPPKGSRGSTGWGHLPPGAIWAKGTSPKRAHAPRDKERKSPKGGRHLLGALGRKVSSLAAPFLGGRAKAARPPLPWPYI

SEQ ID NO: 180770 - protein, 135 aa, Triticum aestivum
  unsure (1)..(135): unsure at all Xaa locations
  Clone ID: PAT_TA_75188.pep
EAFTIFQAIPHYGYMKLKMPGPNGIIXLASDPDTALRAENKTAALAXPKSLSEALATEELTTLRSTVDRDDVILDKRSKPTSFKPADEIVQFQVHPTDPTKTASIGAQLSPDVEAALXEFLRENWDIFAWHPSDM

SEQ ID NO: 180771 - protein, 170 aa, Triticum aestivum
  unsure (1)..(170): unsure at all Xaa locations
  Clone ID: PAT_TA_75189.pep
VRAQPGERGESPPRSSYSLAYPLDGRRVHPLVHGCHGXVEGREPLRDWIPLSILFYFAFLFSGRKPFLIFWEICNSDCADIXTXFXGYKLPCAXSKAPTDLRGGHKPPSRAXGRLMRXVPCGGCGPPFAMIPHPKNHKYSKXFSVNFYHVWTLFDMDMRNKKHATKRNWH

SEQ ID NO: 180772 - protein, 149 aa, Triticum aestivum
  unsure (1)..(149): unsure at all Xaa locations
  Clone ID: PAT_TA_75190.pep
SFLDAYSGYHQIFMAEEDEEKTAFITPCGTYYFVRMPFGLKNAGSTFARVVHHAFEPQMHRNVEAYMDDIVVNSKDRATLIQDLDETFANLRKINLKLNPEKCVFGVPSXRKLLGFFVSQRGIEANPDKIKAIEQIEAPKRVKDLRRLA

SEQ ID NO: 180773 - protein, 103 aa, Triticum aestivum
  Clone ID: PAT_TA_75191.pep
LPQGWTKKAGQIHCPAPLPEEPTGPLLTKMLVPVPYKAPKKEANKKANETRSGLRRRDVSDMKSEDSSDHPSFEEYEEEEEDEEEEEDEEEEELESPTRGGGE

SEQ ID NO: 180774 - protein, 144 aa, Triticum aestivum
  unsure (1)..(144): unsure at all Xaa locations
  Clone ID: PAT_TA_75192.pep
ATSLRKIDADDQPDWRSTPTDPTPHGPVASRLGARAXDDTDARNRLDRLAFSLEVEEGSTVRPTCFGPRIREEPFPKGFTLPHNSPKYNRTVKPEDWLTDYTTTIGITGGNHRLVVRYAPLMLQGSAHTWLNSLPVGSVNMWVD

SEQ ID NO: 180775 - protein, 125 aa, Triticum aestivum
  Clone ID: PAT_TA_75193.pep
FASIAISWRKMCMEADFSYSPTKLAILDEQISIKNACFVMSKNPTFAGYPSPFYIAVFPTGWAFGFSQKFGFSKLLPDFFPEKRETRKFGHLKFLVRVQSRMTRISTTRKMAAAFKKKKKLKGGP

SEQ ID NO: 180776 - protein, 51 aa, Triticum aestivum
  Clone ID: PAT_TA_75194.pep
SIIIFMSILNFCLESFGIWNIHATINKITLKNMLSSIPHQNSVFIIYLLIG

SEQ ID NO: 180777 - protein, 106 aa, Triticum aestivum
  Clone ID: PAT_TA_75195.pep
NYHTSVRAALALFASSGSRTMIEYYCTGGVLQYASGHLTPIELLHVHRVREGERVAKASPSLASHHAHGRGRDAPAFACITGGPDRCVFNLSYSQRQVQLSPRGRG

SEQ ID NO: 180778 - protein, 106 aa, Triticum aestivum
  Clone ID: PAT_TA_75196.pep
DASRDHLDSFAGCVFRERTVDQGETLLNNVLTNENNWTLPEPTPKPTPKKRGVLFLSPEDMQEAKKFMKEKGIKAEDVKNLPPVEEIHGLNLPPVEETLDNPTQVV

SEQ ID NO: 180779 - protein, 121 aa, Triticum aestivum
  Clone ID: PAT_TA_75197.pep
IFVFGGFVLRANSLGNLEQIESYASGRQVRVGNLNYTADIRGDLIFDGFEPMSGAPHSHDEHELALPPDGVRDITPMLTPALDPESIAPSEDGRMDPASEATHSVAIEPNTDFTSNETCVV

SEQ ID NO: 180780 - protein, 52 aa, Triticum aestivum
  Clone ID: PAT_TA_75198.pep
PRGHITRHDQAFEIGRLGQATCSVWSSARLIKVQWNPGQVGFLFYRVATKQA

SEQ ID NO: 180781 - protein, 110 aa, Triticum aestivum
  unsure (1)..(110): unsure at all Xaa locations
  Clone ID: PAT_TA_75199.pep
MQAEMPKISVGQLLEIEPMSSLRESEIKRKYVQGQPLVEPDKVKNLPTRMYELHQWYMNITKISNRDSLMVNVKHEHYYHEKALAVEYSXIFQLYNQDALDKSIVSCYCL

SEQ ID NO: 180782 - protein, 96 aa, Triticum aestivum
  Clone ID: PAT_TA_75200.pep
AQRIKVGHQRRWDPPRRPPGAARGWAAPTGRLGPPWPSSGSSSGSGFLRVRGFSVIFWWNFLRYLKIRFPAHNKTIQAALLKTTSVRVSLVQIMQE

SEQ ID NO: 180783 - protein, 58 aa, Triticum aestivum
  Clone ID: PAT_TA_75201.pep
IPCLWRKVLINLPNWTPPPPPPPVSQGTPPPPPVSDQGTPPTPARPSSPPRQQKRKTA

SEQ ID NO: 180784 - protein, 112 aa, Triticum aestivum
  unsure (1)..(112): unsure at all Xaa locations
  Clone ID: PAT_TA_75202.pep
YDLTPNSFLNISAFIVVCEAFLHIPPHFGLWLKIFNVKPKVVDFQHTECGGAMVSKLPNITWPKGTFAETVKXWQKMWFYITEPRDTTWAATPEFKSIAPMWLTSWIEKGPN

SEQ ID NO: 180785 - protein, 56 aa, Triticum aestivum
  unsure (1)..(56): unsure at all Xaa locations
  Clone ID: PAT_TA_75203.pep
PKILDQEAITRPRPNHSTVGRPKGTPHANGRLLSSFYGHHITLLGALPVTPDINXI

SEQ ID NO: 180786 - protein, 76 aa, Triticum aestivum
  unsure (1)..(76): unsure at all Xaa locations
  Clone ID: PAT_TA_75204.pep
ASCFMCLVICSKTLNYFSISTYDLNPKPNSVLPILPIXRHRVSLVISHCQTLAIRSYRLGISVSPRWGCKLSVSLS

SEQ ID NO: 180787 - protein, 95 aa, Triticum aestivum
  unsure (1)..(95): unsure at all Xaa locations
  Clone ID: PAT_TA_75205.pep
QEKANXRLPQSQVMMVFLACRRDLSSRAVAEAAWGSGDAHVQSTATRQQRPQAFGARSAPYLTLGFTVNPSPSAHWARGLLSAFWERGSPDLPAA

SEQ ID NO: 180788 - protein, 83 aa, Triticum aestivum
  Clone ID: PAT_TA_75206.pep
CPSSFLLLLLTLMLLCCADRPTPTRKEEGGSGGIARDPIARGGCAPLRGEGAVTALAFLRPDRPCKAWGSVLKRRWPLLPHWL

SEQ ID NO: 180789 - protein, 155 aa, Triticum aestivum
  unsure (1)..(155): unsure at all Xaa locations
  Clone ID: PAT_TA_75207.pep
VKAEHQPPAGTLQPLAIPEWKWDKISMDFITGFPRTKRGNNAIFVVIHRXLSEVSHFLPVRESITASQLADLYISXIVSLHGVPLEINSDRGSLFTSRFWESFQNAMGTRLSFRTAFHPQSSGQVERVNQILEDMLRASVISFGMSWDKCLPFPV

SEQ ID NO: 180790 - protein, 86 aa, Triticum aestivum
  Clone ID: PAT_TA_75208.pep
MDGGSSLNLIYQDTVRKMGIDPTKISRSNTTFKGVTPGPEAHCTGSLLLEVIFGFPDNFHSENLTFHIAPFQGGYQALLGSEAFAC

SEQ ID NO: 180791 - protein, 60 aa, Triticum aestivum
  Clone ID: PAT_TA_75209.pep
LRLIPQLDANRDHVPNKNPTLSRTCFLGPEGFNRLAIARDSCDREPFIRAQLFLRASFLY

SEQ ID NO: 180792 - protein, 42 aa, Triticum aestivum
  Clone ID: PAT_TA_75210.pep
WPSRAIPVIVNLSSGHNFFFGPHFFTEVLLDLEGYIREERRV

SEQ ID NO: 180793 - protein, 140 aa, Triticum aestivum
  unsure (1)..(140): unsure at all Xaa locations
  Clone ID: PAT_TA_75211.pep
LSRKAYCNSLILKPFQRDLCEAFRKLNLQVVPQGFLANLIVSPTLEDQIREAQLLDAMVKKVKRGIDKGLSKYKCYRIDDRDTLFFEDRIVVXKDDLRKVIMNEAHXNSFLSIHPGSTKMYHDLKQSYWWTRMKREIAQF

SEQ ID NO: 180794 - protein, 50 aa, Triticum aestivum
  Clone ID: PAT_TA_75212.pep
HVSILDVRMYHIVGQRSTFSNKNYQTDAVLRGVLHRVPLVFLGPCYVSIP

SEQ ID NO: 180795 - protein, 51 aa, Triticum aestivum
  Clone ID: PAT_TA_75213.pep
RTAVMPPSFLPSHPSGEALHRAPCNRLQPRAPPRSPAIVAVLDASPSMMSS

SEQ ID NO: 180796 - protein, 39 aa, Triticum aestivum
  Clone ID: PAT_TA_75214.pep
CSLEKQSKWRRKRRPKSHLDRNSSHTDPSAEQVEPLPDN

SEQ ID NO: 180797 - protein, 62 aa, Triticum aestivum
  Clone ID: PAT_TA_75215.pep
FALHANGGRIIDHSTSREPLPSPSLAFKPYQCKCGSTRDKSFTIVEKRPLVPVHKGPLVPVL

SEQ ID NO: 180798 - protein, 40 aa, Triticum aestivum
  Clone ID: PAT_TA_75216.pep
MKKILFSMFYSILVGEEPDSVFLKKEGKQNQVKMIWVAPS

SEQ ID NO: 180799 - protein, 39 aa, Triticum aestivum
  Clone ID: PAT_TA_75217.pep
LCYHCICQNSIRYFILIKHLTLKTEKITSIHPLENRKTT

SEQ ID NO: 180800 - protein, 47 aa, Triticum aestivum
  Clone ID: PAT_TA_75218.pep
VCLTLGGLAAIQHSPKYDDRSDPQGRRGEGQLLPSPPGFGADTTLLL

SEQ ID NO: 180801 - protein, 54 aa, Triticum aestivum
  Clone ID: PAT_TA_75219.pep
TFLKLFNFNRNIITTLASRVGGDVSSQQTRSPGSNLTCESSGTRMSASVSKTVD

SEQ ID NO: 180802 - protein, 84 aa, Triticum aestivum
  Clone ID: PAT_TA_75220.pep
LILMDSQLKAGKRKGRWCEPGLRIARPPSQASVSTEEPEPQTLSCLVRGLSSSFPSEALHLLIVREATTTSRGAAANKKNQRDD

SEQ ID NO: 180803 - protein, 98 aa, Triticum aestivum
  Clone ID: PAT_TA_75221.pep
CTSVVVRVMRYVSWYEISWTCHVMYISCMSLCIIMLELYFICRIFFIISVFLGLLLLAFPQFILNASHLGCIVLGKTTIGCRTEAAVATFARVLLFVV

SEQ ID NO: 180804 - protein, 84 aa, Triticum aestivum
  Clone ID: PAT_TA_75222.pep
VRVFYNTPINNHLPPPLFFLPLTNLPLPLALATFLNLDCFASIAGTARCHIQRGFTWEQGVTTMVDKVADSLGIAAAVNCRDRL

SEQ ID NO: 180805 - protein, 78 aa, Triticum aestivum
  Clone ID: PAT_TA_75223.pep
KLPRGTLATYRLFTIFTMNITKPSTRPKPPRVINSRTLTRTNQCGELKPMRQMQCNAKQQMLNTLSQSSQDALLKVGG

SEQ ID NO: 180806 - protein, 99 aa, Triticum aestivum
  unsure (1)..(99): unsure at all Xaa locations
  Clone ID: PAT_TA_75224.pep
ERRAVLLDLANRIPGLGYKNGSXALLERTSTIPLYYLFGFGEIEPSSFRQGGAPCGTTIVPRSAAGQLIGSSFLLLILIRNERGRNNAWLGVVARDAGA

SEQ ID NO: 180807 - protein, 94 aa, Triticum aestivum
  unsure (1)..(94): unsure at all Xaa locations
  Clone ID: PAT_TA_75225.pep
LACPHWLTNAGPIHMSAPVADLTMVDFSFNAVTINSTADNFRLNISXDIVSLNIFYQYISFFFKEQLLWSLLFLGRIIICYKGVAXGCAPRLSH

SEQ ID NO: 180808 - protein, 54 aa, Triticum aestivum
  Clone ID: PAT_TA_75226.pep
LNASTLGLRGYVDTLSPLVAMDYRDISCVIIGFFFEITAFPNIRNYEKSVKIKS

SEQ ID NO: 180809 - protein, 117 aa, Triticum aestivum
  unsure (1)..(117): unsure at all Xaa locations
  Clone ID: PAT_TA_75227.pep
ARHWLNSLPANSIGSWENLEDAFFDNFQGTYXRPPDADNLSHITXQPGESARKYWTRFLTKKNQIIDCPDADALAAFKHNIRNEWHARHLGQEKPKSMAALTTLMTRFCAGEESWLA

SEQ ID NO: 180810 - protein, 54 aa, Triticum aestivum
  Clone ID: PAT_TA_75228.pep
IIFLHQTRASTALRVPTREQAAPRGRARPPVSWPPRTPSHVDFTSEKSQIFQKK

SEQ ID NO: 180811 - protein, 101 aa, Triticum aestivum
  Clone ID: PAT_TA_75229.pep
GFNATYSRSCSSGVVVLSVPSIMLEPFKQWNHSLLLSLSPVTRIIPTFAFCSQLAPPLCHSILDYLPGNSWSGSSSTVVLPWVLSISDDKQKSSIALPSTR

SEQ ID NO: 180812 - protein, 74 aa, Triticum aestivum
  Clone ID: PAT_TA_75230.pep
SHEACVSYANISHMHLRLRKQGEEIVCGCLHREETLFSTFIVCCPCLFHTRTHTLFTHSFYFAHTHTHSLALSL

SEQ ID NO: 180813 - protein, 63 aa, Triticum aestivum
  Clone ID: PAT_TA_75231.pep
TRPNTPVRKRRQEVSCTSDTPCLKVGYFRYPLNPSDSNYQGTSHSSSSESTGTKLPTVKTVPG

SEQ ID NO: 180814 - protein, 103 aa, Triticum aestivum
  Clone ID: PAT_TA_75232.pep
LHNQPDMTDTQNEAAIDASMRRCGSSLVRNLEKQYSRCRKKLRLPSSPMATGTTVSDQPLLDDTHRSIKAIVINELGIVGPDKGTNSVIANPTRKKQHPCKCL

SEQ ID NO: 180815 - protein, 58 aa, Triticum aestivum
  Clone ID: PAT_TA_75233.pep
EYIIQLYAKTHWLFFGKFEKIILFCSLVQLGVFYCNHILSCPIALDLSPAFKPPYQTL

SEQ ID NO: 180816 - protein, 77 aa, Triticum aestivum
  Clone ID: PAT_TA_75234.pep
NFKIGHLFFLKQKFKVLTCVNYFCRYMHLLGPIITLVIDKRLETLDLGCLKFALCLSVCSSVLPQLVSSWLYMLEII

SEQ ID NO: 180817 - protein, 128 aa, Triticum aestivum
  unsure (1)..(128): unsure at all Xaa locations
  Clone ID: PAT_TA_75235.pep
LLYWIAQLLGSTAXACFLLRFSTGGLPTGTFGLTGIXGAWEAVVLEIVMTFGLVYTVYAYRXCDPKKGSLGTIAPIAIGFIVGANILVGGAFSGASMNPAVSFGPALVSWXWGYQWVYWVGPLIGGSL

SEQ ID NO: 180818 - protein, 89 aa, Triticum aestivum
  unsure (1)..(89): unsure at all Xaa locations
  Clone ID: PAT_TA_75236.pep
MAGMMKKQVVTALMLALVXVLAACPASQLAVCASAILSGAKPSGECCGNLRAQQGCFCQYAKDPTYGQYIRSPHARDTLTSCGLAGPHC

SEQ ID NO: 180819 - protein, 99 aa, Triticum aestivum
  Clone ID: PAT_TA_75237.pep
AAQPRTPPPRRAAAGLGHLLLRAAAVAAPQRRLRRTAAAHGSSPTALASGDPFLFLLLLDSSLVFLHHQTPITTLTSSFLWIFTSCPFVKKSPRDFILG

SEQ ID NO: 180820 - protein, 36 aa, Triticum aestivum
  Clone ID: PAT_TA_75238.pep
HEARTPWTKQIGGAYTPIHRLVINGDCFGFSGLGAC

SEQ ID NO: 180821 - protein, 73 aa, Triticum aestivum
  Clone ID: PAT_TA_75239.pep
WCKNRSPSWRPPIVRATAALLDGQVTVPSSREEENVGGTLHSRRSRTRLCYFGRDGRLLSTNFPYAIQSRPHC

SEQ ID NO: 180822 - protein, 117 aa, Triticum aestivum
  unsure (1)..(117): unsure at all Xaa locations
  Clone ID: PAT_TA_75240.pep
MFGFGHHXHHGQXPPAHAPAGXGGNQPTFKIFCKADEGYCLXVRDGDVVLAPFNPRDEHQHWFKDMRFSAQIKDEEGNPXAFAIVDKATRLAXKHSLGQSHPVKLVPFNPEYLDESV

SEQ ID NO: 180823 - protein, 167 aa, Triticum aestivum
  unsure (1)..(167): unsure at all Xaa locations
  Clone ID: PAT_TA_75241.pep
MGKEKIHISVVVIGHVDSGKSTTTXGHLIYKLGGIDKRVIERFEKEAXAEMNKRSFKVXPWVLDKLKAXSAERGITTSSCSAGNSSTTKYSCTVIDAPGHRDFIKNMITGTSQADCAVLIIDSTTGGFEAGISQDGQSREHALLAFTLGVKQMICCCNRMDATTPKY

SEQ ID NO: 180824 - protein, 148 aa, Triticum aestivum
  Clone ID: PAT_TA_75242.pep
LALMRSRRDDWRRVGGRYAVYRVMSPATAGPVGRSWIDPEVLSKRGGQRTDGEGIGIGQFEDPKRVPHHLPHRLSSSTRMLCSTSSSSWLLNKISRSSRCSRASALGFRTWRSTVDAGGLCQAGAGGLLSFVYPTLQLLRHGVRLFGD

SEQ ID NO: 180825 - protein, 202 aa, Triticum aestivum
  unsure (1)..(202): unsure at all Xaa locations
  Clone ID: PAT_TA_75243.pep
TRQPLWVIEELVNPLSAAAQHHFSKWVENPEFVFALAYXLPENLVDSMDEILQPLVDXANLVGYSCREEWISGIVIALSTYLAKEIFPKQIELLQESSSSDASSTAVQARVSWLNLVDLMISFDKRTQDLISGTGLLLSVKDDENWQRISVLSVFCDRPDWLEIWAEIERREVFASLKSAMENENHWSTRIEGAMLEYGSDD

SEQ ID NO: 180826 - protein, 143 aa, Triticum aestivum
  unsure (1)..(143): unsure at all Xaa locations
  Clone ID: PAT_TA_75244.pep
RLEEGCTLNSXGTIRHLSVSNNWDGDESEFESTVDLSRVRSITIFGKWRPFFISDKMRLLRVLDLESTSGLVDHHLEHIGKLFHLRYLSLRGCHGIYHLPGSLGNLRQLQTLDVTGTNIIELPKNIIKLRKLQHVHARGVGNN

SEQ ID NO: 180827 - protein, 130 aa, Triticum aestivum
  unsure (1)..(130): unsure at all Xaa locations
  Clone ID: PAT_TA_75245.pep
QGGEDNYERDHQYGRYSCDSDYERSRRDSSRRRIDSFEHERERKGLSXERDESPYVRHSRSRSRGRDNRSRSRSRSWSPRGKSRNWGQRDGFYDDTRFERRGEQDWDERRHDDLVAPSATVVLKGLSQKT

SEQ ID NO: 180828 - protein, 35 aa, Triticum aestivum
  Clone ID: PAT_TA_75246.pep
CATATPTSTTYPTYPPHPATLSVAAGRTVTCVDWS

SEQ ID NO: 180829 - protein, 40 aa, Triticum aestivum
  Clone ID: PAT_TA_75247.pep
EKNPNGELGMPSNVQVAFVLSPALWSSSIALLARHLLGWR

SEQ ID NO: 180830 - protein, 99 aa, Triticum aestivum
  Clone ID: PAT_TA_75248.pep
PAGVPAPSDHEVIRLRLWRFPCVSLSPAAAAAPMYSAGTLVETMGWRRQRRQQRMERKLDEPRASEETETSGAHEDDGEPVAGDVRVGGGGGMARATAS

SEQ ID NO: 180831 - protein, 95 aa, Triticum aestivum
  Clone ID: PAT_TA_75249.pep
PLCRFNAGSPLFLLSSGRISGAGRYSRMPTRELSLMLFMKMPLSSNFSRCTCLVKAYIYQCQFRCARRWPNYALRLPKLASILWLLMTGGLGTRL

SEQ ID NO: 180832 - protein, 108 aa, Triticum aestivum
  Clone ID: PAT_TA_75250.pep
PPNPPSPSPSPALFAPREIAASPPLRRRHHDQRCSPPRENLPGAPRRSSTPSSPASSSRGGRHRRIGHSSPVLVAAIPPRRSAPPVLPRGSTGWSRPPREYHPAPALT

SEQ ID NO: 180833 - protein, 103 aa, Triticum aestivum
  unsure (1)..(103): unsure at all Xaa locations
  Clone ID: PAT_TA_75251.pep
KTSADGHVSCAKEMTKLSGISDIIPEMEVCDFDFEPCGYSMNAINGSAFSTIHVTPEDGFSYASYEVMGMDASALAYGDIVKRVLRCXFGPSEFSVAVTIFGG

SEQ ID NO: 180834 - protein, 128 aa, Triticum aestivum
  unsure (1)..(128): unsure at all Xaa locations
  Clone ID: PAT_TA_75252.pep
AEKAEKTTAAKKTKAEKRPPASKEGGEKKGKKKSKKSVETYKIYIFKVLKQVHPDIGISSKAMSIMNSFINDIFEKLAGESAKLARYNKKPTITSREIQTSVRLVLPGELAXHAVSEGTKAVTKFTSA

SEQ ID NO: 180835 - protein, 140 aa, Triticum aestivum
  unsure (1)..(140): unsure at all Xaa locations
  Clone ID: PAT_TA_75253.pep
GIRHEVCNGETCSRGVKELREALQHDVAAHSGGAHGKGSGHGKGRGKKQVKQPKKEVVDLETLLIHCAQSVSIDDRRSATXLLKQIRQHASATGXGDQRLAHCFANGLXARLAGNGSQIYKLHTISRFACTDVLKAYQLY

SEQ ID NO: 180836 - protein, 49 aa, Triticum aestivum
  Clone ID: PAT_TA_75254.pep
FPVDRPAPTWGLASGLQQDRADYERRHAIVGIGRRKHHHRRPAVPAAAV

SEQ ID NO: 180837 - protein, 67 aa, Triticum aestivum
  Clone ID: PAT_TA_75255.pep
QMNKSCRLGIQIFDLNVDGTRESCEVTEIPGDPPEEHASDSLPHLVGQHEISKHTLILQILKSKINV

SEQ ID NO: 180838 - protein, 98 aa, Triticum aestivum
  unsure (1)..(98): unsure at all Xaa locations
  Clone ID: PAT_TA_75256.pep
AGLQFPVGRVARHLKVGRYAKRVGAGXAPVYLXAVLEYLAAEALEXLAGNAARDNKKTRISPRHIQLAVRNDEELSRLLGXYTIAAGGVLPNIHSVLL

SEQ ID NO: 180839 - protein, 134 aa, Triticum aestivum
  unsure (1)..(134): unsure at all Xaa locations
  Clone ID: PAT_TA_75257.pep
VRWGHLAPGSLCSLTLSDVERQLHGVHLDDLLRTAGSARRTADEVWRDIHGANSGTAXPRAQMTLEDFLSRPGSDAGGAHWAEQYNPPAPVPRQQRHNNVRRPLQRPLGVGAGPVLDALYHDHYGAAMSGRTRA

SEQ ID NO: 180840 - protein, 44 aa, Triticum aestivum
  Clone ID: PAT_TA_75258.pep
MDRPPQVLDHYIGVDVGTGSARACIIDDTGDIEALASENIKLWQ

SEQ ID NO: 180841 - protein, 126 aa, Triticum aestivum
  Clone ID: PAT_TA_75259.pep
DLEVHNVRVNRHAHTGQCISYGKPTTIDTAMGGLLRLAPRAGPPAHRGIVGSARIQAQRGSPEERRGELGTGLHGGLLAAGFVIAAGVHGGHSRRCLPLPSSGAPPHAQPACLHLIQRGGGCVVEQ

SEQ ID NO: 180842 - protein, 92 aa, Triticum aestivum
  Clone ID: PAT_TA_75260.pep
DAGRRSSPSAKKSRSSRSVAPEVTAVRLSWSSMRSRARRRRGTSGSRSASRSALRHRGDPRRRHAVVGAGAAAVARLGVRVVRFRRLAIRFG

SEQ ID NO: 180843 - protein, 159 aa, Triticum aestivum
  Clone ID: PAT_TA_75261.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVER

SEQ ID NO: 180844 - protein, 58 aa, Triticum aestivum
  Clone ID: PAT_TA_75262.pep
QALGKRRRATSTRGGGHGAQHKSCCDEEQETSSRGRGSHRDLASLPGLSVSCRIDVSV

SEQ ID NO: 180845 - protein, 63 aa, Triticum aestivum
  unsure (1)..(63): unsure at all Xaa locations
  Clone ID: PAT_TA_75263.pep
ATMSLSSSTFAGXAKNVPSLAVFGEAKVHMRKXTVAKAKQVSSGSPWYGADRVLYLGPLSGEP

SEQ ID NO: 180846 - protein, 83 aa, Triticum aestivum
  Clone ID: PAT_TA_75264.pep
ALVWWSYASGRVVVPAVGWRGWRARRSSRLRRTEEAARGAEAEAGEEARKDLAALQAEWKSLVGGGGALSLAGTVGRTFLPLH

SEQ ID NO: 180847 - protein, 128 aa, Triticum aestivum
  unsure (1)..(128): unsure at all Xaa locations
  Clone ID: PAT_TA_75265.pep
QPWRFXYSYWNSSQSYVMTNGWSRFVKEKRLDAGDTVSFGRGVGEAARGRLFIDWRRXRPDVVLPTGHHRGFALPSVPFSPWMAHPAGPGGAGGRMFLQATTPATVYDYDAYQHHHQRRHIGYDGYGA

SEQ ID NO: 180848 - protein, 68 aa, Triticum aestivum
  Clone ID: PAT_TA_75266.pep
VLGQIHRLAPLQSRLRLSTAPRRRPWYQPRPRGRSPVRAHSREEAPGVIARRGRQNSEIQRCFIEIGE

SEQ ID NO: 180849 - protein, 156 aa, Triticum aestivum
  unsure (1)..(156): unsure at all Xaa locations
  Clone ID: PAT_TA_75267.pep
GNGGTPHDIGAASSYRLKSVTIRYGDIIDSLTFSYSDHSEHVHSVGPWGGTGGAKXNIHQIXPSEFLTEISGKFGPYALSTSNVITSLMLVTNEDRYGPFGFVQGTPFCTNLENDWAIVGFFARAERYVHKIGVYARPNSLDGGTAVQSELEGGQE

SEQ ID NO: 180850 - protein, 175 aa, Triticum aestivum
  unsure (1)..(175): unsure at all Xaa locations
  Clone ID: PAT_TA_75268.pep
MAPAVMASSATTVAPFQGLKSTAGLPVSRRSGSAGLSSVSNGGRIRCMQVWPIEGIKKFETLSYXPPLSTEALLKQVDYLIRSKWVPCLEFSKVGFVFREHNSSPGYYDGRYWTMXKLPIFGCTDATQVLSEVEEVKKEYPDAYXRVIGFDXMRQVQCVSFIAFRPPGCEESGKA

SEQ ID NO: 180851 - protein, 203 aa, Triticum aestivum
  unsure (1)..(203): unsure at all Xaa locations
  Clone ID: PAT_TA_75269.pep
HWARIEGAHHTGALLGVGEDHPQGWEKRCAAAPXVVMHADWDLXMYYHSFDELSQRHAVGVARSRDGIRWERVGKVLEGGGPGSFDEGGVRQGHVVRDRAAGRYMMAYEGLDGNGGVSIGLAVSEDGLRGWRRCSESPALRPSEDDDQWDVSRVGAPCLVHMDRPYDWRLYYMGVGKDGEAAIGMAYSEGQGLPRFNKCDALL

SEQ ID NO: 180852 - protein, 93 aa, Triticum aestivum
  Clone ID: PAT_TA_75270.pep
DGLCEIVARGMARGVSGPRRYHINLSVFTSLPDMWAIEQLFPIIPMQRLQERPAVYGVLSDLTCDSDGEVDQFIGGRSSLPLHELPTHGTRGY

SEQ ID NO: 180853 - protein, 198 aa, Triticum aestivum
  unsure (1)..(198): unsure at all Xaa locations
  Clone ID: PAT_TA_75271.pep
GCCVTGVEEAQLPTPANADKLNGFHTANVAHTXQCSVCLDKAAVMDQVDLAATPKKQEQASTSTMTEVEEVKIVVKLMPIWSTCILFWTIYSQMTTFSVEQATHMDRRLNAGFEIPAGSLSVFLFLSILLFTSLNERFLVPLAARLTGRAQGLTSLQRVXTGLVFATVAIVVAALVQKIRRDAANGESQVAISAFWLV

SEQ ID NO: 180854 - protein, 151 aa, Triticum aestivum
  unsure (1)..(151): unsure at all Xaa locations
  Clone ID: PAT_TA_75272.pep
PSSFAGKAVTDLPSSALFGEARVTMRKTAAKAKPVSSGSPWYGSDRVLYLGPLSGDPPSYLTGEFPGXYRWDTAWLSADPETFAQNRELEVIHCRSAMLGALGCVFPELLARNGVQFGEAVWFKAXGSQIFSEGGLDYLGHPGLVHAQSIL

SEQ ID NO: 180855 - protein, 204 aa, Triticum aestivum
  unsure (1)..(204): unsure at all Xaa locations
  Clone ID: PAT_TA_75273.pep
SALMQQKELAMSTDELLQAQVELYHHSFAFVKSLALKAATDLCIPDAIQHLGGAATLSDLAAETGIHPTKLSNLRRLMRVLTTSGVFSVTGDHAGAVYKLTRVSRLLVVDRACGRTHLSPVVSAFVSPYPVTTLFSMREWFTDERAAAMSXFEVAHGCTLWEAAAMDGTAFNAXMAADSRFTXENLLRECGSVFETVRGSLVDV

SEQ ID NO: 180856 - protein, 137 aa, Triticum aestivum
  unsure (1)..(137): unsure at all Xaa locations
  Clone ID: PAT_TA_75274.pep
MARTKQTARKSTGGKAPRKQLATKAARKSAPATGGVKKXPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 180857 - protein, 83 aa, Triticum aestivum
  Clone ID: PAT_TA_75275.pep
GGGSWTSASAAARRTLRLRRCRRSGSPPPPRPPSDPGCPYLTRAPALPQSRHRLNHARCTLSLSLSRSGAGIINFAESETGYG

SEQ ID NO: 180858 - protein, 75 aa, Triticum aestivum
  unsure (1)..(75): unsure at all Xaa locations
  Clone ID: PAT_TA_75276.pep
MRECISIHIGQAGIHVGNACCELYCLEXHGIQPDCQIPGDKTVGGXDDAFNAFFRETGAGKHVPRAVFVDLEPTV

SEQ ID NO: 180859 - protein, 173 aa, Triticum aestivum
  unsure (1)..(173): unsure at all Xaa locations
  Clone ID: PAT_TA_75277.pep
MAATAACRSMERRWSLAGSTALVTGXAAKGIGHAIVEELAGLGARVHTCSRKXAELDECRRQWEDKNLRVTVSVCDVSVRAEREKLMNTVRQTLGGKLDILVNNAGQSMVKAATECTGEDYALVMATNIESCFHLAQLAHPLLLRSGGGASSIVHVSSIAGFVGFPGLAVYSM

SEQ ID NO: 180860 - protein, 165 aa, Triticum aestivum
  Clone ID: PAT_TA_75278.pep
PREAVAWQQSGMVELQEELEAERRAAAEAASEAMSMILRLQRDKSEAMMEARQFRRFAEERFAHDASEVAALHDAIARRDASIQSLSEQLRVCRSRLIQLGFLSPSFLPSSPTAAAGDNLFADDYPSIQCLDYPAPSDVGTPRTHHMLYTMPGRDAHKGVICSSP

SEQ ID NO: 180861 - protein, 154 aa, Triticum aestivum
  unsure (1)..(154): unsure at all Xaa locations
  Clone ID: PAT_TA_75279.pep
SSAASSPAGHGKCLPPVLPPPAPPFFPHAARPTTSSPPALLKLTANTTTNARNSISFKLFACSSSSVTTTANSPAPTPVAAAAATTSPPTPSLELLGQQLAKGDYWQADETTRALLIVLAGEAARRXGYVFFSEVQFISLEDLRAVDALWLEHS

SEQ ID NO: 180862 - protein, 156 aa, Triticum aestivum
  unsure (1)..(156): unsure at all Xaa locations
  Clone ID: PAT_TA_75280.pep
QDARGRAARKSRHFKLAAWSVVAIALIAAMVPFGXPLLIFLHQTKKSREVRLGGRATPTGAPDIKDKAEQGKLSGSGSGSSSGSRNAQAQLQFFRADKAAGFDLDDLFRSTXEMLGKGRLGITYRVTLEGGAAVVVVKRLRNMGHVPRKDFAHTMQ

SEQ ID NO: 180863 - protein, 52 aa, Triticum aestivum
  Clone ID: PAT_TA_75281.pep
ARGLLLPPPPLIDQEKLQLSAMEPIPLLTPVQDGPVRPRSQGGASAADKAAL

SEQ ID NO: 180864 - protein, 130 aa, Triticum aestivum
  unsure (1)..(130): unsure at all Xaa locations
  Clone ID: PAT_TA_75282.pep
MVKAVVLGAAGGIGQXXLSLLLKISPLVDELSLFDVVNTPGVAADLSHISSPAAVDGTVAAXGDFKGEQPETEEAKKQALTGADIVIIPAGVPRKPGMTRDDLFKINAGIVQDLVVAIAKYAPKASIAII

SEQ ID NO: 180865 - protein, 33 aa, Triticum aestivum
  Clone ID: PAT_TA_75283.pep
LLLNYAFSSILLTDILLRNSIDLLPDTSASNYP

SEQ ID NO: 180866 - protein, 156 aa, Triticum aestivum
  Clone ID: PAT_TA_75284.pep
MASRAAAAAVVVLALVCAAQPSLSAATAAGGLSPDFHATTCPSLQQIVAFHVGEAFKNDSGVAPALIRILFHDCFPQGCDASVLIEGPGTEQDEIPNKTLRRVALDLIDRIRMRVHSACSRTVSCADITVLATRESLVLAGGPRFDVALGRRDSFF

SEQ ID NO: 180867 - protein, 116 aa, Triticum aestivum
  unsure (1)..(116): unsure at all Xaa locations
  Clone ID: PAT_TA_75285.pep
NGPASGSPPVTCVLCDGVMSWAYEAAKEIGVPCAALWTASACGFMAYNHYKQLXEDGLVPLKDEAQLTDRYLDTVVDRVPGMCDGFQLRDFPSFIRTTDRDDLMLNFLIRESARLT

SEQ ID NO: 180868 - protein, 147 aa, Triticum aestivum
  unsure (1)..(147): unsure at all Xaa locations
  Clone ID: PAT_TA_75286.pep
NHVAYTVGSDKHPAITTWVDDVTSAYFYLCVAHTGSLTTVHDESLSIDWVAYQKAPTGMLGGDLKWPAAWPAGVHCEDIPLFPAFDESVTPAIHATVNHRGSRTDXNEPTLVWVENVRANKFRACVHKVTVGPLTDSTSDAVHVSWL

SEQ ID NO: 180869 - protein, 148 aa, Triticum aestivum
  Clone ID: PAT_TA_75287.pep
FAGGRFVAQRKLGWGNFSTVWLAYDTLLSRFVALKIQKSARDYAHAALHEIELLSAAAKGDPTSSKCVIQLLDHFKHAGPNGKHICLVTEFLGDSLLRLIRYNQNKGIGLSRVREICRSVLTGLDYMHRELGIIHTDLKPENVLLVST

SEQ ID NO: 180870 - protein, 116 aa, Triticum aestivum
  unsure (1)..(116): unsure at all Xaa locations
  Clone ID: PAT_TA_75288.pep
VPASPPTLIHSHFSILCFLPPFNIAGPYXGYGATESHVENETVAPNATTFVDSNTHAASTTMSTHPDAIPLNADHDTAPPSAKRAKLWSEVAASSLPHTMASPSPPPPPSSLSVFP

SEQ ID NO: 180871 - protein, 157 aa, Triticum aestivum
  unsure (1)..(157): unsure at all Xaa locations
  Clone ID: PAT_TA_75289.pep
QPLDRSAGFVPKHIAADRLVVAEHPSLPRKPFVASFPSPAHPAPASSRGKPPTALHPHHNNDLLHRFPPPSRPPPPQAFSPEQALLLHEHPSLSTKLGRLLFPSPEQRAXPVRPLSREAPPPLHPPPGAAPPPCSRRALGRVDFNLCKLLFLFSSEQ

SEQ ID NO: 180872 - protein, 148 aa, Triticum aestivum
  unsure (1)..(148): unsure at all Xaa locations
  Clone ID: PAT_TA_75290.pep
AFQEGALGCVKDFLESCRGDRRALAPAFGLLRNMATFRYIAEIAVSAGFVSHVLXALGSDRASTRTEAAMALAELCSVSSSSKARNEAGGAMXRLIWXXEAKAVGERDAAARAXATLVVAASSHRKAFKKDEMGIVNAVQLLDPAVRG

SEQ ID NO: 180873 - protein, 138 aa, Triticum aestivum
  unsure (1)..(138): unsure at all Xaa locations
  Clone ID: PAT_TA_75291.pep
MAASLXAAATLMPAKIGGRASSARPSSHVARAFGVDASARITCSLQSDIREVASKCADAAXMAGFALATSALLVSGASAEGAPKRLTFDEIQSKTYMEVKGTGTANQCPTIDGGVDSFPFKAGKYEMKKFCLEPTSFT

SEQ ID NO: 180874 - protein, 90 aa, Triticum aestivum
  unsure (1)..(90): unsure at all Xaa locations
  Clone ID: PAT_TA_75292.pep
NGHIEYAGCGSGCGGNMVIESSHERNTKSGGCGSGCGGGGCGGMAIEGSKAGIAKSSGCGSGCGASCGGMVAEGSKTGLAXSGGCGSGCG

SEQ ID NO: 180875 - protein, 81 aa, Triticum aestivum
  Clone ID: PAT_TA_75293.pep
TKLTPHSSSLERTKRTSNSERCRPSNTARALAAAAGEAGRRLGADSHRLHRHYQPRRVMSALHCFPVERNGSCSALLVARP

SEQ ID NO: 180876 - protein, 149 aa, Triticum aestivum
  unsure (1)..(149): unsure at all Xaa locations
  Clone ID: PAT_TA_75294.pep
IDPDHSNKKKIDLTPLPWSSSMPSPSSSSSCMVRSMYGGGFHRWAGCPCSGCKAGGACNTSSSGGNGAHPHGRHGRVPACTAPCPSTSRTGPPMPRRVLIVGPSLTSSMTSSLTYNSGGIATXHAAERASISSRPSHWARLYFSFRNMY

SEQ ID NO: 180877 - protein, 126 aa, Triticum aestivum
  unsure (1)..(126): unsure at all Xaa locations
  Clone ID: PAT_TA_75295.pep
MSSLEEALLQKPPPSVVVCHHAAAACHHEGCPGCAMDRRKESLRGRIPYKELFFVAATTLARSLPITCLFPFMYFMVRDFNIAXREEDIGSYAGFLAASYIIGRAITSIFWGIAADRLGRKPVIVF

SEQ ID NO: 180878 - protein, 64 aa, Triticum aestivum
  Clone ID: PAT_TA_75296.pep
NCAAVAPHSPSQHRSPSPRIIAARCRRLGSPTRTIAARPVPSPPAPSSSTAPPPLSLVRYLLSP

SEQ ID NO: 180879 - protein, 141 aa, Triticum aestivum
  Clone ID: PAT_TA_75297.pep
NQGISDDTLTLRCTITVLKDIQIPRIPAEGIIALPSTNLHQHLGALLQSETGADVTFIVCGESFAAHKDILAARSPVFKAQFFGDMKEKCSVRLEVEDMEAAAFRAMLRFIYTDTAPELDQPLEEGTAMAQHLLAASDRYE

SEQ ID NO: 180880 - protein, 182 aa, Triticum aestivum
  unsure (1)..(182): unsure at all Xaa locations
  Clone ID: PAT_TA_75298.pep
AGKGIPVVPCGLVAWSLFNDTYSFARRPRRAGGIGGGEALRVIKSGISWRSERERLFGKHVYPKNFQNGSLVGGGRLDPRKPXSEQEELIVWMRTAAXPRFRKLYGRVEADLDAXETXAVAVRNSYNTYSFEGGKAVVLSTAGPLGGRNAFLGRAYLVTGMACLVLALLLTLVCLFFPVTEE

SEQ ID NO: 180881 - protein, 98 aa, Triticum aestivum
  Clone ID: PAT_TA_75299.pep
PPTSCSRQPLAMRSFRPRHLRPALPPPAAGQLPSLDPAVSSPSSPQSLALSLLAGSAEEIQFRVALAECVCPRLTPWQGNLQHDWIGVNCAFHGGDVV

SEQ ID NO: 180882 - protein, 183 aa, Triticum aestivum
  unsure (1)..(183): unsure at all Xaa locations
  Clone ID: PAT_TA_75300.pep
GSLHHLIGTKLPTHRAFLRLARRHGPLMLLRLGQVPRVIVSTPEAGMXGVLKVNDLTFASRPSGPTXDIVSCGGKGLIFAPYGDHWRQMRKVCIMELLSTRQVRRIDSIKQVEVTHLVQSVAASSSAIIDIGKELARLTNNIISRAALGGQCRLHEAYLRELDVLASLVGGFSLVELFPSSRL

SEQ ID NO: 180883 - protein, 116 aa, Triticum aestivum
  unsure (1)..(116): unsure at all Xaa locations
  Clone ID: PAT_TA_75301.pep
AEEDKEKKEEELVTGMEKVSVEEPEVKKEEHVDXEKKETLFSKLHRSSSSSSSSSDEQEEEVIDDHRKVIKRKKKKGLKEKLQEKLPGHKDTEGEHVTGLPAPADPASVQTHHDTD

SEQ ID NO: 180884 - protein, 97 aa, Triticum aestivum
  unsure (1)..(97): unsure at all Xaa locations
  Clone ID: PAT_TA_75302.pep
CGVASFGGYLLDRNVITMSLAPKDEHEAQIQFALERGIPAFLGVIGTQKLPFPDXAFDVVHCARCRVHWYANGGKPLLELNRVLRPGGFFVWSATPV

SEQ ID NO: 180885 - protein, 79 aa, Triticum aestivum
  unsure (1)..(79): unsure at all Xaa locations
  Clone ID: PAT_TA_75303.pep
SRVSVERKGDPWLETEYRCFVGGLAWATDDNNLQQAFSQYGEILDAKIIKDRETXRSRGFGFVTFGSDESMRQAIEEMN

SEQ ID NO: 180886 - protein, 59 aa, Triticum aestivum
  Clone ID: PAT_TA_75304.pep
APKAAASNSPWYGPDRVLLPTARSTSEPPSYLSGQFPGDYWWDTAGLSADPETFAENRE

SEQ ID NO: 180887 - protein, 146 aa, Triticum aestivum
  Clone ID: PAT_TA_75305.pep
RSTSSSPNPQPRSARRPKPGSQSREAGEIDGAYQAERARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAK

SEQ ID NO: 180888 - protein, 156 aa, Triticum aestivum
  unsure (1)..(156): unsure at all Xaa locations
  Clone ID: PAT_TA_75306.pep
HGKLVHDLKVQAGCGEISSFQXSMCAHMWRAVTRARXRLAADATTTFRMAVNCRHRLRPKISPVYFGNAIQSVATTATVSELASHDLGWAAAKLHTTVVAHEDGAIRQAXAADWEAAPRCFPLGNPDRAALTMGSSPRFPMYDGYDFGWGRALAVR

SEQ ID NO: 180889 - protein, 154 aa, Triticum aestivum
  unsure (1)..(154): unsure at all Xaa locations
  Clone ID: PAT_TA_75307.pep
AQPPTRLPRRRCQTERSSRTSRRPSRGARTVEGAGTLRNNRHVHEILFLCLQXPRARSPSFSRRITARLEAARTPATALRSLLLVHRLLRAGDRYFEQDFRGLWASRDLRVDAPRCGCSCSTSSATVTATGACSFLHGYTAYLEERMQWVINQS

SEQ ID NO: 180890 - protein, 72 aa, Triticum aestivum
  Clone ID: PAT_TA_75308.pep
GAPCACGASPALVIRSYSPSLPVAVTTVSVEYPYALKPPLRGGREVLALHCGGTGGGGASPPPWPPADRLAS

SEQ ID NO: 180891 - protein, 154 aa, Triticum aestivum
  Clone ID: PAT_TA_75309.pep
RRLAEEGVLPRVEARALCRGSNKEKHINLHWCHAKTRESAQAAREGREIQRKHAEKRRLRHGFDGKAAELRAQAGGSNSANYSPPEHHWAAPQRKESQSPAVEADEDEPPPPPAGVRPEAPHRRQGAGGAARVWIPGAGTRLGFGSGGAARRRG

SEQ ID NO: 180892 - protein, 122 aa, Triticum aestivum
  unsure (1)..(122): unsure at all Xaa locations
  Clone ID: PAT_TA_75310.pep
GGDEERYDGFEGAGGPANFGXVARLVSDKRTKELVAVKYIERGKKIDENFAREIXISHRSLRHPNIIRFKEVCVTPTHLAIVMEYAARGELFERICTAWRFSEDEARYFFQQLLSGVSYCHS

SEQ ID NO: 180893 - protein, 33 aa, Triticum aestivum
  Clone ID: PAT_TA_75311.pep
AHSDHERLLALTAFDDTKAGVKVPCRCWGHRRP

SEQ ID NO: 180894 - protein, 150 aa, Triticum aestivum
  Clone ID: PAT_TA_75312.pep
APDKLLHGLGGGRRLGLGRGGDGGLLDGFHGFGRLPPRRPRRFSPPAGPPRPPPGPGARPRRPPPPVPRPWAPPRQPPPPVPPSWAPPGQAPRPWDRPGPGPSPWGSSWAGSSALGSLLSALGASPSAATSLLAGSSVLAGSSAAGVGGG

SEQ ID NO: 180895 - protein, 66 aa, Triticum aestivum
  unsure (1)..(66): unsure at all Xaa locations
  Clone ID: PAT_TA_75313.pep
MPTVLRAPRVVAILAVVLAAALATAVNAQQCGSQAGGATCANCLYCSQFGYCGKXDAYCGAGCQSQ

SEQ ID NO: 180896 - protein, 95 aa, Triticum aestivum
  Clone ID: PAT_TA_75314.pep
RYYSLRNMWNRAALGTHMQLCSMFSVPPLLPPPRRVVVVGSGARVVLELHLDLHPPAETAVVGLSHYDGGLAICSTGRWDCVDLLQLHPRGRRWE

SEQ ID NO: 180897 - protein, 147 aa, Triticum aestivum
  Clone ID: PAT_TA_75315.pep
AGEAQASLLSRTPSKARVSINLQDNEISLDRSGKLGSPRARKPQSRLTQVVVGGLDASRRLGRVEEVLRETGADIIGLQNVRAEEERGMRPLSELAGALGMRYVFAESWAPEYGNAVLSRWPIKRWKALRVADQSDFRNVLRATIEV

SEQ ID NO: 180898 - protein, 100 aa, Triticum aestivum
  unsure (1)..(100): unsure at all Xaa locations
  Clone ID: PAT_TA_75316.pep
MGNALPCLVDQAVKALPAAAKPRRRXLYSLKLLMRVLHRMKRTPRGNEIGGXSSPESDSEVGGAGVKSVKASHGQASPRRAAAGGGGGQRKGVVRVKVLL

SEQ ID NO: 180899 - protein, 86 aa, Triticum aestivum
  unsure (1)..(86): unsure at all Xaa locations
  Clone ID: PAT_TA_75317.pep
SESSCEAVRQACTVLVKRLKPIKEGLEAKSGAPVPWSTLIAQANXASVNLSAHAFWTPDPAFVKYINYGAAVREVEIDVLTGGTTI

SEQ ID NO: 180900 - protein, 159 aa, Triticum aestivum
  unsure (1)..(159): unsure at all Xaa locations
  Clone ID: PAT_TA_75318.pep
MAATTTMALSSPAIKLAXPSYALGGGGRITMRKAAPKASASNSPWYGPDRVLYLGPLSGEPPSYLSGEFPGDYGWDTAGLSADPETFAKNRELEVIHCRWAMLGALGCVFPELLARNGVKFGEAVWFKAGSQIFSEGGLDYLGNPSLVHAQSILAIWAC

SEQ ID NO: 180901 - protein, 109 aa, Triticum aestivum
  unsure (1)..(109): unsure at all Xaa locations
  Clone ID: PAT_TA_75319.pep
PSSRLVRWLSSEERRIKSSLDLMQRIITDILVERNAVRAAGNGDEGLLDVLLTCQEEDSLESPLHATEIXTVLFDIFGGATDTTSTTFEWAMSELVNHPVAMAKAQLEA

SEQ ID NO: 180902 - protein, 145 aa, Triticum aestivum
  unsure (1)..(145): unsure at all Xaa locations
  Clone ID: PAT_TA_75320.pep
HKAVSALVGIDALSVDIAARKMTXIGMVDPVXVVSKLRKAWSASIDSVGPAKEPEKEGEKKDGDGKKDGADAXKEGEGEKKDGDGXDGAKKDDGEAKPPQPTEEQLMAELMNQYRSAYSAYHNPYINSHYVVQSMEENPNSCAIC

SEQ ID NO: 180903 - protein, 115 aa, Triticum aestivum
  Clone ID: PAT_TA_75321.pep
VGFVVYYDVLINDSTNAGFEDDASKNDQTREHDVLAFILGAKKIIWCLISSGCSVETWLSDCGVTCESYTSNNQTHTSLSTPSWSISHRRPARATMCRLARPSSSTHEGHGQQRR

SEQ ID NO: 180904 - protein, 170 aa, Triticum aestivum
  Clone ID: PAT_TA_75322.pep
KFNNEIACPQGQWRSEPAHNTKPGLGCVGAPDCIAAPWNRDNHLGNGRDGYTNTYNWTIPSCVVSENCVLRLRYNISTTDYDGWNTFASRNGASLSPVKQDPYVNPFNLTRDGEFGNLTLAIDTSQFGRTFQDRSHIFAIRKRPSGIDSDARIFNLNVRGQRGNIVQAYP

SEQ ID NO: 180905 - protein, 34 aa, Triticum aestivum
  Clone ID: PAT_TA_75323.pep
AADACHSLRNATSMQRVPEHPRSTGHTYVFSAPA

SEQ ID NO: 180906 - protein, 76 aa, Triticum aestivum
  unsure (1)..(76): unsure at all Xaa locations
  Clone ID: PAT_TA_75324.pep
MSCNCGSXGCSCGSDCKCGKMYPDLTEQGSAAAQVAAVVVLGVAPENKAGQFEVAAGQSGEGCSCGDNCKCNPCNC

SEQ ID NO: 180907 - protein, 85 aa, Triticum aestivum
  Clone ID: PAT_TA_75325.pep
TVRERQVGSVAIFSEYCVAYSMALVRLFVLQAALITVISPISLEPQESWQASSLRCNTGAADAYPASQPASGNGGTRGRQPRMHA

SEQ ID NO: 180908 - protein, 137 aa, Triticum aestivum
  unsure (1)..(137): unsure at all Xaa locations
  Clone ID: PAT_TA_75326.pep
MAPKAEKKPVAXGERAPAGKKPKAEKRPPASKEGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 180909 - protein, 186 aa, Triticum aestivum
  Clone ID: PAT_TA_75327.pep
MRILNSRVIAEGLMSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPTHGIQVERDQLNKYGRPLLGCT

SEQ ID NO: 180910 - protein, 33 aa, Triticum aestivum
  Clone ID: PAT_TA_75328.pep
GAQVGGDRDVPLPAEGPHEQVARPATAARATAG

SEQ ID NO: 180911 - protein, 43 aa, Triticum aestivum
  Clone ID: PAT_TA_75329.pep
IVFGPAMSTNVARVLVCLEEVGAEYEVVDIDFKAMDHESPEHL

SEQ ID NO: 180912 - protein, 179 aa, Triticum aestivum
  Clone ID: PAT_TA_75330.pep
RVSSPVSTGCRCRRKPELVVVQAPDTPPCRLDKFVGYDNDGDSADSGEALKKPTVAVLGDGGLGGKLITSATDIIIDLRTKKRPDKVLLPPIVTRPKPARRTPEELLDLEDKHIDTLARAAQRATTPFSDEQSKVAKPRRSVSSSARRLRTRGNTPRVASCKKSKPPAPAPAPSPAREK

SEQ ID NO: 180913 - protein, 94 aa, Triticum aestivum
  unsure (1)..(94): unsure at all Xaa locations
  Clone ID: PAT_TA_75331.pep
PDKHHFESRPTPCASKTYPQHAGAIRNGGHIVXNARPCNVVEVSTSKTGKHGHAKCHFVAIDIFNGKKLEDIVPSSHNCDVPHVDRQDYQLIDI

SEQ ID NO: 180914 - protein, 184 aa, Triticum aestivum
  Clone ID: PAT_TA_75332.pep
RPARGGQRKRRGDHRAQRAHRTAGAAISHRSGRMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDQLGLHSLRQR

SEQ ID NO: 180915 - protein, 168 aa, Triticum aestivum
  Clone ID: PAT_TA_75333.pep
LPHKLSSKVEHTPIDCTPEAETELDSTSTKKKAKRKKKKVVPTSDSSTHSANTTVESAAESVVDPDDDMPVLEPCIDEESLSETDDAAVFLLPSATEPFRFPGSRAFPQGLPSGNSDTTAAQRNALTHAALLKADALSQQAPAKPYTYSIPRAAYRTAECALGPSAME

SEQ ID NO: 180916 - protein, 109 aa, Triticum aestivum
  Clone ID: PAT_TA_75334.pep
RYTYISDHDASIPRKLARTTCMRPPRASSRRLPPRGATGGSLPPARSGSPTPGRTRRAYLCGGGRPLLRSPRAGRPPLLLLHLELAPSAIGQQEGVGARVGGRERRKQM

SEQ ID NO: 180917 - protein, 154 aa, Triticum aestivum
  unsure (1)..(154): unsure at all Xaa locations
  Clone ID: PAT_TA_75335.pep
GQRVTKLDPEDEEQESFPLTDHKYNCAFPSTNPEGTKLVFRSSRDRVHGGKREDKNLFIIDAEKVGAXGVDQLTDXPWTDTHCSWSPREGCDWIVFSSSRGKPGGAPVSDHGLDSGYFSVYLVNAKDMGVVPVPVPVRVIHSAPTIAGHVNHPV

SEQ ID NO: 180918 - protein, 106 aa, Triticum aestivum
  Clone ID: PAT_TA_75336.pep
SCGTCWELAAPSYVERREPAGVIQAKKKSMTPSPQLPPNPSPTRSCRQIHPRRTTGEQSNLKPPWSRRERNRSQPAVAADPPMDPSNPCLLTSLHGAAKNTRFEPA

SEQ ID NO: 180919 - protein, 72 aa, Triticum aestivum
  unsure (1)..(72): unsure at all Xaa locations
  Clone ID: PAT_TA_75337.pep
EIQKAEHWGTLIFKKLHARIKASKFHLVPHLLLYGLLSLFDLLFRYVLLTLXNXLGESEKNKFCKLRHISMF

SEQ ID NO: 180920 - protein, 58 aa, Triticum aestivum
  Clone ID: PAT_TA_75338.pep
TGTPALRDRDLDSGPPPAGAAARHSPAATTRLCSTVYGIANSRMSDSMAYDKELMLKG

SEQ ID NO: 180921 - protein, 192 aa, Triticum aestivum
  Clone ID: PAT_TA_75339.pep
APAVALHSNSGISAALHCSADQGASLQLRRSPQRSTAAPAASLHCKSGDPRGVSLERRSCSIVAPTKLQQPHGASLKVRRASLQVRRHFNQLRRRFTAAPAAPCCFIATPASPLYFTCCTQLPPAMTAASAQPSLRQHEVSGDSDLQQRCSDTRRRQFVAAVQQRVVVAALVYDDGQRRWCVGRCGEGRRRG

SEQ ID NO: 180922 - protein, 43 aa, Triticum aestivum
  Clone ID: PAT_TA_75340.pep
PREDLQGDLISGGQESASGGNDQGEASSRNLISTLPCAPKFAS

SEQ ID NO: 180923 - protein, 41 aa, Triticum aestivum
  Clone ID: PAT_TA_75341.pep
CRSPLLPGTAPALAERSRSPARRASVAPLSVLLTCQIQTRC

SEQ ID NO: 180924 - protein, 173 aa, Triticum aestivum
  Clone ID: PAT_TA_75342.pep
AGLIAVSNINEKKLVAPGSIARSILSEQKLRAVLENARQIVKIADEFGSFSQYCWGFLNHKPVVSKIRYPRQVPVKSPKADMMSKDMVRRGLRGVGPTVIYSFMQAAGLTNDHLVSCFRFKECKPSPSLAMSDADRAKTEAEQKLEEPRTKAHGEEMTVNSDPSIAIDTLTIS

SEQ ID NO: 180925 - protein, 211 aa, Triticum aestivum
  unsure (1)..(211): unsure at all Xaa locations
  Clone ID: PAT_TA_75343.pep
LANYSLDTTASPVSFFELLGVLENLKGVTSPQVASQCVLQAYASGNVQLVNGTDAGKLSQFRAHFXSTDQDKGCNFAAYVPSEEDTPLQRAEWIKYLGTFTNSEDRANAVYDAIKTNYLCLSKAAAALSTRFKPVVAWVEFTEGVWTFVRESYKLQYVKDAGAEIVDATITDQRFNGSDPEDMDSLHAILCTVDVVIDQTYASDPAEYKLS

SEQ ID NO: 180926 - protein, 168 aa, Triticum aestivum
  Clone ID: PAT_TA_75344.pep
AGSISYGHRVKFPKVKCHENGRGQAKNFTFSDGNFNVSIPSDGRVPYYFLTQKDQNSTYFFRFEKIFEIFEDKKGNYHKVPFSSIKLNTLKWKVSVTNDSFTFTGIKQHGFQRHRFESVSLVNTFSSGKDSNGICSGSVLQKCNANCLAFCRNVSECALGCDFGKDRN

SEQ ID NO: 180927 - protein, 38 aa, Triticum aestivum
  Clone ID: PAT_TA_75345.pep
RLGLPTIDIASNSWGLIPLLYTVQTIKWLLALHVPAAR

SEQ ID NO: 180928 - protein, 137 aa, Triticum aestivum
  unsure (1)..(137): unsure at all Xaa locations
  Clone ID: PAT_TA_75346.pep
RIINEPTAAALSYGMNNKEGLIAVFDLGGGTFDVSILEISNGVLEVKATNGDTFLGXGEDFDATLLNYLVSEYKNSDNIDLSKDKLALQRLREAAEKAKVELSSTPQTEINLPFIXADASGAKHFNIXLTRSEFESL

SEQ ID NO: 180929 - protein, 76 aa, Triticum aestivum
  unsure (1)..(76): unsure at all Xaa locations
  Clone ID: PAT_TA_75347.pep
MSCNCGSGCSCGSDCKCGKVYPXDLTEQGSAAAQVAAVVVLGVAPENKAGQFEVAAGQSGEGCSCGDNCKCNPCNC

SEQ ID NO: 180930 - protein, 139 aa, Triticum aestivum
  Clone ID: PAT_TA_75348.pep
MPCLSYHKTLLVVLDSAVWPPLASKIKIGKGTELLKKVAATCKNKTSVVAARLLVLVSLRRRMATVGAFSHRIHALVAAADRENGARVDCNKALMVRKVRKTPTLHGGEVVVNISHQLALFDQGNDGDGGCTDWTLHPI

SEQ ID NO: 180931 - protein, 116 aa, Triticum aestivum
  unsure (1)..(116): unsure at all Xaa locations
  Clone ID: PAT_TA_75349.pep
MERSPSLGSQCTHTPQVSTSVVEPYNSVLSTHSLLEHTDVSILLXHEAIYDICRRSLDIEXRPTYTNLNRLVSQVISSLTASLRFDGALNVDVNEFQTNLVPYPRIHFMLSSYAPS

SEQ ID NO: 180932 - protein, 102 aa, Triticum aestivum
  Clone ID: PAT_TA_75350.pep
ASGEYSPACRRACLGEGGSSPQSQGGGGGGVKEASRRWQRWGWRRSQVDGGGSYLSLGNWTVMAVIQDAAHCSGSPHLSHEKSSTAPNDGKYHCSCFLKSFA

SEQ ID NO: 180933 - protein, 73 aa, Triticum aestivum
  Clone ID: PAT_TA_75351.pep
TCCSGYVGRCAHWSRLGVSAGAPPPISAWVAYVRVRGALAVRRPPPPPPPISLPSSLFSGEVADGLCGCGCGA

SEQ ID NO: 180934 - protein, 114 aa, Triticum aestivum
  Clone ID: PAT_TA_75352.pep
SSFVTFSSMGRRRKIMNPEQNAYRLRQATCTYSKTRSRTRSTACSSSRHAATFAPLYSFLAEHRATGLLDEPDIEIATACHLIRPPGRPAAPRAAKTFAWRSVARSASIDNLAR

SEQ ID NO: 180935 - protein, 139 aa, Triticum aestivum
  Clone ID: PAT_TA_75353.pep
EIRELKQEYGSFYGFHGSPIGNWHSILRNGLTNKAYAQAFGPGIYLARDAATSVGYLYRGGMGSGTSNWPGSDIGTTDLKCMAMCEIIDWSSKEKSQHCRGEVHKIGCHHNKSSPYIRVENDHLLITRFFFVWNKTTNP

SEQ ID NO: 180936 - protein, 112 aa, Triticum aestivum
  Clone ID: PAT_TA_75354.pep
MADTVTLVSNDKEGDAVSLTVSRKAIELSVTVKNLLQEMPDDDDAVGPIPLPNVSGPVLQKVIEYVTHYHENPDPEAEKKTDAEKRSAEIPEWDKNFCAGLNMEGLFNLILA

SEQ ID NO: 180937 - protein, 33 aa, Triticum aestivum
  Clone ID: PAT_TA_75355.pep
GGASLQSPVHKMATVSDSLVWELVRKNNCFLIK

SEQ ID NO: 180938 - protein, 67 aa, Triticum aestivum
  unsure (1)..(67): unsure at all Xaa locations
  Clone ID: PAT_TA_75356.pep
TSGSPGLQVKQWLVPLLEGKIRSGFAMTEPQVASSDATNIECAVSMQADFYVIHGRKXGWTSGAMDP

SEQ ID NO: 180939 - protein, 100 aa, Triticum aestivum
  unsure (1)..(100): unsure at all Xaa locations
  Clone ID: PAT_TA_75357.pep
HAGNDGCEGCAEXVYTCSSPLCGCCAGGLKNFEELKLVRNSSSAVYGRYKIMDDQTEILDECGPDXFIMKQSGDAVLECDLPTNSGQVDERMELNVVEKE

SEQ ID NO: 180940 - protein, 152 aa, Triticum aestivum
  Clone ID: PAT_TA_75358.pep
GELVEGKVVTEQAGDLVVGILTLNGKVGNRALVGAQVGRLAEETVRAALGEHAGHKVQEARRLLVPDALLVLALLDREHLELVVVEHNLDQGNTLVALPQRQAELVVGRKRVPTQPSVRAEVGLANARRGNRGSVDRDREALGSEVVAAGID

SEQ ID NO: 180941 - protein, 176 aa, Triticum aestivum
  unsure (1)..(176): unsure at all Xaa locations
  Clone ID: PAT_TA_75359.pep
AGSDFGIARMFGGDQTTAYTLKVIGTYGYMSPEYAMDGVFSIKSDIYSFGVMVLEIVTGKKIRGFYDTELDLNLCGYAWMLWKEGRSTELLDDAMGGSCDHSQVRRCIQVALMCVDVQPRNRPMMSSVVMMXAGENATLPEPNEPGVNLGRNRTDTGFSETQSEFTVTTTDTAHSS

SEQ ID NO: 180942 - protein, 181 aa, Triticum aestivum
  Clone ID: PAT_TA_75360.pep
MWALIARHFPGRTDNAVKNHWHVVRARRSRERCRLLAKAASSTFPSYYSGGAQLDFAGASAGSFCFGFSKPSGGGFFGSPPAAAAVAPSSTPVLFNGYGASGNQSLLSRYSSYLDGGKQPAAPSSHSIAFSSPPSREALAFDGRGGPNHQHRKDYHVDGNKPLKTKDAPPFIDFLGVSVSS

SEQ ID NO: 180943 - protein, 151 aa, Triticum aestivum
  Clone ID: PAT_TA_75361.pep
GGSGARLKHVAVGWLVGMVVVIAAFTALFGGWHAYRRWYAVGGAGEYESGAWPWRLTAFQRLGFTCADVLACVKEANVVGMGATGVVYKAELPRARTVIAVKKLWRPAATDGDAARNLTDDVLKEVGLLGRLRHRNIVRLLGYMHNDADAM

SEQ ID NO: 180944 - protein, 123 aa, Triticum aestivum
  Clone ID: PAT_TA_75362.pep
MANAPGASLGPVPFADVEADSGLVSGVPEQLPEEHADADLVSALPSAPIAMGISNLRFYEGCWLPEWSVPAAVALQRRFEPRRDDVIVASFPKCGTTWVNALTFATIARRAYPAAGAGHPLLR

SEQ ID NO: 180945 - protein, 33 aa, Triticum aestivum
  Clone ID: PAT_TA_75363.pep
DTFRNTPQARFLSTLSVVKGECASLITAKHIHA

SEQ ID NO: 180946 - protein, 124 aa, Triticum aestivum
  unsure (1)..(124): unsure at all Xaa locations
  Clone ID: PAT_TA_75364.pep
MEEAKNGEKGVDWQMSAAGQSNVATSTSMERIFWASYEDLPSDLXSCFLYLAILAKSGVMDVEVIVRMWIGEGFIKPHKGNTMEELGHKYLKELALRCLVGIESRNNEDDIRDVKVHKSLIAFL

SEQ ID NO: 180947 - protein, 161 aa, Triticum aestivum
  Clone ID: PAT_TA_75365.pep
SLWASASTPLRMASSSSHSVAAMIAITTSRGQSLMDLEKKLKDIRKHIRSSSKGLVTTSTGELFCGGPDYGQTSRAVADELARRMARVVHEIFTMPFPTVAAVTGDVRSSLALALVLAHDDTATMEKAKFEVKEVQDGRVCMPPYVAALLRDKAAFPRMRS

SEQ ID NO: 180948 - protein, 154 aa, Triticum aestivum
  unsure (1)..(154): unsure at all Xaa locations
  Clone ID: PAT_TA_75366.pep
QVNLKFLLFFKAMSGLKINFDKREVVILGFSTKEQXRIVDNLNFKLAMFPITYLRMLMADTKILMSAFDPLVRRLASWAEPWRGPLTGQLTSNGSKSVLISSNLASLSMYICETTRPETSKSLCVRTIPRSCWSTRYINVYFKVQSHLLYYIEI

SEQ ID NO: 180949 - protein, 133 aa, Triticum aestivum
  unsure (1)..(133): unsure at all Xaa locations
  Clone ID: PAT_TA_75367.pep
RVVQILRQNGPFVVLHLRYEMDMLAFSGCTHSCSNEEAEELTRMRFAXYPWWKEKVIDSKAKRKDGLCPLTPEEIAMVLKALDIDRHYQIYIAASEIYCGQRRMAALTSAYPNVVRKETFLPSGLRFFQNHSS

SEQ ID NO: 180950 - protein, 118 aa, Triticum aestivum
  unsure (1)..(118): unsure at all Xaa locations
  Clone ID: PAT_TA_75368.pep
MDFNAKLYGFGLVXQLTHDVTSHSTDVVIGTQAYMDPXTSAQARYTRESDVYSFGVLLLEVVCGVPPILIGNDMNSLIKMVRECDRRIAILSAAHQQLRGEYDEEIKGALLIGLRYVE

SEQ ID NO: 180951 - protein, 86 aa, Triticum aestivum
  Clone ID: PAT_TA_75369.pep
NARSWRSSSCEPLHRECRDEMADLAHCQKVTHSLMAPMAPMTADKLMVAGARTSNFRPYIGATTALLSGLVSPRTSTQQEERNGWI

SEQ ID NO: 180952 - protein, 90 aa, Triticum aestivum
  Clone ID: PAT_TA_75370.pep
IGTRRETCRRWSSRRRSRRRSSMLHRLRLPAAVLTSSCFEHHLGIFRVSNGCLFAITGALDQNELMLEYVLEAFVTSVQAILRGQTDKRT

SEQ ID NO: 180953 - protein, 117 aa, Triticum aestivum
  unsure (1)..(117): unsure at all Xaa locations
  Clone ID: PAT_TA_75371.pep
KNETGLDWIVSRIISLLPXPFVPAAELLTDDHFSLTSSDSEDAAAATDRHAMQDGGGQDHISDLAXDDLLSNIVSRLPTKEAARTMVLSTRWRCVWAATPLLLDDAHLKAGLGNFNA

SEQ ID NO: 180954 - protein, 112 aa, Triticum aestivum
  Clone ID: PAT_TA_75372.pep
SILWQDWDQRERPCAPHEEISRPPPLQSPLLPWTLAGAPSIRTRYRYCISPPLPSTRQMSIQGNEVSLPIELGLFLAVVSKKWESRFCVSSLHQSFASSLTMFILGTMHPWR

SEQ ID NO: 180955 - protein, 134 aa, Triticum aestivum
  Clone ID: PAT_TA_75373.pep
SAGDGRYSACASSSVQCAGVQVGSFPVGCLSGNLSANCVPYVCPGGCSGHGSCSQLTCTLATRATRAPTAPSTLTTSASRSTAKSCATPHRPAATAASRSWRRATPSTSFSSLPPISAPPSASTPLKTAAIASR

SEQ ID NO: 180956 - protein, 94 aa, Triticum aestivum
  Clone ID: PAT_TA_75374.pep
TGDISSDHCFKSRWNVDGYEWEIRIYPRSRESNHVNGRCVALHLIFLSEARMGAVRTTLRCCLVDPRGIFKPSREDRRSLTFRKPQDTSYTVIL

SEQ ID NO: 180957 - protein, 131 aa, Triticum aestivum
  Clone ID: PAT_TA_75375.pep
MLSYGILKYITNSFSNEIGRGGFGVVYQGDLENWVVAVKIFKTHNADRQFLDEIRCLKIANHKNIVRFLGYCSDIQEEVTTSDGVPVLAGHYKRLLCLEYVPKGNIRQYLRQEKPHPEDWPARYKMIRGIC

SEQ ID NO: 180958 - protein, 134 aa, Triticum aestivum
  unsure (1)..(134): unsure at all Xaa locations
  Clone ID: PAT_TA_75376.pep
SLEEWLTENRYGRFANLVETAIDLGQVDNGEYRISPLYSSDLAVLKDELSEVENHINNLHMHTATDLDLSVDKQLKLEXGPFGHVFRISKKDEQKVRKKLTTNYIIIETRKDGVKFTSAKLKKLGDQYQSLLGD

SEQ ID NO: 180959 - protein, 157 aa, Triticum aestivum
  unsure (1)..(157): unsure at all Xaa locations
  Clone ID: PAT_TA_75377.pep
STHYHFSADVGSEASPVGLPGRVFIGKLPEWSPDVRLFTTXEYPRXKXLRDXDVHGTMGLPVFEKGSYSCLGVMELIMTRQKLNFTSEINDICRALQAVNLRSTEVSSTPRATKFNSASYKDALPEILEVLRAACVTHNLPLAQTWVTCAQQGKGGS

SEQ ID NO: 180960 - protein, 154 aa, Triticum aestivum
  unsure (1)..(154): unsure at all Xaa locations
  Clone ID: PAT_TA_75378.pep
KKKAGFDIMDLDTIQVAKRCFVPALFGHATEDDFILPXHSDKICEAYVGDKNIIXKFDGDHNSPRPQFYFDSITIFFHNVLNPPDVPDDHYFLTPHGSLGQGHWDTEHDIEYRIAQSPTAPSTTTEDAIAQLRSRRLMSRMEVPSGTATEGRAD

SEQ ID NO: 180961 - protein, 89 aa, Triticum aestivum
  Clone ID: PAT_TA_75379.pep
PVLALPDFSRPFCIETDACDTGVGAVLVHDAHPVAYLSKALGVRNQRLSIYDKEFLAVIMAVEKWRHYLQRAPYVIITDHKSLCSLGDQ

SEQ ID NO: 180962 - protein, 157 aa, Triticum aestivum
  unsure (1)..(157): unsure at all Xaa locations
  Clone ID: PAT_TA_75380.pep
LKGSSLGRSTDKVKIDENTTLKDLDLNYSFYXSEPSWRDALLKQIEIDSEFLKXQGIMDYSLLLGFHYRARQSLVRGGSLPESILQENKLAVLSEQDAMEDGSAYXYREGLVLVQRGSNQDGKVAVGPHIRGSRLRSSSACYEEVDLLLPGTARLQI

SEQ ID NO: 180963 - protein, 77 aa, Triticum aestivum
  Clone ID: PAT_TA_75381.pep
PTPTHTHSLATEDTRSAVTMAGGYGGAGGNLKNMVIGLPRPAPVHPLLPHLRPLPRRPQRRPGVLVVRRAPAPPRQA

SEQ ID NO: 180964 - protein, 126 aa, Triticum aestivum
  Clone ID: PAT_TA_75382.pep
HTKDQGYIILWSQTCMHAWRMHGTAWVTRHRANLTPTLRNPRRRSPKSRTRPRQLHVLVLRPWPLAETTRCNCFLLLARRRRRLGLGSMLRLDRWRCDVNTAARHQGATDRRRWWCGWWWDQSRAT

SEQ ID NO: 180965 - protein, 112 aa, Triticum aestivum
  unsure (1)..(112): unsure at all Xaa locations
  Clone ID: PAT_TA_75383.pep
MEGKEEDVRLGANRYSERQPIGTAAQGGGADEKDYKXSPPPAPLFEAEELTSWSFYRAGIAEFLATFLFLYISVLTVMGVVGNPSGSKCGTVGIQGIAWSFGGMIFVLVYCT

SEQ ID NO: 180966 - protein, 167 aa, Triticum aestivum
  unsure (1)..(167): unsure at all Xaa locations
  Clone ID: PAT_TA_75384.pep
ELARTGGGLASVPPYGETFFGHPTGRASDGRVVLDFIVEALGMPSPKPYFAGKTAADFRRGVNFSXYGGSTALGPEFFLSRGLRSFVPVSLANQTAWFKNVVQLAGSEQEQRKLTATMLVMMGEMGINDYLVAITGKLSDGEIRTFVPHIVRAIRDVVTDVIGAGAK

SEQ ID NO: 180967 - protein, 172 aa, Triticum aestivum
  unsure (1)..(172): unsure at all Xaa locations
  Clone ID: PAT_TA_75385.pep
RRGRSPPRRSERRSYRDIICKNCRRPGHIARDCPSASXCNNCNLPGHFAAECTSKTVXWNCKKSGHIATECKNEALCHTCSKTGHMARDCPASGSNAKLCNNCFKPGHIAVDCTNDRACNNCRQPGHIARECKNDPVCNLCNVSGHLARACPKTTTLASEIHGGPFRDISCR

SEQ ID NO: 180968 - protein, 185 aa, Triticum aestivum
  unsure (1)..(185): unsure at all Xaa locations
  Clone ID: PAT_TA_75386.pep
MEQLIPVINKLQDVFNAIGSDPIDLPQIVVVGSQSSGKSSVLENIVGRDFLPXGSGIVTRRPLVLQLINLPWEGGAPPAAGDEAKNGKKDLSEWGEFLHKPNEMFYDFAQIREEIVRETDRLTGKNKGVSNVAIHLKIYSPHVLNLTLVDLPGITKVPVGDQPSDIESQIRRMALMYIEKPNAII

SEQ ID NO: 180969 - protein, 129 aa, Triticum aestivum
  Clone ID: PAT_TA_75387.pep
EARVPPEREMHLGAGLWLLLSLCALCSAEGSWSVVTHSQINVKDIAFPSVIAVGDFLCGAGDFKGHLFLESDSEGVYSIDSTNKISRTGVLACWSRVDGSLRFAKSLPQFKEINVLRNCSTDQLILLGK

SEQ ID NO: 180970 - protein, 141 aa, Triticum aestivum
  Clone ID: PAT_TA_75388.pep
EPPPSSFALWRSPQYWLPPPTAYMTQEQLVQAATQNAIAELDRLREKLERAVKEGADIEVQIGFKRQVKQQKAEVKDRKVRIQDKVKLSHCQKTIKKIESKIQKRKAADKPNNAKLAGLNKRREWWIVRQEQIRLAEEKRL

SEQ ID NO: 180971 - protein, 177 aa, Triticum aestivum
  Clone ID: PAT_TA_75389.pep
TRKTKAKAGGAEASSPALSIGNCKVEIHGSGLRCVSTEQNLTISGTRGAKILITVDGARSSSDGTGEGSDFILLNPNEADSLNKSLLQEVLRLYKKELAAMDYAADAGRKSGFLEKCIMNGKYKTLILRPSSLDGPEEAIHSPSAVAKKGASSVTMLAAWWIWKQHNPVAFYYHSCC

SEQ ID NO: 180972 - protein, 102 aa, Triticum aestivum
  Clone ID: PAT_TA_75390.pep
LISDQLDGCACWLVASTRRPRGPRSTRGPSRPCTRRCTPRRPTSCRRRSAPCGPSQRRRYSSRSSTASRLRCTRLLLFEAPGASPCARRLGAAAASTGALVP

SEQ ID NO: 180973 - protein, 145 aa, Triticum aestivum
  unsure (1)..(145): unsure at all Xaa locations
  Clone ID: PAT_TA_75391.pep
ELVLDGSSLTCDQLVELGVNHNIRLSLSALAWERVAAGRHVVDEVIRNEETVYGXINTGFGLFATVRIPTEKVCELQRNLIRSHSAGTGAPLSLARTRRLLALRINTLAKGFSGIRTVTLQQLLDAFNACCLSYVPEKGTVGASG

SEQ ID NO: 180974 - protein, 133 aa, Triticum aestivum
  Clone ID: PAT_TA_75392.pep
KLFILFIVVLYLAISVSGDTIPSSTKKKDKKKKTDDWVVQIKGNNVDVDRIAFEHGYQNLGKVANLTDFYLFEKLKTKDISPPLDDNDLISFHERQINENEIQERIDRHRSIVAKTMALEIRKDLLQHIFSGE

SEQ ID NO: 180975 - protein, 162 aa, Triticum aestivum
  Clone ID: PAT_TA_75393.pep
EPRLEPPLLHGVRADVLGRCLDLGETPRRTAGGRAEDIRLWSRDDQTLYNRGGNRSPRRVPWSRRAPYANLAALFAGGGACACGVGDGTCSCFTASRSLRQWPSRARRLVPAPAHVFNLGKNLSNFSDRTRSNISCSDFCNSSMIQTMWLVWALARTDRTSL

SEQ ID NO: 180976 - protein, 102 aa, Triticum aestivum
  unsure (1)..(102): unsure at all Xaa locations
  Clone ID: PAT_TA_75394.pep
QHYIRRQPRPVFSKKLRSRIRSXXLIPSIGDQLRPKFLFCHAIQFCAHLASHHSVWPLAVLSCRGGTGISGNATASHLNFASAPLPSSVFAGHTFHVRIYPA

SEQ ID NO: 180977 - protein, 150 aa, Triticum aestivum
  unsure (1)..(150): unsure at all Xaa locations
  Clone ID: PAT_TA_75395.pep
MQIFVKTLTGKTITLEVEGSDSIQQVKQKIQDKEGIPPDQQRLIFAGKQLEDGRTLADYNIQKESTLHLVLRLRGGMQIFVQTLTGETITXLEVEGSDXIQQVKQKIQDKEGIPPDQQRLIFAGKQLEDGRTLADYNIQKESTLHLVLRL

SEQ ID NO: 180978 - protein, 156 aa, Triticum aestivum
  unsure (1)..(156): unsure at all Xaa locations
  Clone ID: PAT_TA_75396.pep
MAESEHSIHVLLAAYPAQGHINPLLQLAKRLAGQPGVRCTLAVTRSSLGPSGGASLDAGAVHVAAFSDGCDQRGYDEVGDVRLYLARLDSAGSSSLDGLLRSEAEQGRPVHALVYDAFLLFAPRVARRHGAXCAAYFTQACAVNLVYAHAWAGLLG

SEQ ID NO: 180979 - protein, 104 aa, Triticum aestivum
  Clone ID: PAT_TA_75397.pep
RRWRRGSRIHARTCAITTSTMTGASVAAGLGRILGLPVAVGNQKKQAEHRVDVLTATAAGAAADPRICEDFCRNWPAPEHDWCLDFCLAGDYVQRAPLHLKLAG

SEQ ID NO: 180980 - protein, 102 aa, Triticum aestivum
  Clone ID: PAT_TA_75398.pep
GSAEESTSASRRSGTASSSPPRAPRVSPPLAEPWSASSSSFAAAESESSEWSAPPDCFDGEVSCERFRFRHLSFASEEDEALRGIVAGAGGGGNGASCRIPA

SEQ ID NO: 180981 - protein, 30 aa, Triticum aestivum
  Clone ID: PAT_TA_75399.pep
QVVEMSRRADIRKQVPCWQQLQSRKMLGLI

SEQ ID NO: 180982 - protein, 141 aa, Triticum aestivum
  Clone ID: PAT_TA_75400.pep
ARGWQGSHADAAITGNKNEGIEKAKSLILLLATLAATITYQAGMDPPGGVWSDGDPEAVPPGFKAGDPILQFKHAARYKAFFYCNSTAFVASLVVILMVQNESLMSGHALDVAMILDLFGLIGAYAAWSCREVSTSIYVVA

SEQ ID NO: 180983 - protein, 138 aa, Triticum aestivum
  unsure (1)..(138): unsure at all Xaa locations
  Clone ID: PAT_TA_75401.pep
GFQVTFVNTEVDHALVLAAMAPGGGAALRGIHLASIPDGLAGDEDRKDLNKLIDAYSRHMPGYLERLVGEIEAAGRPRLKWLVGHVNMGWSFEVAKRLGIRVASFWPASAACLAIMLKIPQLIEDGVLDEXGWPERQE

SEQ ID NO: 180984 - protein, 173 aa, Triticum aestivum
  Clone ID: PAT_TA_75402.pep
GIRHEVLVAQVHIGHPEHRSPDNRYIWKRRADCVHLINLGKTCEKLVFAARVIAAIENPADVVVCSARPYGQRATLKFAHYTGATALAGRYTPGTFTNQIQEKFVEPRLLIITDPRTDSGPLKDSSYVNIPTIAFCYTYSPARFVDFAIPAHYKAQNSIGLLFWLLAREVLYL

SEQ ID NO: 180985 - protein, 113 aa, Triticum aestivum
  Clone ID: PAT_TA_75403.pep
MASKKCASCTKTVYPVEQVSAAGVFFHKNCFRCQHQGCGTPLNLKNFKAHQNKVYCAVHYPEDHQKIRATQVTDSVHVKHATSAPRKVSEGLSNVHKGDERFRKEGGDFKVEY

SEQ ID NO: 180986 - protein, 158 aa, Triticum aestivum
  Clone ID: PAT_TA_75404.pep
MLENQSQAEVLWPRLVANKLFRKPSGSHAFVADFPAAAGAAEEEFDACGSPDADAQRCVKRPRPQQRNKTLKYRLFASTWNVGGVAPPDDLDLSDWLDTRNGTYDVYVLGFQEVVPLRARNVLGADKNRIGMRWNELVRAALNRSSPSPSPGATGGGE

SEQ ID NO: 180987 - protein, 63 aa, Triticum aestivum
  Clone ID: PAT_TA_75405.pep
VRERGREDFFLLLALLIKEWRVKIERKRERRAFWAWHSLDHQNHSFIHPKGISVLLYSFFVFI

SEQ ID NO: 180988 - protein, 147 aa, Triticum aestivum
  Clone ID: PAT_TA_75406.pep
AIEVISGAGYTNVVDWWSVGCISYEMIVGIPPFCGDTPEDVFMNIMNYEESLQFPDNKPEDEEEPAINISELAKEFICSLVTAPERRLGKNGTDEIRQHAWLSIIDWNNFTSQMKPPFVPNLESKNDTSYFPQSQDVNNNEIHQQNN

SEQ ID NO: 180989 - protein, 137 aa, Triticum aestivum
  unsure (1)..(137): unsure at all Xaa locations
  Clone ID: PAT_TA_75407.pep
SLHPNPDLPPAPVKPWHATVTGAKGKKGAAGRKAGGPRKKSVTRSVKAGLQFPVXRIGRYLKKGRYAQSRXAPGAPVYLAAVLEYLAGELLELAGNAAXRTTXKSRIIPRHLLLAVRNDEELGKLLAGVTIAHGGIF

SEQ ID NO: 180990 - protein, 41 aa, Triticum aestivum
  Clone ID: PAT_TA_75408.pep
ALVTPHPLRRHGSSLGVCAREHEDSLGLLRPCVCVGDGGTR

SEQ ID NO: 180991 - protein, 83 aa, Triticum aestivum
  Clone ID: PAT_TA_75409.pep
LFFFFFFDRTRGACIHAGGDERRGDGPARCDAGRRAAAASPSWAERPSGAGARRRCRRACWAARAGGDGAAGQTHRQSPRSAP

SEQ ID NO: 180992 - protein, 75 aa, Triticum aestivum
  unsure (1)..(75): unsure at all Xaa locations
  Clone ID: PAT_TA_75410.pep
VPAGDKKDKKFEPPAAPSRVGRKQRKQKGPEXAAARLPPVAPLSKCRLRLLKLDRVKDYLLMEEEFVASQERLSP

SEQ ID NO: 180993 - protein, 34 aa, Triticum aestivum
  Clone ID: PAT_TA_75411.pep
KVLGNSQYILLPFQPYKLIYAYMLAEVGKVSDSL

SEQ ID NO: 180994 - protein, 141 aa, Triticum aestivum
  Clone ID: PAT_TA_75412.pep
GERWDQGIRIELFFLSTMYQSLGIQLGGCNARMKRHARCTGCPQSSAIRVSGPCTPGCELPVLLLRHAAGGVVPAGHCRASFPVRVISMTIVLFSPMSISSLVFCDSWRRPAESTSPPSVASATGRTTTACCFACVTCDVA

SEQ ID NO: 180995 - protein, 138 aa, Triticum aestivum
  unsure (1)..(138): unsure at all Xaa locations
  Clone ID: PAT_TA_75413.pep
MDAPRGAALGKRKEREYSSSSEQRQPLFPPPPPPGRQELLRNKPHQLSRFANKSPMPTPPPQGGSSKLLAGYXAHEFLKFGTLLGEAXPAPGRKETATPPPAPTPDPARRYAEASMLLMAGGTRIPGFXNPTQLGCWL

SEQ ID NO: 180996 - protein, 176 aa, Triticum aestivum
  unsure (1)..(176): unsure at all Xaa locations
  Clone ID: PAT_TA_75414.pep
MDPAVMASSXATTVAPFQGLKSTAXGLPVSRRSSGSLGRVSNGGRIRCMQVWPIEGIRKFETLSYLPPLSTEALLKQVDYLIRSKWVPCLEFSKVGFVFREHNSSPGYYNGRYWTMWKLPMFGCTDAXTQVLNEVEEVKKEYPDAYVRVIGFDNLRQVQCVSFIAFRPPGCEESGK

SEQ ID NO: 180997 - protein, 174 aa, Triticum aestivum
  Clone ID: PAT_TA_75415.pep
RRKMIKGLQRTTEGKEEKGTKVVFVCVIGKEKKKKNEERKEEREVQKRGSEVSLTLATRLGKRMEDESRVLRVSGPSGEWSGKKERVGVEAHGGWWRERTVLFLSDLAVAVFSLEEVGTARRGARPKRKTKRTRSRRPGPSGTSHGVGEVEVVHHHLGGFLLGGEEARRDVRAA

SEQ ID NO: 180998 - protein, 177 aa, Triticum aestivum
  Clone ID: PAT_TA_75416.pep
CRLNAHVASSLVLMYAARCDGVTARALLDVQLARGGGTPVVWNALMSGHKRSRQFRLSCCSFQDMVRAGIVPTPVTYITVLSACGKGNDVLLGMQLHKRIIESGVLPDLKVENALVDMYAECGEMEAAWDLFEGMQVRNIVSWTSVISGFVRLGQVDRAKVLFDRMPERDTVSWTAM

SEQ ID NO: 180999 - protein, 99 aa, Triticum aestivum
  unsure (1)..(99): unsure at all Xaa locations
  Clone ID: PAT_TA_75417.pep
RARLSYKMEFSVGDAADGCMGSLAVDAYXGXGRVTVPYESKGTGGFTRGVLEFTATEDRTRVVFVSASYNMKSDGTVCGPVVDDASLVCAQSHARRLLL

SEQ ID NO: 181000 - protein, 160 aa, Triticum aestivum
  unsure (1)..(160): unsure at all Xaa locations
  Clone ID: PAT_TA_75418.pep
MLIPKKDRNAILTYLFKEGVCVARKDXLLGVHAEINVPNLYVMKLMQSLTSKGLVTATFNWSHHYWFLTNTGIEHLREYLGLPEEIVPATLKRKLQARREGGEDRPRGPRFGGKDAAPGEGEFKPTFEGRGRGRGGARGGRGRGGYYRGEQREQTQTPAQ

SEQ ID NO: 181001 - protein, 178 aa, Triticum aestivum
  Clone ID: PAT_TA_75419.pep
DEALEKTRPERVNVGPERVKARITEPKHRAGHRYIGRLVQRQAAVLILVLADLKAADGGAPRDRHTRAAQLASDEYVEGGTELIAEFVDGFARVGQCRPHLADHTLTARARSHETICSVYEGIHQRQRPERYRGGRGCTEKGGERDADGACGCSGAYGSTRGRRRWHARRDACSPGDP

SEQ ID NO: 181002 - protein, 173 aa, Triticum aestivum
  unsure (1)..(173): unsure at all Xaa locations
  Clone ID: PAT_TA_75420.pep
APAVMAXSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 181003 - protein, 146 aa, Triticum aestivum
  unsure (1)..(146): unsure at all Xaa locations
  Clone ID: PAT_TA_75421.pep
HGGGKRCTWGHPXSDLGAGGPPCDRLARGKKGMCVHHNPLLDDDRIHGGRTLAAFSITSSAASLDRRSHPATSETSRRSISMLPVEAPGRAPLPEGRVHGGNIVSMFANGLSFGEDSSNNAEASTSAPRSSKPAKEFSASGRSSWL

SEQ ID NO: 181004 - protein, 191 aa, Triticum aestivum
  Clone ID: PAT_TA_75422.pep
LGVGDPNAPRFVLWEGKLRPVPSKPGDLPFFSLMSIPGKLRAGLGALGIRPPPPGREESVEEFVRRNLGAEVFERLIEPFCSGVYAGDPSKLSMKAAFGKVWRLEEIGGSIIGGTIKAIQDKGKNPKPPRDPRLPAPKGQTVASFRKGLAMLPNAIASRLGSTVKLSWKLTSITKADNQGYVLRYETPEGL

SEQ ID NO: 181005 - protein, 162 aa, Triticum aestivum
  Clone ID: PAT_TA_75423.pep
AYATPICTQLRMEKPMASGELNQWMTIHFLPGTWELDYRLDKFIELWGFLLPLYCQSCKSTRSGKICVSSVPDDLGSFTVVQEDYGTSASNQGTLQGGRGFITGAVVVVVQGSINHKYYLNFDQDYVGTDHFLGASLDRVTIDHGYYNLLVQVNLDVNYHHD

SEQ ID NO: 181006 - protein, 92 aa, Triticum aestivum
  Clone ID: PAT_TA_75424.pep
VQQRTTTYCLCPVSPWPRACTHDVRPWFDRTNRISCDALRKCASPRPLAGFGETWSLRCPSRTLSSPRPLANRAPPLSPHVRPGTSPPPCRA

SEQ ID NO: 181007 - protein, 181 aa, Triticum aestivum
  Clone ID: PAT_TA_75425.pep
HALPREKLLILFDVDGTLTDPRLPASEQMLHFLKELRKRATIGFVGGSDLVKQQEQLGRNTLHDFDYAFPENGLMAYHNGSVIHKQSLKDFLGEAKLKEFINFCLHYIADLDIPIKRGTFIEFRNGMLNVSPIGRNCSQEERIAFNEYDLQHGIRKKFVEALQAKFASFGLKYSIGGQISF

SEQ ID NO: 181008 - protein, 57 aa, Triticum aestivum
  Clone ID: PAT_TA_75426.pep
RGGSTGYDNAVALPAGGRGDEEELAKENVKNASSSTGNLTLSVTKSKPETGEVTRRL

SEQ ID NO: 181009 - protein, 201 aa, Triticum aestivum
  unsure (1)..(201): unsure at all Xaa locations
  Clone ID: PAT_TA_75427.pep
MAASALHQTTSFLGTAPRRDDLVRSVGDFGGRITMRRTLQNAXPQSFWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGXGPLGEGLDIIYPGGAFDPLGLADD

SEQ ID NO: 181010 - protein, 107 aa, Triticum aestivum
  Clone ID: PAT_TA_75428.pep
RRVVVVSVRARRRAVLVVLRAVVRRHRPLCPRRERERRRAERVERPQLHDLSGAHLLLEALGQLVRVHVVADHQQQILVAAGKRHRLHPCILLPSPNPVNHLVPTLA

SEQ ID NO: 181011 - protein, 139 aa, Triticum aestivum
  unsure (1)..(139): unsure at all Xaa locations
  Clone ID: PAT_TA_75429.pep
MTSSAASANSGGRITMRRTVKSAPQSIWYGPDXPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAI

SEQ ID NO: 181012 - protein, 100 aa, Triticum aestivum
  Clone ID: PAT_TA_75430.pep
DKMLHIFSSTVKMPHLSLRGSSLPPSLRRLGPLLLVVSFADGARWGRADGGAARRRQGGSGHAEETKDGAGTRGGGTARGAAPAGGRAELRRRSSRVGVR

SEQ ID NO: 181013 - protein, 63 aa, Triticum aestivum
  Clone ID: PAT_TA_75431.pep
MDEENPVELLQRYRRDRHVLLNYILSGNLIKKVVMPPGAISLDDVDIDQVSVDYVLNCAKKGD

SEQ ID NO: 181014 - protein, 139 aa, Triticum aestivum
  unsure (1)..(139): unsure at all Xaa locations
  Clone ID: PAT_TA_75432.pep
MGIARDTLHKHRSTGAKRKVPRSKRKYELSSSNLPKPFIGARKVTTVRVRGGATKFRXVALDHGNFAWASEHATRKSRMLVVSYNAVSNELVRTNTLVKGAIVQIDATPFKQWYEKHYGVTLGKAKEGEAAASTDAAAP

SEQ ID NO: 181015 - protein, 190 aa, Triticum aestivum
  unsure (1)..(190): unsure at all Xaa locations
  Clone ID: PAT_TA_75433.pep
AQYPESRLVALNTIKEYADALRRGSGDGGVAAIVDEXHMLKIFLSYHCDFRIVGQEFTKEGXWXFAFQRDSPLAADLSTAILQLSESGQLQRIHDEWFTRPSCSTDDTEVGATSLGLRSFWGLFLVCALICLLALLVFFIRVCWQYSRYSSSEAAGEPGAADAVGPTAAAANAVERQRRPSRFGSFRELV

SEQ ID NO: 181016 - protein, 155 aa, Triticum aestivum
  unsure (1)..(155): unsure at all Xaa locations
  Clone ID: PAT_TA_75434.pep
QADAYKETHNLVVSPRDTYVGGLVSNLQVAELIACVAKNXGRATCKVVELVAETTAPLLPTEDLLARVPSDPGRAPPPAKESPPAAAAAPAPVAAPPAPAPAPAPAAPPTPAPAPAPAAAPPAPAPAPAPAAAAKTERPLSPYAAYEGLKPPSSP

SEQ ID NO: 181017 - protein, 94 aa, Triticum aestivum
  unsure (1)..(94): unsure at all Xaa locations
  Clone ID: PAT_TA_75435.pep
CEQLLLRLAKPNCRHTGLVDVDXLINQRNQISISHDNNDLVRPGSAPSTHCYGTLVVRSKARVLLRRCRLVGPLPHRAPAVDDEVVPVDILGLV

SEQ ID NO: 181018 - protein, 109 aa, Triticum aestivum
  Clone ID: PAT_TA_75436.pep
SSSSSRGLRPQHRRRPPRLSTTTAALPRHNDNHPPRVAVVVPRPLGGCCCSSSQAAPRPPTPSTSMAPVTRPRRLTRSRAWSSTPARSRCRLWGDQMQIPGIISWLIIS

SEQ ID NO: 181019 - protein, 172 aa, Triticum aestivum
  unsure (1)..(172): unsure at all Xaa locations
  Clone ID: PAT_TA_75437.pep
MAWHCLLALFLLSSTAYGQLSPSFYDKSCPTLQRTVRATVTKALRAERRMGASLLRLHFHDCFVQXCDGSILLDDVAGSFVGEKTAFPNVNSVRGYEVIDQIKKDVELVCPGVVSCADIAALAARDGTSLLGGPSWAVPLGRQDSTTANMMEANSDLPAPSLNLDGLIAAFA

SEQ ID NO: 181020 - protein, 162 aa, Triticum aestivum
  Clone ID: PAT_TA_75438.pep
MAATTTMALSSPAIKLAGASYALGGGGRITMRKAAPKASASNSPWYGPDRVLYLGPLSGEPPSYLSGEFPGDYGWDTAGLSADPETFAKNRELDVIHCRSAMLGALGCVFPELLARNGVKFGEAVWFKAGSQIFSEGGLDYLGNPSLVHAQSILAIWACQVV

SEQ ID NO: 181021 - protein, 121 aa, Triticum aestivum
  Clone ID: PAT_TA_75439.pep
AAYALLRLCTRFAALTCRPLRCKSASNSMPTSLLPKPARETRTEAHMPLDRLAPEILMRVLRVLRLQDVLRVSETCTTLRDVARDPHLRLSVQLSVTKALRTQLDGAMRLGVRLVSLTAAG

SEQ ID NO: 181022 - protein, 174 aa, Triticum aestivum
  Clone ID: PAT_TA_75440.pep
MAPAVMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGNA

SEQ ID NO: 181023 - protein, 145 aa, Triticum aestivum
  Clone ID: PAT_TA_75441.pep
MVTPPTGPPLRITHPSHPGHVLTLYATGGALFQCDGCRHYGEDDRRYRCDPCDFDLHVCCVPFKVEDLTLTHPFFKGCTFDFRYSPPGGALAGRGSFCGACGDQVLGFMFHDGHRQIGLHPQCANLAERVVQHDGAFDLLKESPA

SEQ ID NO: 181024 - protein, 32 aa, Triticum aestivum
  Clone ID: PAT_TA_75442.pep
RALGSILKHESAFVGIVKVVAFTSCAAVDISA

SEQ ID NO: 181025 - protein, 130 aa, Triticum aestivum
  Clone ID: PAT_TA_75443.pep
TIRICTSSICTTLRHMPQQHRPRRQCRDQTSCGPRFLPGTAAQSTAPLASLLRGAPSCEACATRRQSSFADPRGRPSSFSAASEEHRWSAPNRGDAAGREQRQVVCVADELKPRAYGRAWTRVCHAPPRP

SEQ ID NO: 181026 - protein, 166 aa, Triticum aestivum
  Clone ID: PAT_TA_75444.pep
MSFCHFAFRSNGFVVLTMDSADEQNYLTEEAITDLEKKLEQIRDNPEVKGLVTTCKSGIFCSGLDYDHDASEEQAENLATGVAKVIRLLFLLQVPTVAAVRGHVTSLGLALALAHDHVFVWDQAVVRLPEAQLGRRLPDYVPTLLRDKLSYARLRKLLMLKSQPCT

SEQ ID NO: 181027 - protein, 149 aa, Triticum aestivum
  unsure (1)..(149): unsure at all Xaa locations
  Clone ID: PAT_TA_75445.pep
MSYVAEDTALQASGYFRPWRVQPFVDLYGRRFHIGSIRGANVIYALTGQRRLNAAVTVQTLLDVFTVSGIVHYGTAGSSNDSMSFGDVSVPKLVAYTGAWTWKKFKSLKESSTELNFGQFNIPDGGENLLGSLKYXNEELYSVGKPMEE

SEQ ID NO: 181028 - protein, 147 aa, Triticum aestivum
  unsure (1)..(147): unsure at all Xaa locations
  Clone ID: PAT_TA_75446.pep
MVSGSGVCAKRVVVDARHHMLGRLASIVAKELLNGQRVVVVRFQEIXCFSGGLVRQKMKYLRFLRKRMNTKPSHGPIHFRAPAKILWRTIRGMIPHKTARGEAALARLKAYDGVPPPYDRTKRMVIPDALKVLRLQPGHRYCLLGQL

SEQ ID NO: 181029 - protein, 130 aa, Triticum aestivum
  unsure (1)..(130): unsure at all Xaa locations
  Clone ID: PAT_TA_75447.pep
RSAPRPPPKNNGFTTRTPKKAGDVVXPAPTLLLFGQAILTEEQMKSSSAGGEAATSPVAGGCGSPNWDAEKAPNLSEGSGSGSGVIQGSPSNNNTSSWRLQWFGDSSSQAAPELLGLEAGQCKVFVESDA

SEQ ID NO: 181030 - protein, 79 aa, Triticum aestivum
  Clone ID: PAT_TA_75448.pep
VRHCQKPITGDILNYGGSLTTRIICSALSATLRSAPVWRSRTSAASLTVALAGPPSCTAALLPVRPRRRPPPPPLLLPT

SEQ ID NO: 181031 - protein, 181 aa, Triticum aestivum
  Clone ID: PAT_TA_75449.pep
RSSHQQQQLLLCLLLHLCLGIQLSYSIATTSNQTTCRPDQSSALLRLRRSFSATTDSTCTLASWRAGTDCCHWEGVTCAAADGRVTTLDLAECGLQSAGLHPALFELTSLSYLDLSSNSFGPAWIPCKVLQVYIDYPCKLLEISKIQPDIQGESTARLVRLVSHLVQGVFPCVVSLAAGTQ

SEQ ID NO: 181032 - protein, 135 aa, Triticum aestivum
  Clone ID: PAT_TA_75450.pep
ARQPSSSSLTPGLPAPTPRAAIAHSSARTTRSKAKARHAGPAERTILQTRGAAQEGDVPGGALASPGQVLHQVRLRAGLRVPDRFACALGRFGVLVVHPRPHTPRAPMLRASSFLDTGSTVDPQSDAVPVNNIGS

SEQ ID NO: 181033 - protein, 168 aa, Triticum aestivum
  Clone ID: PAT_TA_75451.pep
TPESSDTVLSASRDKSILTWDLKAASSDAHSYGQPKRALRGHSHYVQDVVISSDGQFALSGSWDGTLRLWDIATGLTTKSFVGHSKDVLSVAFSSDNRQIVSGSRDRTIKLWNTLGECKYTIDDQRHTEWVSCVRFSPNTQNPLIVSGGWDKMVKVWSLNNCKLRTNL

SEQ ID NO: 181034 - protein, 121 aa, Triticum aestivum
  unsure (1)..(121): unsure at all Xaa locations
  Clone ID: PAT_TA_75452.pep
VMASSATTVAPFQALKSTAGLPVSCRSGSTGLSSLXNGGRIRCMHVWPIEGIKKFETLSYLPPLSTEXALLKQVYYLIRSKWVPCLEFSKVGFVFREHNSSPGYYNGRYWTMWKLPMFGCT

SEQ ID NO: 181035 - protein, 101 aa, Triticum aestivum
  unsure (1)..(101): unsure at all Xaa locations
  Clone ID: PAT_TA_75453.pep
VQFVNSATSRTFGYSKSELQGQNIKMLMPSSIADRHDAYLXKYLRTGVGNIIGKGRVVEGRRKDGKHDYARSRRLSRAVESATCSPAPSPRCSAPSRAAPL

SEQ ID NO: 181036 - protein, 177 aa, Triticum aestivum
  unsure (1)..(177): unsure at all Xaa locations
  Clone ID: PAT_TA_75454.pep
MAPYVMASSATTVAPFQGLKSTAGLPISRRSGSAGLSSVSNGGRXIKCMQVWPIEGIKKFETLSYLPPLXSTEALLKQVDYLIRSKWVPCLEFSKVGFVFREHNSSPGYYDGRYWTMWKLPMFGCTDATQVLNEVEEVKKEYPDAYIRVIGFDNMRQVQCVSFIAFRPPGCEESGKA

SEQ ID NO: 181037 - protein, 33 aa, Triticum aestivum
  Clone ID: PAT_TA_75455.pep
SIWQLNFKYYDYRHLELSSVRKFSTASSRRRLP

SEQ ID NO: 181038 - protein, 105 aa, Triticum aestivum
  unsure (1)..(105): unsure at all Xaa locations
  Clone ID: PAT_TA_75456.pep
LRCQDIVVVEVPKLAQGGLRMKAITEWGQPRSKITHLVFCTTSRVDLPGXPIYQLTKILGLRPSVKRLMMYQPGCFAGGTVLRLAEDLAENNRGARVLVVCSEIT

SEQ ID NO: 181039 - protein, 159 aa, Triticum aestivum
  unsure (1)..(159): unsure at all Xaa locations
  Clone ID: PAT_TA_75457.pep
MSPQTETKAGXGLKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLYEEGTVTNMFTSIVGHVFGFKALRALRSEDLRIPPTYSKTFQGPPHGIQVER

SEQ ID NO: 181040 - protein, 98 aa, Triticum aestivum
  unsure (1)..(98): unsure at all Xaa locations
  Clone ID: PAT_TA_75458.pep
KLVSATKEGLKLDESEDEKKKQEELKXKFEGLCKVIKEVLGDKVEKVIVSDRVVDSPCCLVTGEYGWTAYMERIMKAQALRDSSMAGYMSSKKTMEIN

SEQ ID NO: 181041 - protein, 35 aa, Triticum aestivum
  Clone ID: PAT_TA_75459.pep
WRPPRPACCWTSGPRTSSSHPPLELRWLVAKIFSC

SEQ ID NO: 181042 - protein, 106 aa, Triticum aestivum
  Clone ID: PAT_TA_75460.pep
SPLRLITACEAGLERPTQIRPKSKPAAGTVSGWWEFSPTSPTERSSHRFINPPELIISSSYLKQAAHCLTSLSLPRWAYQQLIYIHRGPASWPNGLLVVCRPWGSI

SEQ ID NO: 181043 - protein, 36 aa, Triticum aestivum
  Clone ID: PAT_TA_75461.pep
ITVGVGKGGCGVNVKPGRRRHGRSREGRRRRERRSL

SEQ ID NO: 181044 - protein, 107 aa, Triticum aestivum
  unsure (1)..(107): unsure at all Xaa locations
  Clone ID: PAT_TA_75462.pep
GIPLPPCGHSPGGGSGGGSSHDGRRKVIGASILVXGVALSVLILLLLLVTLCKLWKSQKTEEIRTGYIESLPTSGATSWKLSGVEEPLSINVATFEKPLRKLTFAHL

SEQ ID NO: 181045 - protein, 32 aa, Triticum aestivum
  Clone ID: PAT_TA_75463.pep
ADRQEHGTGIGKKYYNNKRTKQSSREKPARAR

SEQ ID NO: 181046 - protein, 27 aa, Triticum aestivum
  Clone ID: PAT_TA_75464.pep
WLLLSSPYLLNTGLLLLLQYQAKYWLV

SEQ ID NO: 181047 - protein, 128 aa, Triticum aestivum
  unsure (1)..(128): unsure at all Xaa locations
  Clone ID: PAT_TA_75465.pep
GSPGLQAVVELANEEDARMLLHRAVECCPLHVXLWLALARLETYDQAKKVLNKAREKLNKEPAIWITAAKLEEANGNTQSVSKVIERGIRSLQREGLDIDREAWLKEAEAAERAGSVLTCQAIVKSTI

SEQ ID NO: 181048 - protein, 125 aa, Triticum aestivum
  Clone ID: PAT_TA_75466.pep
DDGTIISTARLNRTVHVDAAKRLMTVESGMLLRDLVEAAAVAGLSLPHSPYWHGLTIGGLLSTGAHGSSLWGKGGAAHEYVVGLRIVTPAPASQGFAVVRELGAGHPDLDAAKVSLGVLGVISHV

SEQ ID NO: 181049 - protein, 106 aa, Triticum aestivum
  Clone ID: PAT_TA_75467.pep
PETTAGGDAPGAQAVVLGAAPAMHGELRECRVKAIAREARWLLPPAGSGRRSTGPGPSGVAVERCWCRRRRKRSCGSPLFRRHEPRGALPRFWPVNQLAAIHGSKR

SEQ ID NO: 181050 - protein, 103 aa, Triticum aestivum
  Clone ID: PAT_TA_75468.pep
PGCRPLEEKKQALERRSDATQETAAQATDFSQRRSIHTKSSSYPPWITPPCPLFPVMATEAPRRSHPAAVAATSCLPWRAFPPFKRLNPHGSRPLPLVRTLIP

SEQ ID NO: 181051 - protein, 167 aa, Triticum aestivum
  Clone ID: PAT_TA_75469.pep
SSRPRSTRLRLPSLPSELVPPRLVVSGPRSMPSSTPLPSLVPPPQLPPSRPPPSQVLPVLNGRLSPSTLLPLSVLTSTTSRLKPQPASTTTSPPSRRSLVTDARMPLPFLLNGLLRLLVPSCSTKPPSTPGLLLATRSGTSCGRPVGLSNLLPSSTERREPSLTLLL

SEQ ID NO: 181052 - protein, 138 aa, Triticum aestivum
  Clone ID: PAT_TA_75470.pep
DPPGCRPVRSCHCRPDSAGSAPEHWSALTLVCAAATTMKPAAAPAWVSMLNTNVMTMLRTVHTAAASKIASKTASKSQGIGCTICTLIIAFAEEELGSNKTITSVENFLNSTVCGLLPSFLQGECQNLVDQYAPVIAA

SEQ ID NO: 181053 - protein, 47 aa, Triticum aestivum
  Clone ID: PAT_TA_75471.pep
VTPKLSRWPKYHFLYIILYLRTIPKLLVTSGISPGTPNNIRYAAYSY

SEQ ID NO: 181054 - protein, 183 aa, Triticum aestivum
  unsure (1)..(183): unsure at all Xaa locations
  Clone ID: PAT_TA_75472.pep
QALVYEYLENGSLEKYLYRARGRRRRGREXERLEWRTLHSIAXGTAKGIRYLHEQCQHRIVHYDIKPANILLTADFTPKVADFGLARLGERENPHMSSLTGGGRGTPGYAAPELWIALPTTEKCDVYSFGMVLFEILGRRLNYDAQLEHESREWFPKWVWDKYEQGDLESIVSAAAGVGEADR

SEQ ID NO: 181055 - protein, 127 aa, Triticum aestivum
  Clone ID: PAT_TA_75473.pep
MAASMITSPIVAPTSVPSLSRRGSSFAVVCSGGKKIKVDKPLGLGGGLTVDIDAYGRKVGKKGVYQFVDKYGANVDGYSPIYTPEEWSESGDRYAGGTTGLLIWAVTLAGLLGGGVLLVYNTSALAG

SEQ ID NO: 181056 - protein, 98 aa, Triticum aestivum
  unsure (1)..(98): unsure at all Xaa locations
  Clone ID: PAT_TA_75474.pep
MYPAFLAMYAVIYXLGQLVLFRRWEWRHRLDGARCLISLAHGSGAALAAVAAIAAQPAGNRGFAAPNSRMQDHVLDYSVAYFTMDLLHYLAFLPGDVL

SEQ ID NO: 181057 - protein, 126 aa, Triticum aestivum
  unsure (1)..(126): unsure at all Xaa locations
  Clone ID: PAT_TA_75475.pep
RPGPVTEKLPVRAAMPLLPTKLAMGGRXGGGDEAAFHEFNGASFAGAVFNLSTTIVGAGIMALPATMKVLGLVPGLVMIVLAAFLTDASVELLMRFSRVVGAPSYGAVMGDAFGWWGRRLLQVCVV

SEQ ID NO: 181058 - protein, 96 aa, Triticum aestivum
  Clone ID: PAT_TA_75476.pep
MSPQTETKAGVGFKAGVKDYKLTYYTPEYETKDTDILAAFRVSPQPGCSAQKKQGAAVSLPNLPTGTWTTVWTDGLTSLDRYKGRCYHIEPVAGED

SEQ ID NO: 181059 - protein, 48 aa, Triticum aestivum
  Clone ID: PAT_TA_75477.pep
SAPTPNPARGQLRAHVVEVLVKHRLEVCEPHDLDEDGDCHLWLSPLSK

SEQ ID NO: 181060 - protein, 148 aa, Triticum aestivum
  Clone ID: PAT_TA_75478.pep
MASTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDARVRANAQQPKLFVGMILILIFAEALALYG

SEQ ID NO: 181061 - protein, 159 aa, Triticum aestivum
  Clone ID: PAT_TA_75479.pep
AELNHFLAVQLGEDGYSGVEIRTTPDKTEIVIRATRTKSVVGEGALRIRELTAIIQKRFGLKPNSIELLVSAVKRRGLCAIAQAESLKYKLLAGLPVRRACYGVIRFVMESGAQGLEVVVSGKLRGQRAKAMKFRDGYMVQSGHSVVDYVDTAVRHVML

SEQ ID NO: 181062 - protein, 114 aa, Triticum aestivum
  unsure (1)..(114): unsure at all Xaa locations
  Clone ID: PAT_TA_75480.pep
MQIFPXLKKMRLIELGSLEIWAEHSVGERSDNLLTFPVLEELEIKNCPKLASIPVIPVVGNLRIVGVHSTAVGSVCMSIRLGSWTISRLLNSLVSGRHTHVASEHPARPKSKTS

SEQ ID NO: 181063 - protein, 159 aa, Triticum aestivum
  unsure (1)..(159): unsure at all Xaa locations
  Clone ID: PAT_TA_75481.pep
MSPQTETKAGVGFKAGVKDYKLTYYTPEYETKDTDFLXAAFRVSPQPGVPPEEAGAAVAAESSTGTWTTVWTDGLTSLDRYKGRCYHIEPVAGEDSQWICYVAYPLDLFEEGSVTNMFTSIVGDVFGFKALRALRMEDLRIPPTYSKTFQGPTHGIQVE

SEQ ID NO: 181064 - protein, 168 aa, Triticum aestivum
  unsure (1)..(168): unsure at all Xaa locations
  Clone ID: PAT_TA_75482.pep
MSPQTETKAGVGFKAGVKDYXLTYYTPEYXNXDTDILAAFRVSPQPGVPPEEAGAAVAAESSTGTWTTVWTDGLTSLDRYKGRCYHIEPVAGEDSQWIYYVAYPLNLFEEGSVTNMFTSIVSDVFGFKALRALRMEDLRIPPTYSKTFQGPXHGIQVERDQLNKYGRP

SEQ ID NO: 181065 - protein, 178 aa, Triticum aestivum
  unsure (1)..(178): unsure at all Xaa locations
  Clone ID: PAT_TA_75483.pep
MADDDVQALVIDNGSGMCKAGFAGDDAPRAVFPSIVGRPRHTGVMVGMGQKDSYVXGDEAQSKRGILTLKYPIEHGIVTNWDDMEKIWHHTFYNELRVAPEEHPVLLTEAPLNPKANREKMTQIMFETFNTPAMYVAVQAVLSLYASGRTTGIVLDSGDGVSHTVPIYEGYALPHAIL

SEQ ID NO: 181066 - protein, 149 aa, Triticum aestivum
  unsure (1)..(149): unsure at all Xaa locations
  Clone ID: PAT_TA_75484.pep
MVTRFKKNRKKRGHVSAGHGRVXQHRKHPGGRGNAGGQHHHRINMXDKYHPGYFGKVGMRTFNFNKNAAFCPVVNVDHLWTLVPESQRLEAAGRTDGSVPIIDVTKAGFFKVLGKGRLPKQGAIVRAKFFSKRAEDKIKAAGGVCELVA

SEQ ID NO: 181067 - protein, 107 aa, Triticum aestivum
  Clone ID: PAT_TA_75485.pep
RCRRTRRPSSPSTETSSSSRASPEPSVVTPTLPSRSSARSTSETRAASTSTWLIFRARSTASSVRCRRAATVCSTSTTPSPRPPSPTRPPPSARAPPTSDEASPPSR

SEQ ID NO: 181068 - protein, 178 aa, Triticum aestivum
  unsure (1)..(178): unsure at all Xaa locations
  Clone ID: PAT_TA_75486.pep
CRFAEVTTVLSGSNYPTANIFYPYIMNVKIAIVEHAMGSNANLKKNGRSMLDKFDKYWDSNSEGEGNXNSGKNKKKEKNNVMVIATILDPRFKMKLVDYCFKKMYGKEKGSSEAKEIKSEFFDLYATYEMENRKNEAGNNNEQSSVCSRQTSTSMSSLSSGFQSFLEETNSEPSKSEL

SEQ ID NO: 181069 - protein, 179 aa, Triticum aestivum
  Clone ID: PAT_TA_75487.pep
YGPYRADSDGGLALEPAAFQGRYPAQVKFVIDGDFMPIPESSIRNGHRENYSRGKFWPELTFTQVEKLRALFRPVTSLPVPEAPPLHYVDNRHPAQSAAFLPPSASYPTQPTSYVHHPSTFAPTPAAHLVPNQPYPRPDSHLPVTAQYTTPAYYATPTAYPYQAGYQAYGPPPATYHYA

SEQ ID NO: 181070 - protein, 110 aa, Triticum aestivum
  Clone ID: PAT_TA_75488.pep
EKRPISFAMSIHVCIVGPSQVGKSCMMMVLKNGVFPYMYNHGNIRYDESDDKYLHPSPDSTESFGITEQIEGQRINFFYDDTIGNRHEYYREDRLKKIQTSRCILLGDGC

SEQ ID NO: 181071 - protein, 43 aa, Triticum aestivum
  Clone ID: PAT_TA_75489.pep
LEPSTISSRLPPPPSPLNPRRRRPGSPFTSHSLDACQGRPATT

SEQ ID NO: 181072 - protein, 56 aa, Triticum aestivum
  Clone ID: PAT_TA_75490.pep
RALVTRLEVGPRTGRGGRRNRFRSAPHAATPVGSRIAGVAGGWAIGRSWPCDLDGL

SEQ ID NO: 181073 - protein, 44 aa, Triticum aestivum
  Clone ID: PAT_TA_75491.pep
MLQRSSLSLGELCLSMFCLLTHMTLIFPLDFLSCLFYVLQIFCL

SEQ ID NO: 181074 - protein, 124 aa, Triticum aestivum
  unsure (1)..(124): unsure at all Xaa locations
  Clone ID: PAT_TA_75492.pep
SPPPPQSRAPSISPRTTNLASSSIAPLMASSSSALRMPAAVCAVLVLLLLSAVSRCEADLLQXTVAGGRRMLAGGSNAAAAFSRPTETTAGSSSWRTADGRATAAMPYSESKRSSPGGPDPQHH

SEQ ID NO: 181075 - protein, 166 aa, Triticum aestivum
  unsure (1)..(166): unsure at all Xaa locations
  Clone ID: PAT_TA_75493.pep
GLQVITPYAARAVAAAVLPLLLLVVATSAYGGAHGRRPISRRSFPNGFLFGTATSSYQYEGGAMEGGRGPSIWDNFTHQHPDEIADRSNGDVAVDSYHLYXEDVRLVKDMGMDAYWFSISWTRILPDRTLKGGVDREGITYYNHLIDELLSKGVQPFVTLFHWDSP

SEQ ID NO: 181076 - protein, 150 aa, Triticum aestivum
  unsure (1)..(150): unsure at all Xaa locations
  Clone ID: PAT_TA_75494.pep
MGISRDSMHKRRATGWKXRAWRKKRKYELGRQPANXKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATE

SEQ ID NO: 181077 - protein, 174 aa, Triticum aestivum
  Clone ID: PAT_TA_75495.pep
DKHAQARALVQGICSRGRCSSSRSETKQGRDAWRTELLVKRRGDAGDGGRRGSVSQERLRRSQGTPARSGQTADPAGDTAGEAGAIDVVFVADAGAWQCRLRRARRTELNLGRRRPRAAMATCAGAGGVQDGGAKAFGDGSSYHCAAVSMVTAEVEEGHALADGRPGNARARQR

SEQ ID NO: 181078 - protein, 169 aa, Triticum aestivum
  unsure (1)..(169): unsure at all Xaa locations
  Clone ID: PAT_TA_75496.pep
VLDLFFGFIKSSLLDSSKSCESKALFALSTILKEHHEYSLAQLDEIMMLLHGIKPDSNNARFRXQLVCYKYLLVHMIKVHEESTSQKAFLIXNELILALKSKKESRRLAYDVLLAISTSLRSSELNNGDSDLQRLFTMVMGYLSSPSPHIVSGAIAALSLLIYTDADFC

SEQ ID NO: 181079 - protein, 103 aa, Triticum aestivum
  unsure (1)..(103): unsure at all Xaa locations
  Clone ID: PAT_TA_75497.pep
LAGRSSVIQLNRFDCAIRSGAVRATISSTGNVAGGGXKVSWPEVVGLPAXEAKAVILKDKPDADVIFVPFGAGVQQDLSLNRVRVFVGTIASVVTVVLAPKVG

SEQ ID NO: 181080 - protein, 92 aa, Triticum aestivum
  Clone ID: PAT_TA_75498.pep
ELMELGRFKQAEADCDQALLLDKKNVKAYLRRGTRKESVLNYQEALQDFRHALALEPQNRTALAAEKRLQKHLRFGWRSKTATFKFCDQTSL

SEQ ID NO: 181081 - protein, 99 aa, Triticum aestivum
  Clone ID: PAT_TA_75499.pep
VVCHLAFLLCFLLRQNIQWKPSYGRNRGKPCKHYVSNLFKLKSNSFRRYENKLLSALNTDKTTPSIFMYIYFPYLPYNMSLNFKFYMLTEHHLSNIAFF

SEQ ID NO: 181082 - protein, 144 aa, Triticum aestivum
  Clone ID: PAT_TA_75500.pep
QVVSSAELELSWIVVDPQSSRAVNVSSRRAVAVDRHWYTGETLVRYAVVLGGSKFEATVTCSEEAGCLNVRDVSLTVEDADGAAVSGEGSLRLLAAAMEGPRSKAGERERDEARRMYEEFVRSKRGRKESKARREVLVDLCCSA

SEQ ID NO: 181083 - protein, 99 aa, Triticum aestivum
  Clone ID: PAT_TA_75501.pep
VRSSAELLLPESVKGLKALLSIAAHRRLWFPERLHRDFLEVMFTNRKERAELLEGLVVSNKDATVPVLPQKILLLWGHNDDIFNIELAETIKEQLGEKT

SEQ ID NO: 181084 - protein, 68 aa, Triticum aestivum
  unsure (1)..(68): unsure at all Xaa locations
  Clone ID: PAT_TA_75502.pep
WIPRAAGRHDAKLEALPSPRXLMNTHMHHSLLPASVARTPTLRFVYICWEPKDMLVSMWHFGNTITPM

SEQ ID NO: 181085 - protein, 106 aa, Triticum aestivum
  Clone ID: PAT_TA_75503.pep
RDQSGRTEREHKTRLGGGGQVEEEAWCSAGASRPRSYTALHRPPPRRLPRRRCSDLRAAYHECFNRWYADKFAKGQWNKDDCAADWHKYRACLEEHLEEQHLRQIL

SEQ ID NO: 181086 - protein, 64 aa, Triticum aestivum
  unsure (1)..(64): unsure at all Xaa locations
  Clone ID: PAT_TA_75504.pep
MDMEIPVIDLXGLTGDAPQRSQAIARVHEXACQDWGFFWVDSHGVDAALMEEVKRFVYAHYDEH

SEQ ID NO: 181087 - protein, 161 aa, Triticum aestivum
  unsure (1)..(161): unsure at all Xaa locations
  Clone ID: PAT_TA_75505.pep
MAVWQNKKLMKGKKGGKKKIIDPFTRKEWYEIKGPQXFSVRQVGKTLVTKTTGTKIASDSLKGRVLEANAADLFEDEDKAYLKFRLRVDDVQGKNCLTNFHGLSLTTDKVKGLVRKWQSLIEGSIDVXTNDGYLLRVFVIGFTKRRQNQLKQTSYAQTAQI

SEQ ID NO: 181088 - protein, 168 aa, Triticum aestivum
  unsure (1)..(168): unsure at all Xaa locations
  Clone ID: PAT_TA_75506.pep
LSPDLRDTVWKIAVSTGGEKEYNQLFEIFEKAXPQCAHGLRALMILGTTKNEDLLKRTLKLTLDTKYVRSQDSYAVLFGVASNPLGTQLAWEWFTQNWDAXFKQFGEGNFLLSRMISYATXXFTXKAKAKEVKKFFHSKTVPSAVRTIRQSIEVIRTNSAWLERDRKA

SEQ ID NO: 181089 - protein, 102 aa, Triticum aestivum
  unsure (1)..(102): unsure at all Xaa locations
  Clone ID: PAT_TA_75507.pep
MARGLKKHLKKXNAPSHWMLDKLGGAFAPKPSSGPHKARQCLPLILILRNRLKYALTYREVQSILMQRPIMVDGKVRTDETYPAGFMDIISIPKTGENYWLL

SEQ ID NO: 181090 - protein, 159 aa, Triticum aestivum
  unsure (1)..(159): unsure at all Xaa locations
  Clone ID: PAT_TA_75508.pep
AGGAQPILKSSNVIGKGGFGEVYKGVLDNVLVAVKKPIGPYCAGEXQFANEVIIXISXYIHKNIVRLIGCCLEVDSPLLVYEFISKGSMHDILHEFREPLNLDVRLSIVLESAHGLAYXMHSQAHTKILHGDIKPANILLDNNFVPKISDFGISRLIAV

SEQ ID NO: 181091 - protein, 109 aa, Triticum aestivum
  unsure (1)..(109): unsure at all Xaa locations
  Clone ID: PAT_TA_75509.pep
LAKVSEKKKLLEIIIYSIMSLFIAFFTSINITFAVYGYSWNLNQVIGDTYSXGLITLLILTCIFYFSSGIYLIYRLSSISKGMKKDRFQGKKKYQLLAISIVITFFNVL

SEQ ID NO: 181092 - protein, 80 aa, Triticum aestivum
  Clone ID: PAT_TA_75510.pep
TSGSPGCRRPSSAGRGISTSADRGVGGGVRTRTRRRRVRATWLRRPARARADYDYLIKLLLVGDSGVGKSCLLLRSSDGS

SEQ ID NO: 181093 - protein, 121 aa, Triticum aestivum
  Clone ID: PAT_TA_75511.pep
MAPPRSCSSARLLPTHGGAPTTRRPSAPPKTCAPSVPVRHSARQAANPSSTPIAQRATLRLVQELGVVGPKERMTVKTAEALLCRFDEPLTEDDIACISKLTRLDIQALRTMAGLAGPDGA

SEQ ID NO: 181094 - protein, 35 aa, Triticum aestivum
  Clone ID: PAT_TA_75512.pep
TPSPTPKHARRKTVTAMDVVYALKRQGRTLYGFGG

SEQ ID NO: 181095 - protein, 118 aa, Triticum aestivum
  Clone ID: PAT_TA_75513.pep
MADQLTDDQIAEFKEAFSLFDKDGDSCITTKELGTVMRSLGQNPTEAELQDMINEVDADGNGTIDFPEFLNLMARKMKDTDSEEELKEAFRVFDKDQNGFISAAELRHVMTNLGEKLT

SEQ ID NO: 181096 - protein, 175 aa, Triticum aestivum
  unsure (1)..(175): unsure at all Xaa locations
  Clone ID: PAT_TA_75514.pep
YTPTAKSRRQVGEGVDAKAPVQQVDVQSPGPGQILVKIXWTGLCASDKSLIHDEWASFGVAMQPATKGIAGHEGAGVVVAVGDDMHQKWKVGDRAGIKWVWGTCGECEFCTNGSDELHCPKQINSGFTAAGTFQQYAVSDGRYTTRIPXGVSDEEAGPIMCGGVTAYVACKRSSV

SEQ ID NO: 181097 - protein, 191 aa, Triticum aestivum
  unsure (1)..(191): unsure at all Xaa locations
  Clone ID: PAT_TA_75515.pep
IAQEIEEIIGLDCSNAIRCSAKEGIGIIEILDAIVNKVPPPKDTLKNPXLRALIFDSYYDAYRGVIVYFRVIDGSIRKGDKICFMANKKEYVADEIGVLSPNQMEADELHAGEVGYLSASIRSVADARVGDTITHFAKRAESALPGYSEATPMVFCGLFPLEADQFEELREALGRLQLNDAALKFEPESSS

SEQ ID NO: 181098 - protein, 169 aa, Triticum aestivum
  unsure (1)..(169): unsure at all Xaa locations
  Clone ID: PAT_TA_75516.pep
VSSLLAGLAQLEELDLSSNNFHNISGLLAVLHGCQNLTTLILHQNFGGEELPGDGIIGGFKSLKVLALGDCALKGRVPEWLSQCKKMEVLDLSRNQLVGTIPLWIGQLHHLCYSDLSNNSLVGEVPKSLTLLKGFATAXRSEGMTFTNMPLYVKHNRSTLGRRLNELPN

SEQ ID NO: 181099 - protein, 34 aa, Triticum aestivum
  Clone ID: PAT_TA_75517.pep
ELAAFHDMDQQCLSRPRTVRLRPKRRLLLVRVLG

SEQ ID NO: 181100 - protein, 159 aa, Triticum aestivum
  unsure (1)..(159): unsure at all Xaa locations
  Clone ID: PAT_TA_75518.pep
MAEVDAAAAAAAGAQAVQLIDGEGEFAGESAERFMTYAGVAGCGLSYAVVAIMGPQSSGKSTLLNLLFGTNFREMDAFRGRSQTTKGIWMARCVGVEPCTVVMDLEGTDGRERGEDDTAFEKQXSLFALAISDIVLINMWCHDIGREQAANKPLLKTVF

SEQ ID NO: 181101 - protein, 159 aa, Triticum aestivum
  unsure (1)..(159): unsure at all Xaa locations
  Clone ID: PAT_TA_75519.pep
EVAKESKTVRCWQPIHPDAYMPTEILEIILTDADAATKGSLFSTCSRVYNLKKNQNLATAILKKYARKQIKTVGLHYEYAHEASLAGWIVDXYHNFIEAHNKKQIDLPENYDFASCFNSDDYASWPEFKELLRKCHLFTDEINGVFGPQCYLQLRHFSL

SEQ ID NO: 181102 - protein, 157 aa, Triticum aestivum
  unsure (1)..(157): unsure at all Xaa locations
  Clone ID: PAT_TA_75520.pep
MPAGHGLRSRTRDXFARPFRKKGYIPLTTYLRHLQWSGEHVDVKVNGAVHKGMPHKFYHGRTGRVWNVTKRAIGVEINKQVGNRIIKKRIHVRVEHVQPSRCNEEFLQRKLNNDXLKAEAKARGEVISTKRQPAGPKPGFMVEGTTIETVTPIPYDV

SEQ ID NO: 181103 - protein, 126 aa, Triticum aestivum
  Clone ID: PAT_TA_75521.pep
RVAASRQTSWAVFAPPPPLSLSGHLGALAGDPGCFPLDDEAYPPSSHWPTLTPVIFGSYLVFRVCLDLVPLAQPAPKQCFTPRCPVNCCASTHFGENQLALGSSGISPLTTTHPLILQHQSVRTSA

SEQ ID NO: 181104 - protein, 120 aa, Triticum aestivum
  Clone ID: PAT_TA_75522.pep
MSSSVELEVPAVEVPIPSSEPAASEPQVDNGDSSSSSSSSSSSSSSSSSSSDDVEFLKLKRCEAFADIPRYPVFLKGIKNGNKRIGTTQSDHVLIFQDCENTEFSICNNQRYSTLIAVDC

SEQ ID NO: 181105 - protein, 172 aa, Triticum aestivum
  Clone ID: PAT_TA_75523.pep
GKAISGTISPIQGLNSPNMLVQDCKKTGYIGFPIHVHGGFNERTDDLKDMCYPSASTGHDNENEMNGMIHDQRETDNITMIPSDSTLSRQSTVKGPELKGPAECQKELWQPASPVDSLYHPPGNGLYAQSVALQLKHHPSGGPATCMVDLISVPAAQATSNSASLLQPCTNQ

SEQ ID NO: 181106 - protein, 93 aa, Triticum aestivum
  unsure (1)..(93): unsure at all Xaa locations
  Clone ID: PAT_TA_75524.pep
DPPGCRSMVGSPDLISIPGETGRMYEANVDDVGYRLVAIYTPXREDGVEGRPVSASTEPIAVEPEIYKEVKQKLDDGSVKFEVLCDKDRTPKK

SEQ ID NO: 181107 - protein, 177 aa, Triticum aestivum
  unsure (1)..(177): unsure at all Xaa locations
  Clone ID: PAT_TA_75525.pep
MAPAVMASSATTVAPFQGLKSTAGLPVSRRSGSASXSAASSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIXAFRPPGCEESGKA

SEQ ID NO: 181108 - protein, 37 aa, Triticum aestivum
  Clone ID: PAT_TA_75526.pep
APIPGHRRGLPKTSQPAWWRPGRRCPRQLSLNGIGLP

SEQ ID NO: 181109 - protein, 142 aa, Triticum aestivum
  unsure (1)..(142): unsure at all Xaa locations
  Clone ID: PAT_TA_75527.pep
MYPIEHGIVTNWDDMEKIWHHTFYNELRVAPEEHPVLLTEAPLNPMANREKMTQIMFETFNTPAMYVAIQAVLSLYASXGRTTGIVLDSGDGVSHTVPIYEGYALPHAIMRLDLAGRDLTDYLMKILTERGYSFTTTAEREI

SEQ ID NO: 181110 - protein, 107 aa, Triticum aestivum
  unsure (1)..(107): unsure at all Xaa locations
  Clone ID: PAT_TA_75528.pep
MASSSSAGGDTVSKLVTILSIDGGGVRGIIPATVLAFLEKELQKLDGPDVRIADYFDVVAGSSTGGLLTVMLTAPDKDGRPLFDAKDLAKFXIDESPKIFPQKDSIF

SEQ ID NO: 181111 - protein, 131 aa, Triticum aestivum
  Clone ID: PAT_TA_75529.pep
QQKSSSFTNRSLNCDTSIALSELVKGPRPEGSGHGSFIKQPLSDAVLDGRDGVHKDVAADQAERNLTVNGRAPIECEGIHKDVAADEAEGNLTVNGPVSIVGNADHMDLSVTKEAAEATGYDREKVGCGFS

SEQ ID NO: 181112 - protein, 142 aa, Triticum aestivum
  Clone ID: PAT_TA_75530.pep
TPLDQVQQRVGCVRGAYDTVSMTVKELIANLRGPEGTHSLYLAGDNLEESFPGLMPYVSPLPSETFLKKEELASLGLWIGRDGQVTHAHFDCVHNFMTVIAGEKEFTVAPPASFLNMYPHTFASCNKQDQKGEIYRFSQVDV

SEQ ID NO: 181113 - protein, 180 aa, Triticum aestivum
  unsure (1)..(180): unsure at all Xaa locations
  Clone ID: PAT_TA_75531.pep
CRNRHEDRLSPCTLEGMDIYSTVLYHLNEEMRLSYLAQELISVDRLSPQAWCAVGNCFALRKDHXETALKNFQRAVQLDSXVAYAHTLCGHEYSALEDYENSVKFYRCALQVDERHYNAWYGLGVIYLRQEKLEFAEHHFRRAFQINPRSSVLMCYLGMALHALKRDEDALEMMDKAIFS

SEQ ID NO: 181114 - protein, 98 aa, Triticum aestivum
  Clone ID: PAT_TA_75532.pep
RPWPCAARGLCRGPYPIRWPPWSAWILCEMAPTVAILRRSELSTRSLPASTPVLLLHIAAAFLRLPIFILDARSRMMTEELLSLRLGMSRSLMCSADS

SEQ ID NO: 181115 - protein, 121 aa, Triticum aestivum
  Clone ID: PAT_TA_75533.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSPWICNVAYPLNLFEEGSVTNLFTSIV

SEQ ID NO: 181116 - protein, 130 aa, Triticum aestivum
  unsure (1)..(130): unsure at all Xaa locations
  Clone ID: PAT_TA_75534.pep
MAAAFSSTVGAPASTPTNFLGKKLKKQVTSAGNLPMARAPRPTRFTVMAAENLDEKRNTDKWKGLAYDISDDQQDITRGKGIVDSLFQAPTGDGTHEAVLSSYEYVSQGLKKYDFDNTMGGFYXIAPAFM

SEQ ID NO: 181117 - protein, 143 aa, Triticum aestivum
  unsure (1)..(143): unsure at all Xaa locations
  Clone ID: PAT_TA_75535.pep
SNAEPHPCWGCHDLLTRDALERSDSLKHDCFTIRCHVLVCTPDEVLLPHIHQHFSHLLQNMVGADVTFEVGGETFTAHRCVLAARSQVFMAQLFGPMIXGTATSDNVLHIKDLEAKVFRALLHFIYTDSFPGMDTDSVRMEDD

SEQ ID NO: 181118 - protein, 154 aa, Triticum aestivum
  unsure (1)..(154): unsure at all Xaa locations
  Clone ID: PAT_TA_75536.pep
ASALHQTTSFLXTAPRRDDLFRSVGNFGGRITMRRTVESAPQSIWYGPDRPKYLGPFSEQTPSYLTGEFPGDYGWDTAGLSADPKTFAKNRXLEVIHSRWAMLGALRCVFPEILSKNGIEFGEAVWFKAGAQIFSEGGLDYLGYPYLVHAQSIL

SEQ ID NO: 181119 - protein, 52 aa, Triticum aestivum
  Clone ID: PAT_TA_75537.pep
RAAGKTSKARLTGIQVERDKLNKYGRPLLGCTIKPKLGLSAKNYGRACYECL

SEQ ID NO: 181120 - protein, 98 aa, Triticum aestivum
  Clone ID: PAT_TA_75538.pep
EVEVQRVEEMAEISDAPAVTSGELAAVLRAMDEKYRALFDAISKQASSSKSEAEIKEEIHPLQMPHVKLEGPENYVSWAEHAETILVSRKLEGYILGT

SEQ ID NO: 181121 - protein, 129 aa, Triticum aestivum
  Clone ID: PAT_TA_75539.pep
MAAKCYPTVSDEYLAAVAKAKRKLRGFIAEKNCAPLMLRLAWHSAGTFDVATKTGGPFGTMKCPAELAHGANAGLDIAVRLLEPIKEQFPILSYADFYQLARVVAVEVTGGPEVPFHPGRQDKPEPPPE

SEQ ID NO: 181122 - protein, 33 aa, Triticum aestivum
  Clone ID: PAT_TA_75540.pep
RNVAKSSVTRRLSGRCTSIFKLSATLLSSSLLL

SEQ ID NO: 181123 - protein, 71 aa, Triticum aestivum
  Clone ID: PAT_TA_75541.pep
MYYTAILESMVDGARLRNDKKRTGMENRCLAREIVNVVTCEGSERVEQHEVFGQVKDQLHCCAMSAWPDFL

SEQ ID NO: 181124 - protein, 84 aa, Triticum aestivum
  unsure (1)..(84): unsure at all Xaa locations
  Clone ID: PAT_TA_75542.pep
ASAAEEIESDIVSLAQSEDSDVYDIYTVKGGGLIPTXREGASAASYPLLQVDDEDGECYDDDEYPYDTDDSNAEDNPLYDYPEE

SEQ ID NO: 181125 - protein, 68 aa, Triticum aestivum
  unsure (1)..(68): unsure at all Xaa locations
  Clone ID: PAT_TA_75543.pep
VLYKFTQGPYFPLAMSAVLMVIMIVWHYVHVKRYKXELQHTVSPDEVNAPPLAXHDLKRVPGLGLFYT

SEQ ID NO: 181126 - protein, 59 aa, Triticum aestivum
  unsure (1)..(59): unsure at all Xaa locations
  Clone ID: PAT_TA_75544.pep
FCNARIDMFKDTXRLAVDKWGLIEVVEEPADFKVNEDNNMSEIEYELVNVPPKKQERKK

SEQ ID NO: 181127 - protein, 33 aa, Triticum aestivum
  Clone ID: PAT_TA_75545.pep
SGCCYWRCSRRWRPTDALCGNALSLHKYVDLAF

SEQ ID NO: 181128 - protein, 56 aa, Triticum aestivum
  Clone ID: PAT_TA_75546.pep
IFEKLAGESAKLARYNKKPTITSREIQTSVRLVLPGELAKHAVSEGTKAVTKFTSS

SEQ ID NO: 181129 - protein, 116 aa, Triticum aestivum
  unsure (1)..(116): unsure at all Xaa locations
  Clone ID: PAT_TA_75547.pep
MYTARRKIQKDKGVEPLRVXDTVAHAFFDLENGNQELKSDLEDLYINTAIQIDVVGNRKAVVIHVPYRLRKPFRKIHVRLVRELEKKFSGEDVVXLATRRIVRPPGKGSAVQRPRT

SEQ ID NO: 181130 - protein, 30 aa, Triticum aestivum
  Clone ID: PAT_TA_75548.pep
TLTAANYQIIWLMSPINLNLDSSLNCTVTT

SEQ ID NO: 181131 - protein, 35 aa, Triticum aestivum
  unsure (1)..(35): unsure at all Xaa locations
  Clone ID: PAT_TA_75549.pep
RHYFQNTPGLIFVVDSYYRERVVQARDXLHRMLNE

SEQ ID NO: 181132 - protein, 143 aa, Triticum aestivum
  unsure (1)..(143): unsure at all Xaa locations
  Clone ID: PAT_TA_75550.pep
MAAAMRFAAGVQRAQSVYKAVVSPLVEGERRRLMPRLINGGRPAYFPQSSMSSGGDGCNTALKRPCAKPALDLDAXRAWGGRQIAEIETKKHDLFYQLAELDSRFPSRNKYFRENRELIHHLFGHIEPNPSDTLWRFCRARES

SEQ ID NO: 181133 - protein, 97 aa, Triticum aestivum
  unsure (1)..(97): unsure at all Xaa locations
  Clone ID: PAT_TA_75551.pep
LPPHMLTILPPTDSRLRPDQRHLEYGEYEKANSEKLRLEQLQRQARRLQEKGWQPRWFRKDEDDSHCYLXGGYWEAREKGNWDGIPHIFGQSSASTG

SEQ ID NO: 181134 - protein, 92 aa, Triticum aestivum
  Clone ID: PAT_TA_75552.pep
LQHESLCSMLECHESSWALQMRRSFSGAICLFPAALVSTTSSHYDHPNHAHPPLSHVFLLPDHNRCEFLEYSCVSDPFMIEIVVPRKKKKKK

SEQ ID NO: 181135 - protein, 88 aa, Triticum aestivum
  Clone ID: PAT_TA_75553.pep
GKAMPTSVSDHLNVFFRYSTLVAIFSSSKNATACTACPNIREPCGTQRALAHATIARRRCWLILRILGTRMHSWQCRNPVARTPAGTR

SEQ ID NO: 181136 - protein, 93 aa, Triticum aestivum
  Clone ID: PAT_TA_75554.pep
TTYIRILLTQGFNKGITTIKQQDGRTKRSYATTITTNYNQQDEHRGKHMARKESSKVSVQGPSTDTQARNTRTRSNPLEAEDQDDTTTTEGQI

SEQ ID NO: 181137 - protein, 42 aa, Triticum aestivum
  Clone ID: PAT_TA_75555.pep
SCVFSLFLYSVNLTSQFCRTPPKCKLVNDSSSQKKKKKKKKK

SEQ ID NO: 181138 - protein, 119 aa, Triticum aestivum
  unsure (1)..(119): unsure at all Xaa locations
  Clone ID: PAT_TA_75556.pep
RRVDNCTTTLHGGVISLNYPSLVVLFGSRTHVRTLXRTVTKVSEQPSETYRVSVTVPDGVYVTVTPXTLVFKQKRKKMSFTVECRTDVVKPAGAWDFGSIAWXSVDHKVTSPIAFTWGK

SEQ ID NO: 181139 - protein, 83 aa, Triticum aestivum
  unsure (1)..(83): unsure at all Xaa locations
  Clone ID: PAT_TA_75557.pep
CPTRRVLTSQTTICAARFRQMVPSRTSIPASPXTRGWAATARPMHGGPPAGVKNKLAVLLLLLASSQRIGRRPVHACITWVDS

SEQ ID NO: 181140 - protein, 115 aa, Triticum aestivum
  Clone ID: PAT_TA_75558.pep
WRRLASCPSWGHHFGAGISRSDSCVVDGSVLYGSGGGAFVSSLLLCKLKILPWLPFCCGELRALGVVSVLLCSMTRKKPPQPAYRPGFTGGAPSPGSCLALVDCGAPVLHRGFGM

SEQ ID NO: 181141 - protein, 120 aa, Triticum aestivum
  Clone ID: PAT_TA_75559.pep
AGSMVTTQSTGTDRQPAGGFRNTNRQPMEFYSVYDVPIDQLLGVPPDESDLHECWEGFGSNGGQLVAPYCLSTHDETPDTTPPETESAAHTADGPESGWRRKRGPRKRRVAVVHRPILAS

SEQ ID NO: 181142 - protein, 46 aa, Triticum aestivum
  Clone ID: PAT_TA_75560.pep
KLARYNKKPTITSREIQTSVRLVLPGELAKHAVSEGTKAVTKFTSS

SEQ ID NO: 181143 - protein, 118 aa, Triticum aestivum
  unsure (1)..(118): unsure at all Xaa locations
  Clone ID: PAT_TA_75561.pep
PQGSVPDPRSDQGEVHEVRATXPPGRSPPLTLRRETSNPLLTQASDGDAARLRAGLDPCADAMELSWIPSAAFGSWWLFSFSRTQQVRQSVRPIQFFFSFLRSKMHALNVLLFERWIE

SEQ ID NO: 181144 - protein, 77 aa, Triticum aestivum
  Clone ID: PAT_TA_75562.pep
MNVESYKPAGAEGSAPLKECPVRCKIRCSATSHKKPCNFYCNYCCKRCLCVPSGTVGNKEECPCYNNMNTQDGKPKC

SEQ ID NO: 181145 - protein, 53 aa, Triticum aestivum
  unsure (1)..(53): unsure at all Xaa locations
  Clone ID: PAT_TA_75563.pep
GKNKAVEYDKFIECCLTVKGLTEKFKXKDPAYSGFATFGYEAFMPTVLPLLIA

SEQ ID NO: 181146 - protein, 90 aa, Triticum aestivum
  Clone ID: PAT_TA_75564.pep
RAQQAGSMTICVYGRRRNGLVKTVCALPQAMLVRAMAWAAHRRLPACLAQLHDTGQGQSSDFSNSSRPAGFSARACECFLHYICFGAWGS

SEQ ID NO: 181147 - protein, 69 aa, Triticum aestivum
  Clone ID: PAT_TA_75565.pep
VYLAGHPACGGGRADTVAGLVGVGAALVGAERDAEPARHAGAPAPRVAVVEAPRTLRCYHCCRRGREFL

SEQ ID NO: 181148 - protein, 120 aa, Triticum aestivum
  unsure (1)..(120): unsure at all Xaa locations
  Clone ID: PAT_TA_75566.pep
AAASTAVVTTQSTAGKLPYMLLYPTHLPNHKGRRRRPHRXGHPQQHLHLSMVHRSFVSSTPTTVRARPNKERATRSPRTGTCRETSAVCVTLCVSLCQQLFDHGVFYLCVALGRVHLSYA

SEQ ID NO: 181149 - protein, 112 aa, Triticum aestivum
  unsure (1)..(112): unsure at all Xaa locations
  Clone ID: PAT_TA_75567.pep
AAASTSSGNNAEYAGIRLSFWVVMAVFTNNGAVAVWLGALMLMATLLASQGKPTYIGCFEAKQNCFPDECQKKCEDXVGKDTLGDCHRERESKPYPGLECCCFRKDTPPNDK

SEQ ID NO: 181150 - protein, 66 aa, Triticum aestivum
  Clone ID: PAT_TA_75568.pep
RWATAPAAYIPMVLPDKIASTNSPSRCTAAAEILQQKRSNTPIASDGLAPPLMDQSGAVVVSREEE

SEQ ID NO: 181151 - protein, 107 aa, Triticum aestivum
  Clone ID: PAT_TA_75569.pep
KYAMPRNHNTSSGSFDTQCRSTRSRDSGRGFVRASQLVATRSSARSGQSDDASLAYRLQQEEFMTAFDNEGGERQPQNTISTARANLRAMASRAERAVLLRARGWPL

SEQ ID NO: 181152 - protein, 101 aa, Triticum aestivum
  unsure (1)..(101): unsure at all Xaa locations
  Clone ID: PAT_TA_75570.pep
SPGRLIRVSGSDSKQYLPYTTSSTITIKIVLRALSHIRVSAXLWPIILELSSGFLAMTLSVIRPSWRVTPRSISSTIFVPKKAPVKLDKSRSTKLTHPKHT

SEQ ID NO: 181153 - protein, 171 aa, Triticum aestivum
  unsure (1)..(171): unsure at all Xaa locations
  Clone ID: PAT_TA_75571.pep
SSRSHGKGERSTISIVVIGHVDSRKSTTTGHLIYKLGGIXERVIERFEKEAAEMNKRSFKYAWVLDKLNAERERGITIDIALWKFETTKYSCTVIDAPGHRDFIKNMITGTSQADCAVLIIDSTTGGFEAGISEDGQTREHALLAFTLGVKQMICCCNKMDATTPKYSKAR

SEQ ID NO: 181154 - protein, 31 aa, Triticum aestivum
  Clone ID: PAT_TA_75572.pep
SLVPVDQSTVSLVETFGKFNEVLEPGCHFLP

SEQ ID NO: 181155 - protein, 111 aa, Triticum aestivum
  unsure (1)..(111): unsure at all Xaa locations
  Clone ID: PAT_TA_75573.pep
TSSAPPVSSSSPVPRPLVGARSSQDSRGGSAGGGQSSLGYLXFGDCEPXKPAAAPAAKPAPAEKPALAAADITQQIPACIPGSPANNYYRADSQNTGNFLTDRPSTQVHAA

SEQ ID NO: 181156 - protein, 66 aa, Triticum aestivum
  Clone ID: PAT_TA_75574.pep
HNGDTHSKLFPFFMTGLMPQEAVQYLDLVCRCTKNTRHLVSMLRSLAERLEDANPSIIHNNPTRLY

SEQ ID NO: 181157 - protein, 133 aa, Triticum aestivum
  unsure (1)..(133): unsure at all Xaa locations
  Clone ID: PAT_TA_75575.pep
MYTARKKIQKDKGVELSEFEDTVAQAFFDLENGNQELKSDLKDLYINTAIQIDVVGNRKAVVIHVPYRLRKPFRKIHVRLVRELEKKFSGQDVVFVATRRIVRPPKKGSAVQRPRTRTXTAVHDGILEDVVYP

SEQ ID NO: 181158 - protein, 86 aa, Triticum aestivum
  unsure (1)..(86): unsure at all Xaa locations
  Clone ID: PAT_TA_75576.pep
SNAPKVAVAKKGDAKXPSAAKVAKAVKSGSIKKTAKKIRTSVTFHRPKTLSKARDPKYPRISTPCRNKLDQYPILKYPLTTESAMK

SEQ ID NO: 181159 - protein, 55 aa, Triticum aestivum
  Clone ID: PAT_TA_75577.pep
RLRRQRSRYKVQQRQAGHTSKAGWEHVPWRRAWPLQGPGFIQDEAQGSSVIWKGS

SEQ ID NO: 181160 - protein, 80 aa, Triticum aestivum
  Clone ID: PAT_TA_75578.pep
GEGRGIPDKRVHSVPLRVCCSMSAALMECFDLIHDVCTTLMCHRQVSYQMQIQHVKPICLWPPLVFLVGILATPGKCEEG

SEQ ID NO: 181161 - protein, 65 aa, Triticum aestivum
  unsure (1)..(65): unsure at all Xaa locations
  Clone ID: PAT_TA_75579.pep
KRKFTNLWPRKPKEMISPMTEGQKRVPFVLNVRPQLTRVLEIFIWFKAPSSXEGKNPDPRADHSL

SEQ ID NO: 181162 - protein, 67 aa, Triticum aestivum
  Clone ID: PAT_TA_75580.pep
AVLTGREGVQGTIFFTQEGEGPTTVTGSVTGLKEGLHGFHVHALGDTTDGCMSTGPHFNPACPVHWA

SEQ ID NO: 181163 - protein, 64 aa, Triticum aestivum
  Clone ID: PAT_TA_75581.pep
WTKATTLSCTAVTRYGAGPAAAMLSIFAAANKVGLGNGQDKVPHTFIVGAQSVKHGGTYAVSSR

SEQ ID NO: 181164 - protein, 85 aa, Triticum aestivum
  unsure (1)..(85): unsure at all Xaa locations
  Clone ID: PAT_TA_75582.pep
GAPVRIHIEPKRHCNNWDFEICGSFADRNCTIIDCTGKIVAQXGKKELIESNDFYHVTVQSGCDQAFIIGVMAVLDNIHGESTRC

SEQ ID NO: 181165 - protein, 134 aa, Triticum aestivum
  Clone ID: PAT_TA_75583.pep
PFPGNPAQLSAQEQLMYEQSQEYQLQLQQQCQRQLQQFWAEQRSEIEQATDIKNHPLPPTRIRKIMKADEDVRMISAEAPALFAKACEMFTLEMTMRSWMVAKEDKRRILQRSDIAAAVARTGIYDFLLDLFTS

SEQ ID NO: 181166 - protein, 155 aa, Triticum aestivum
  unsure (1)..(155): unsure at all Xaa locations
  Clone ID: PAT_TA_75584.pep
CRNSARGSSIVTEEMFSSMFLHKDNTACPAKGFYKYXSFVTAXEWFPEFGSGAHHVDADTRRREVAAFLAQISHETTGGWSTAPDGPYSWGLCFKEEINASSNYCDAENKEWPCVQGKSYHGRGPMQLSWNYNYWPAGEALCFDGLGQPELVASD

SEQ ID NO: 181167 - protein, 45 aa, Triticum aestivum
  Clone ID: PAT_TA_75585.pep
CPFSHTTTLCSPVMAVPFSWIVALSPSKQFTETVLHITLVVTAKP

SEQ ID NO: 181168 - protein, 159 aa, Triticum aestivum
  Clone ID: PAT_TA_75586.pep
RLLCSRSHGAVHAVFNPPDLYHRGAAVSARRAAEAPSCLDAGGDGHETWIRVERLEKGLCGASRPVFFRGVATVVAKLFNVVEPDVAMFGKKDYQQWRLICRMVRDLDFAVQIVGSEIVREADGLAMSSRNVRLSPEEREKALSISRSLVNARTAALNN

SEQ ID NO: 181169 - protein, 174 aa, Triticum aestivum
  unsure (1)..(174): unsure at all Xaa locations
  Clone ID: PAT_TA_75587.pep
LLRLRRRRTHRGSSDSSDQERPAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDXDRVVEARDELHRMLNEDELRDAVLLVFANKQDLPNAMNAAEIT

SEQ ID NO: 181170 - protein, 153 aa, Triticum aestivum
  Clone ID: PAT_TA_75588.pep
TKVLDILLRYNVKATFYTTVVFARHAPDILARMISEGHELESHSVYHGQFSEEDLLASKEELEALAGVRIKGFRMPRMMPVSDEAIEKAGYLFNSSLHPTWIPGRYNHLSRPRTTFYVKKVLQLPASVTPIIRFPLFWITFHVLPMWLYNFFC

SEQ ID NO: 181171 - protein, 134 aa, Triticum aestivum
  Clone ID: PAT_TA_75589.pep
KTCPYFHQLDALYRTKALASSSSSSGPAAVTVLSPVPLSSQTPPPAAQHVEHGAKNVITNGNGHGNGNGAAMQVKASNGSGAAAMFPSPVHAAGNAGNNNGTATNKLELKQEGIAKETAPVQPAVAMNHSYRRN

SEQ ID NO: 181172 - protein, 39 aa, Triticum aestivum
  Clone ID: PAT_TA_75590.pep
AFAAYDQGYDLFLGNLRGLVSREHIDENLASSKYWKYSV

SEQ ID NO: 181173 - protein, 33 aa, Triticum aestivum
  Clone ID: PAT_TA_75591.pep
ETNTFILGSVFILRPHSILIFRSKPIRCLRDVT

SEQ ID NO: 181174 - protein, 71 aa, Triticum aestivum
  unsure (1)..(71): unsure at all Xaa locations
  Clone ID: PAT_TA_75592.pep
IGQKDSYVXDEAQSKRGILTLKYPIEHGIVTNWDDLEKIWHHTFYNELRVAPEEHPXVLLTEAPLNPKANR

SEQ ID NO: 181175 - protein, 53 aa, Triticum aestivum
  Clone ID: PAT_TA_75593.pep
KLARSRCASSPSAARSPAPRSQTALVLSSVSAAAGAGGSPPLAKGLSFEFYRA

SEQ ID NO: 181176 - protein, 97 aa, Triticum aestivum
  unsure (1)..(97): unsure at all Xaa locations
  Clone ID: PAT_TA_75594.pep
LRQCRAWLVRYFFGVQKRKGYSMSGIWANNRPVRXALGVHKGTVPDXWLRCYHGTPYTTDIRSSVEYHRSLTSRGYRSLTLXAGDHDMTVPFIGTQA

SEQ ID NO: 181177 - protein, 139 aa, Triticum aestivum
  unsure (1)..(139): unsure at all Xaa locations
  Clone ID: PAT_TA_75595.pep
PQFHFHIHTTRQRKHDRCHLNEAVTFTGKGTPPGAAPGTSAPAGSAGRRTAPPCNHRHGDRLPACRTSPSGPWSAPPATPGRPPASXRSPGRLRGQHGAAATAGVELLLGVLSCSPGQVMAPCGSSETASGASIFSLSS

SEQ ID NO: 181178 - protein, 115 aa, Triticum aestivum
  unsure (1)..(115): unsure at all Xaa locations
  Clone ID: PAT_TA_75596.pep
RRRLSTLVSLTHSPPPPPAQRPPRDSHCASMCVRPEVYPLFAATGVAIGICAFPSLLRNXTGNPEVRLNKMGRAAGVLENHEEGRRYAEHGLRAYVQDKTPEIMPGINKFFTSPK

SEQ ID NO: 181179 - protein, 129 aa, Triticum aestivum
  Clone ID: PAT_TA_75597.pep
CSEFGTRIPYVLPLLLHLRPAATARPAWWCATRLPPHSPISIHHSATHPSISGHQHPPAHHRTPPRLQPSPYCRCSPTFFPNLVAAPNLLQSPTLLLFFFSCALCLLLTSVARCFSSSSVTSAAALLPH

SEQ ID NO: 181180 - protein, 141 aa, Triticum aestivum
  unsure (1)..(141): unsure at all Xaa locations
  Clone ID: PAT_TA_75598.pep
MGRVIRAQRKGAGSVFKAHTTHRKGACQLXVSLDYSERNGYVKGVVREIIHDPGRGAPLAKVVFRHPYRYQHVTETFIAPEGLYTGQFVYCGKKAQLAIGNVLPVGSMPEGTVVCNLESKTGDRGALARSSGNYATIISHN

SEQ ID NO: 181181 - protein, 22 aa, Triticum aestivum
  Clone ID: PAT_TA_75599.pep
PKKSLPVWFLGLISLYKTILQL

SEQ ID NO: 181182 - protein, 34 aa, Triticum aestivum
  Clone ID: PAT_TA_75600.pep
PSKHDLTSQEPISPRLSLQHGNPFVLPVTALAAH

SEQ ID NO: 181183 - protein, 35 aa, Triticum aestivum
  Clone ID: PAT_TA_75601.pep
LCAALVLQSKACRIGSRVSNHGVKTSLAPMIWGCH

SEQ ID NO: 181184 - protein, 133 aa, Triticum aestivum
  unsure (1)..(133): unsure at all Xaa locations
  Clone ID: PAT_TA_75602.pep
INDPTAAAIAYGLDEKATSVGEKNVLIFDLGGGTFDVSLLTIEEGIFEVKATAGXDTHLGGEDFDNRMVNHFVQEFKRKHKKDISGNPRSLRRLRXTSCERANRTLSSTALTTIEIDSLFEGVDFYSTITRAR

SEQ ID NO: 181185 - protein, 40 aa, Triticum aestivum
  Clone ID: PAT_TA_75603.pep
HGRLPPCRPCFQLRRKCQETCARMAYMMNMTHKCAREPSC

SEQ ID NO: 181186 - protein, 79 aa, Triticum aestivum
  unsure (1)..(79): unsure at all Xaa locations
  Clone ID: PAT_TA_75604.pep
ENIVWLIGYCHHTSPIIALHEGKHVSASVXQRLICFEYMQGGSLDDQLSAESCKLDWDKCYKIIKGICEGLLYLHNSAT

SEQ ID NO: 181187 - protein, 34 aa, Triticum aestivum
  Clone ID: PAT_TA_75605.pep
GQSSPKISCSHSLLSLSANITESYQKSSLTSLLR

SEQ ID NO: 181188 - protein, 108 aa, Triticum aestivum
  Clone ID: PAT_TA_75606.pep
MTPLPPRRKEGPSLPRRSKELWVLYRGCWLKPQTAESVAVVQAQFEPRPDHVFLATYPTCGTTWLTALAFAVSTRLRHGHAVRYSGHPLLTNHPQHLVPFLELPDRRL

SEQ ID NO: 181189 - protein, 69 aa, Triticum aestivum
  unsure (1)..(69): unsure at all Xaa locations
  Clone ID: PAT_TA_75607.pep
LILLFQDDRVGGLXVLGRDGRLADVQPVENAIVINTGDQIEVMSNGRYKSAWHRVLATRDGDRRSIASF

SEQ ID NO: 181190 - protein, 94 aa, Triticum aestivum
  unsure (1)..(94): unsure at all Xaa locations
  Clone ID: PAT_TA_75608.pep
AIAGSYGYIAPEYAYTLKVDKKSDVYSFGVLLLELVTGRKPVGXFGDGVDIVQWVRMATGSTKEGVMKIVDPRLSTVPIQDLTHVFYVAMLCVA

SEQ ID NO: 181191 - protein, 78 aa, Triticum aestivum
  unsure (1)..(78): unsure at all Xaa locations
  Clone ID: PAT_TA_75609.pep
MLQSMAAKCXRTVSDEYLAAVAKAKRKLRGFIAQKNCAPLMLRLAWHSAGTFDVATRTGGPFGTMKCPAELAHGAHAG

SEQ ID NO: 181192 - protein, 34 aa, Triticum aestivum
  Clone ID: PAT_TA_75610.pep
IGTRCRLGSTSRPDRKSCAIVDPRLKLQHGVCGR

SEQ ID NO: 181193 - protein, 99 aa, Triticum aestivum
  Clone ID: PAT_TA_75611.pep
FLFFFVIGISFWVKREDQLIQVTPSAELPGAKGVEIHSIFPGKAEHFPAGKVHQLWTLFHNGATEYMNVTYIEAQLVLPQDNSFFLQNFTKQPYFINVP

SEQ ID NO: 181194 - protein, 65 aa, Triticum aestivum
  unsure (1)..(65): unsure at all Xaa locations
  Clone ID: PAT_TA_75612.pep
RRLARRGGVTRISGLIYEETRGVLKIFLENVXRRLPTRARPRRPSRLDVVYALKRQGRTLYGFGG

SEQ ID NO: 181195 - protein, 79 aa, Triticum aestivum
  unsure (1)..(79): unsure at all Xaa locations
  Clone ID: PAT_TA_75613.pep
RCVVRKVPLYKDLYEASSRQRDHRLGILEFEVRLAEKGRLGLEGLNEARPQSXPNRKVVPEPFVPLTDKDEDSVRRALG

SEQ ID NO: 181196 - protein, 145 aa, Triticum aestivum
  unsure (1)..(145): unsure at all Xaa locations
  Clone ID: PAT_TA_75614.pep
MAYTGILLLLLATAAMAGPGHAGATEYTVGDSDGWTIGXXHLAWSQKYNFTTGDTLAFNYVPRQHDVYRVTRDAFQTCEPTAGQTVRKWASGRDVVDLAATGDYYFICNITGHCLGGLKFSVAVGAPPPPPPSPPPPSAFPTAMP

SEQ ID NO: 181197 - protein, 35 aa, Triticum aestivum
  Clone ID: PAT_TA_75615.pep
RVSFSNLSMTTLVNALHSLYIRWPVVVDLHRVDMA

SEQ ID NO: 181198 - protein, 153 aa, Triticum aestivum
  unsure (1)..(153): unsure at all Xaa locations
  Clone ID: PAT_TA_75616.pep
PSPTARSAPPTCATWSLADVAEDVPRFGGRRRRRASISRVLVDWVEAQRPXPTVARAYIAXGDHDGGEGETASCVVSSGLRLPFGEVDFGWGRPAFASYHFPWPGGARYVMPIPSARGGGDWVVYVHAAPEVVKVMEEEPTVYRAPGSSDIFG

SEQ ID NO: 181199 - protein, 161 aa, Triticum aestivum
  Clone ID: PAT_TA_75617.pep
MEPVEVESRRPKDTPFRQQRLKACQPILTPFVVIGVFLGVGILMFVLGFIMWHYNAQVVEATVRYDSVCTNPEVVPVSQSNPCTVTFIVDKNIPAPAFFYYRLTNFDQNHRRYVSSRSDTQFAGQSPQSASGLSDCTPIISVNNNATSSPGFYNPCGLIAN

SEQ ID NO: 181200 - protein, 165 aa, Triticum aestivum
  unsure (1)..(165): unsure at all Xaa locations
  Clone ID: PAT_TA_75618.pep
VMMADMTSNVKPLHRISLRYLVHILAPECALCLVDLQPHFRRHSLQDFNCFLHXIDVPHEGAVIKIECIQVECALGLDLFDDCLRCKAVQEGSERISLINSLLSSDNLSIDEFEGIAVIVRDYPVVDLGEVFXDSSEDSVSIEGVESVFDVHLGQHKVLQVAFLD

SEQ ID NO: 181201 - protein, 103 aa, Triticum aestivum
  unsure (1)..(103): unsure at all Xaa locations
  Clone ID: PAT_TA_75619.pep
MSGRGKGRKGXGKGGAKRHRKVLRXNIQGITKPAIRRLARRGGVKRISGLIYEETRGVLKIFLENVIRDAVTYTEHARRKTVTAMDVVYALKRQGRTLYGFGG

SEQ ID NO: 181202 - protein, 133 aa, Triticum aestivum
  unsure (1)..(133): unsure at all Xaa locations
  Clone ID: PAT_TA_75620.pep
MPAGHGLRXRGRPNLFARPFRKKGYIPXLTTYLRTYEVGEHVDVQVNGAVHKGMPHKFYHGRTGRVCNVTKRAIGVEINKQVGNRIIKKRIHVRVEHVQPSRCNEEFLQRKLNNDQLKAEAKARGEVISTKRQ

SEQ ID NO: 181203 - protein, 63 aa, Triticum aestivum
  Clone ID: PAT_TA_75621.pep
GFSSLGDTSPVCCLLMPRSLQSASPSCSRRPTWTPPQPAGLRQEDCGDVIFSMCMRNCKQKQG

SEQ ID NO: 181204 - protein, 34 aa, Triticum aestivum
  Clone ID: PAT_TA_75622.pep
RTVPGNIIAVQADMPFNGLTTFGGAFLSKFECSQ

SEQ ID NO: 181205 - protein, 99 aa, Triticum aestivum
  Clone ID: PAT_TA_75623.pep
DRYTTQDCSAIPSDRDRVCRPTRCAAACAHMTRSRYAAKWSKSCALRVRPCTHTISSSSAAAVCSGLGRGFARETTSTSRYDMECHWPPERQRTDFRTP

SEQ ID NO: 181206 - protein, 67 aa, Triticum aestivum
  unsure (1)..(67): unsure at all Xaa locations
  Clone ID: PAT_TA_75624.pep
MRFRCPEALFQPSFLGMESAGIHETTYNSIMKCDVDIRKDLYGNVVLSGGTTMFPXGIADRMQKELT

SEQ ID NO: 181207 - protein, 70 aa, Triticum aestivum
  Clone ID: PAT_TA_75625.pep
PNTQSCMFIIRLCHRHGKVAEALELWGDMVENGSGSFTLVSDVLFDLSCDEGKLEEAERCFHQITDLGQK

SEQ ID NO: 181208 - protein, 112 aa, Triticum aestivum
  unsure (1)..(112): unsure at all Xaa locations
  Clone ID: PAT_TA_75626.pep
QKSNCLHTRPCQECPGSRSSILPKSLLLPSFCSLLLAAVLTEACEIIAXVCSNWTKMALLGHYIRFRSGTPGRCTDAALDTVLRLRPAKRLSDKIGQNSVLEPRRFGRRSGL

SEQ ID NO: 181209 - protein, 121 aa, Triticum aestivum
  Clone ID: PAT_TA_75627.pep
GFLFFRGRNLKKGAHARVQEQLSGDELLSDSFPYRGAWKNGVLWEVDGHWVVQGAVDVDIGANPSAEGGGDDEGVDDQAVKVVDIVDTFRLQEQPAFDKKQFISHMKRYIKNLSAKLEGDD

SEQ ID NO: 181210 - protein, 42 aa, Triticum aestivum
  Clone ID: PAT_TA_75628.pep
MCRPSHHVVYDLLDGLNVEPLQLDNNLHMALEHIESSACNKR

SEQ ID NO: 181211 - protein, 119 aa, Triticum aestivum
  unsure (1)..(119): unsure at all Xaa locations
  Clone ID: PAT_TA_75629.pep
DEDTMDEDEESVAAVHFLLLLFGEAPRSEVFKTIIFSTITKKVKQCQPIDLVYDSLAKNWNKLCKCACYLWLMVLEALMETNLRVERPNVIXPAEPHHILVDLFKEMTIHKRKAQKTKK

SEQ ID NO: 181212 - protein, 35 aa, Triticum aestivum
  Clone ID: PAT_TA_75630.pep
SYGAAHRCREAEGPRSPLSSRLGRSAVLRPRVPSS

SEQ ID NO: 181213 - protein, 88 aa, Triticum aestivum
  Clone ID: PAT_TA_75631.pep
NSGPLHIKVVMVENYIEILHASTPETLIVTRFKPPLMFSKPCVSMNRGWGLICFPSQLLNKTCLLCPQPQILNESAGCATRFRREGRP

SEQ ID NO: 181214 - protein, 170 aa, Triticum aestivum
  unsure (1)..(170): unsure at all Xaa locations
  Clone ID: PAT_TA_75632.pep
QLFGEIXRQSKERIQXIRFNKDGSLVACQVAGKTADIYXILDETEATRKAKRRLHRKKEKASAKAAAAEGNGSVIDPSPAQDSQNPTVVVTDVFKLLQVLRTSKKICSVAFSPSNPPKGCLATLSLSLNNNVLETYSVDYEKVSKMYSVEIHGHRSDIRSLALNSEDNLL

SEQ ID NO: 181215 - protein, 139 aa, Triticum aestivum
  Clone ID: PAT_TA_75633.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNE

SEQ ID NO: 181216 - protein, 56 aa, Triticum aestivum
  unsure (1)..(56): unsure at all Xaa locations
  Clone ID: PAT_TA_75634.pep
MGHSNVXNSHPKNYGPGSRVCRVCGNSHGLIRKYGLICCRQCFRSNAKDIGFIKYR

SEQ ID NO: 181217 - protein, 168 aa, Triticum aestivum
  unsure (1)..(168): unsure at all Xaa locations
  Clone ID: PAT_TA_75635.pep
GWTAAPLLQSFMLXFVASLSILLRLASVSTLRISCSLFSPLRSFSTARKALPLTLSEPFSNSLQMRXTSSSNRLSIPAGVLLSSHGRALTRSSIISLGFFRPSARRVSSFSKSISSAKSISLLRSSLSCAALGMFPAITLPDLXPSDFSGNGVSCYRTCFFRTQKSHI

SEQ ID NO: 181218 - protein, 141 aa, Triticum aestivum
  unsure (1)..(141): unsure at all Xaa locations
  Clone ID: PAT_TA_75636.pep
FTRPAVLETKQRLLNVSYNIRYVGRWSLATFQRQQISAEGVYDTETGSLCLIACRRVNVSSSDCKILITAHFASLDAKAAKHXRGKIISLRGKTDPLFFETLGLDSYWMFIGQVEESILRMDLESTMALISMTLSCAFIAV

SEQ ID NO: 181219 - protein, 38 aa, Triticum aestivum
  unsure (1)..(38): unsure at all Xaa locations
  Clone ID: PAT_TA_75637.pep
FFFFFFFFFGNRHHSGYFRYMNHIHSXALNSSKEVLYL

SEQ ID NO: 181220 - protein, 55 aa, Triticum aestivum
  Clone ID: PAT_TA_75638.pep
TLRNMLTSPGGFAETREGEVRFPEISTAILEKICQYFYWSLHYARGKETAEFPIE

SEQ ID NO: 181221 - protein, 62 aa, Triticum aestivum
  Clone ID: PAT_TA_75639.pep
PKLLVCDTTKWSYSTVTSNQGSNVVISFTYHQLQTLPCRSPFSLSMDRRPRNLPHHSPCPRF

SEQ ID NO: 181222 - protein, 119 aa, Triticum aestivum
  unsure (1)..(119): unsure at all Xaa locations
  Clone ID: PAT_TA_75640.pep
AERSVSGRNGVPDWNANTKEFPCPDSSMKWSDLTSALKCLCSPXLVDHKYLASQAGLCFPRELMLNSALLGGAAGCPSPSPASCLLCLPHPPCYILSSNSKVWLGFRFCFAGENGEGFG

SEQ ID NO: 181223 - protein, 155 aa, Triticum aestivum
  unsure (1)..(155): unsure at all Xaa locations
  Clone ID: PAT_TA_75641.pep
MGKIKIGINGFGRIGRLVARVALQSDDVELVAVNDPFITTEYMTYMFKYDTVHGHWKHSDIKLKDDXTLLFGEKPVTVFGVRNPEEIPWGEAGADYVVESTGVFTDKDKAAAHLKGGAQKVVISAPSKDAPMFVVGVHEDEYTSDVYIVSNASCT

SEQ ID NO: 181224 - protein, 109 aa, Triticum aestivum
  Clone ID: PAT_TA_75642.pep
SGRGLLLLQGNRPRRVFRWPAAGSSPLRAEPQKQQLRFRRGESASGPGVAMKDPEIEPRLTGPCPPSLIFPLRTQVSHSSSTRTSSHSLRAGGGSHERRLESEEGSLGE

SEQ ID NO: 181225 - protein, 94 aa, Triticum aestivum
  Clone ID: PAT_TA_75643.pep
FCKVKKAIAQYITTTLRCKKDGSSQQLQGSSVKYGSCAVVSVEKSASAMLSPTPWLQGGRVRRDHQFGDLRHCACRCHGHLCHCMLRQQPPAQG

SEQ ID NO: 181226 - protein, 69 aa, Triticum aestivum
  Clone ID: PAT_TA_75644.pep
PHCTPFILIILVTHFLHHSCKKISFNCTCHLPLLRHMKMLRVPFNTPGWCAVVACWCCTWLDHTGAQFL

SEQ ID NO: 181227 - protein, 41 aa, Triticum aestivum
  Clone ID: PAT_TA_75645.pep
FFFFFFFFSEILVEKCIKMDVFRTYLGIRYSTYNHFTQAAA

SEQ ID NO: 181228 - protein, 145 aa, Triticum aestivum
  Clone ID: PAT_TA_75646.pep
PTSLLLPDVTDELDISLPFQRYSFFFILLPRPLRELHSNLHHHLSYSVAHLFPNELPLGSGPHRGAPSLSINPRVAGALDEARRRRTVTAHEARAMTSEMKASGQARTDPSSSSPIIFFPRIFSLRSFFPRFFSRGSLVFFCMRL

SEQ ID NO: 181229 - protein, 104 aa, Triticum aestivum
  Clone ID: PAT_TA_75647.pep
SIRSEFIVLLMFAAYIAANHVCLDVWLPTFVLFCNGLVTGLNAYIPADDLRCLACYGCLVPAIEHVLFNPRELITHTGCSCVLRIKFPGVVLLARLSRIQFGEG

SEQ ID NO: 181230 - protein, 40 aa, Triticum aestivum
  Clone ID: PAT_TA_75648.pep
HAESERFVPPLYVKKNACSISVRRCVPLPREDQSPPSFWN

SEQ ID NO: 181231 - protein, 105 aa, Triticum aestivum
  Clone ID: PAT_TA_75649.pep
QAVPRTGTETRQCYKAAQAEYLHEEPETDDGKACRRWTMKDSDTKAQHTDPAIPHNVRSTGKRNPFQSLSPTIIAHGKMPFRGGGCFSHTSGFADGNARHTSAIR

SEQ ID NO: 181232 - protein, 52 aa, Triticum aestivum
  Clone ID: PAT_TA_75650.pep
AEKDKGKKAPISRSSRAGLQFPVGRIHRQLEQRTQANGRVGATAAVYSAAIL

SEQ ID NO: 181233 - protein, 79 aa, Triticum aestivum
  unsure (1)..(79): unsure at all Xaa locations
  Clone ID: PAT_TA_75651.pep
RRRRVELPACTASIANDQICAEGAVPRAGSADNLKLQSTTSSRVRVGASALGRAPCADRISAXEKIVQRRQSAWCHSSQ

SEQ ID NO: 181234 - protein, 101 aa, Triticum aestivum
  Clone ID: PAT_TA_75652.pep
RFPSRLSWRRDLLPNSRGHVGCEEEEKRGREVPLPSCAHVAVQVEIRLLHPRPARSPRAPHPWWLSIRLPLPHRRGELTPGLLLDWNALKGTKENRLEDRS

SEQ ID NO: 181235 - protein, 44 aa, Triticum aestivum
  unsure (1)..(44): unsure at all Xaa locations
  Clone ID: PAT_TA_75653.pep
FEYIIIGXTGVGKSCLLLQFTDERFQPVHDLTIGVEFGARMITI

SEQ ID NO: 181236 - protein, 44 aa, Triticum aestivum
  unsure (1)..(44): unsure at all Xaa locations
  Clone ID: PAT_TA_75654.pep
VVAGCMHYFTIEVKEGGAKKLYEAXVWEKAWENFKQLQDFKPAA

SEQ ID NO: 181237 - protein, 69 aa, Triticum aestivum
  Clone ID: PAT_TA_75655.pep
HSSARLCMWCCIRVHFQAVRSAPPEAKCPVCREVGVFAHAVHINSLTCSSKPGAKITGDAGYARSGPRW

SEQ ID NO: 181238 - protein, 62 aa, Triticum aestivum
  Clone ID: PAT_TA_75656.pep
RTHDTRENRALGLVTQHVNRIQKRSKMHSHAAPMCTVEQQWERSRCRSRRRGGSSSKAPRSI

SEQ ID NO: 181239 - protein, 66 aa, Triticum aestivum
  Clone ID: PAT_TA_75657.pep
VLNRSCMTCFSVMNFQKQNWHVCCKCSSSQPWSNRTHESRKNDNNESGSFWLILRNSTMFSLVLHE

SEQ ID NO: 181240 - protein, 25 aa, Triticum aestivum
  Clone ID: PAT_TA_75658.pep
RVGTPMTVVASSYCCRRDLTRGRED

SEQ ID NO: 181241 - protein, 91 aa, Triticum aestivum
  unsure (1)..(91): unsure at all Xaa locations
  Clone ID: PAT_TA_75659.pep
MQIFVKTLTGXTITLEVESSDTIDNVKAKIQDKEGIPPDQQRLIFAGKQLEDGRTLADYNIQKESTLHLVLRLRGGLQIFVKTLTGETITL

SEQ ID NO: 181242 - protein, 51 aa, Triticum aestivum
  Clone ID: PAT_TA_75660.pep
WLPWQRRLRRISRGKEGCCSFTISNKFQGAASFNEILQSKSITIRIRGCRP

SEQ ID NO: 181243 - protein, 58 aa, Triticum aestivum
  Clone ID: PAT_TA_75661.pep
FDDPNCIEKLISIYAVNPQSLPGVEEEMLKAHRQENQINMPVQVIDAGSIVLCTEVWH

SEQ ID NO: 181244 - protein, 63 aa, Triticum aestivum
  Clone ID: PAT_TA_75662.pep
VTWLPWSIRDQRLSPFWLERVASIGSSCWSRVDGARMQALSSDKRANQAPNQPRLAALSLRSS

SEQ ID NO: 181245 - protein, 133 aa, Triticum aestivum
  unsure (1)..(133): unsure at all Xaa locations
  Clone ID: PAT_TA_75663.pep
RIGRLVARVALQSDDXELVAVNDPFITTEYMTYMFKYDTVHGHWKHSDIKLKDDXTLLFGEKPVTVFGVRNPEEIPWGEAGADYVVESTGVFTDKDKAAAHLKGGAKKVVISAPSKDAPMFVVGVNEDKYTSD

SEQ ID NO: 181246 - protein, 118 aa, Triticum aestivum
  Clone ID: PAT_TA_75664.pep
SAKARIELEDEPAQLLEVNVWVRVEPLRRRALQDDRAIHTQISQENHRKPLRARSDGLHSIRRPMAYSRAASIPAPLMCSSRTQEQPPPLLLSWRRWRSPPRARAYVSTSMPSSSPHP

SEQ ID NO: 181247 - protein, 38 aa, Triticum aestivum
  Clone ID: PAT_TA_75665.pep
KMEGGGDDTVGPGSHQHDMTCAKDASKRSPHCIISASA

SEQ ID NO: 181248 - protein, 102 aa, Triticum aestivum
  Clone ID: PAT_TA_75666.pep
SLSPLLPPRPKPCWQWLFLSGLLSSSLSPLLPPRPKPCWQWLFPAGLLSSSLSPLLAPRPKPCWALGWLFTSWLVVLTHWPLFCATTIPCWTLECCYLCQCP

SEQ ID NO: 181249 - protein, 126 aa, Triticum aestivum
  Clone ID: PAT_TA_75667.pep
MAPKVAVAKKGDAKAQAAKVAKAVKSGSIKKTAKKIRTSVTFHRPKTLSKARDPKYPRISTPRRNKLDQYQILKYPLTTESAMKKIEDNNTLVFIVDLKADEKKIKAAFQKMYDIQAKKVNTLIRP

SEQ ID NO: 181250 - protein, 55 aa, Triticum aestivum
  Clone ID: PAT_TA_75668.pep
FQKIADKLHYDQTFLFSTRRCTLSSTESTRVLSWFFYAIAREKKHMIHIGDQKHI

SEQ ID NO: 181251 - protein, 43 aa, Triticum aestivum
  Clone ID: PAT_TA_75669.pep
YAIYLLYPGYSNQPPEYFLSTPFPLPSFSSPCLSPLFTEFVAA

SEQ ID NO: 181252 - protein, 52 aa, Triticum aestivum
  Clone ID: PAT_TA_75670.pep
FAWCSDKLGLSLELGSFAAGVMISTTDLAQHTLEQIEPIRNLFAALFLASIG

SEQ ID NO: 181253 - protein, 155 aa, Triticum aestivum
  unsure (1)..(155): unsure at all Xaa locations
  Clone ID: PAT_TA_75671.pep
DGNCFSADPEHQHEANYCQQPYEGRRSGKDFGLVVTIVGIVLIVLVLSLLLVASNKRNCQRVTAEQQLLQKQMQDNSTPGMSSELLESARYISQAVKFGSQXMPTHRVFSLEXLKKRQNALNDRHFLGQGSIGKLYEGKLENGTVIAIRCLALHQ

SEQ ID NO: 181254 - protein, 50 aa, Triticum aestivum
  Clone ID: PAT_TA_75672.pep
YSAQGTYITITQHSGTTLAHTKKLDKNIIYSGAIIDQCTTTATLLLQAID

SEQ ID NO: 181255 - protein, 165 aa, Triticum aestivum
  Clone ID: PAT_TA_75673.pep
CSSQGTLHDQQQVLWISDDGIPDLGGTYKGDTCFADEVIQPALTYPGAYRRISVELKIHHLAVNSLLKSSQVDEMEGGSIGNFENDIPPGPNATETDYHDARLCLPAFQVLKQLIQRCISDAVSSGNVFADAILRHLYRWLCSPRSRLHDPALHRLLHNVLKKVF

SEQ ID NO: 181256 - protein, 111 aa, Triticum aestivum
  Clone ID: PAT_TA_75674.pep
RLFPSTWRRLSEGALRDEEEATLSMSYITRILQKVRVSCRILPRYSDTAPILPDTYPRRRTSSSSPRLKTGHLVPSTLWSRRAATAHRSPTLHKSQLQSSPLPHVLLRLSI

SEQ ID NO: 181257 - protein, 94 aa, Triticum aestivum
  unsure (1)..(94): unsure at all Xaa locations
  Clone ID: PAT_TA_75675.pep
CNGAETMHFGYPHNPSTXILKLNITQEGVRSPFSSKVRDIXKMKLVVLDIQKINMYVPIYFLGRVLICDVTGKILMKYFLFGMPXLKLGLNDKI

SEQ ID NO: 181258 - protein, 47 aa, Triticum aestivum
  Clone ID: PAT_TA_75676.pep
ISGVILTHPNEQCLDLNCFMLVFTSIEYHWGGSRHCLQNILVVPLPS

SEQ ID NO: 181259 - protein, 153 aa, Triticum aestivum
  unsure (1)..(153): unsure at all Xaa locations
  Clone ID: PAT_TA_75677.pep
SGFKVNAIDLTGSGIXSSDTNKISSLSEYAEPLTSYLKGLGDAEKVILVGHDFGGACISHAMEMFPSKVAKAVFLCATMLTNGHNALDIFQQQMDTNGMLQKAQELVYSNGKDRPPTAINIDRASVRDLLFNQSPAKDVSLASVSMRPIPFAP

SEQ ID NO: 181260 - protein, 73 aa, Triticum aestivum
  Clone ID: PAT_TA_75678.pep
GWEKGVPTRRPSHSLRPSAGEVHALMPQERQKHCLYLGHFIFAAICFFCYCNRVQFCHTMGWERGCDQALLYG

SEQ ID NO: 181261 - protein, 69 aa, Triticum aestivum
  unsure (1)..(69): unsure at all Xaa locations
  Clone ID: PAT_TA_75679.pep
PTNTLTHTEANITRRNREKKDSVFRCKHIDKHCRFFAESPVYAFFSYPKKXTVLSSIGSAVWSPASFRL

SEQ ID NO: 181262 - protein, 87 aa, Triticum aestivum
  Clone ID: PAT_TA_75680.pep
PKRPMPHPHVPSSRMPTGIQLFILQQTSVSRKLTEGSMPQSNMFPSLHYYNLVYSCPQPNHGVTDSLPHHSECLLVKINIKEWQSAV

SEQ ID NO: 181263 - protein, 55 aa, Triticum aestivum
  Clone ID: PAT_TA_75681.pep
LNDAWFILLLCSIHVLVQAEAKIGQSALASSLSTATLRKLPSSTTSDRHEPEPAG

SEQ ID NO: 181264 - protein, 34 aa, Triticum aestivum
  Clone ID: PAT_TA_75682.pep
TRSSTTVLILGSKIQNAILYFRKVLLYLLLDTLW

SEQ ID NO: 181265 - protein, 76 aa, Triticum aestivum
  Clone ID: PAT_TA_75683.pep
PHKPLITPSLASLLAFKTNILHSAPKEEQKTQTGKLHMYIAEADIYSAYIFELEFGLSGVFFLHPDPPGSQLLFCK

SEQ ID NO: 181266 - protein, 59 aa, Triticum aestivum
  Clone ID: PAT_TA_75684.pep
VLVSIYRSWLMLRCLVQRRLCKGYPAADSKAYFPEGGTTSPSAALGYVEENPNVESFEL

SEQ ID NO: 181267 - protein, 73 aa, Triticum aestivum
  Clone ID: PAT_TA_75685.pep
GAIPMPEDALDKTSPAHPRSTATFRLPFAIHTTMTRNPERLLEKKNRKPVATNGTNRSHAVGSHVLRPDKPSR

SEQ ID NO: 181268 - protein, 52 aa, Triticum aestivum
  Clone ID: PAT_TA_75686.pep
CTKTTIPHKGRDASSPILLLLQLFLFLVLALLVGSGVLVLLYWRQVVRVLSP

SEQ ID NO: 181269 - protein, 56 aa, Triticum aestivum
  Clone ID: PAT_TA_75687.pep
CYLLQQLTNKQNCLRTGDIDQHATSDFLPRHARRAGARNPNVFLQVKNRAKVYSEC

SEQ ID NO: 181270 - protein, 126 aa, Triticum aestivum
  unsure (1)..(126): unsure at all Xaa locations
  Clone ID: PAT_TA_75688.pep
AKIQDKEGIPPDQQRLIFAGXQLEDGRTLADYNIQKESTLHLVLRLRGGMQIFVKTLTGXTITLEVESSDTIDDVEAXIQDKEGIPPDQQRLIFAGQQLEDGRTLADYNIQKESTLHLVLRLRGGQ

SEQ ID NO: 181271 - protein, 58 aa, Triticum aestivum
  Clone ID: PAT_TA_75689.pep
ELQIGLKNYDPQKDKRFSGSVKLPHIPRPKMRVCMLGDAQHVDQAEKMGLDYMDVESL

SEQ ID NO: 181272 - protein, 33 aa, Triticum aestivum
  Clone ID: PAT_TA_75690.pep
SYEFTDGVSCNFDSKHYTQWFMLAQTKTQSRCC

SEQ ID NO: 181273 - protein, 145 aa, Triticum aestivum
  unsure (1)..(145): unsure at all Xaa locations
  Clone ID: PAT_TA_75691.pep
MAPKVAVAKKGDARPRPPRXAKAVKSGSIKKTAKKIRTSVTFHRPKTLSKARDPKYPRISTPXRNKLDQYQILKYPLTTESAMKKIEDNNTLVFIVDLKADEKKIKAAXEKMYDIQAKKVNTLIRPDGEKKAYVKLTPDYDALDV

SEQ ID NO: 181274 - protein, 33 aa, Triticum aestivum
  Clone ID: PAT_TA_75692.pep
YSEDDVHNEYKMQCVGYVPPMEIRSLMLLIKKL

SEQ ID NO: 181275 - protein, 107 aa, Triticum aestivum
  Clone ID: PAT_TA_75693.pep
PVSQSEKALGTARGEESGRRKAQKRRHVVAERAIVGGEPAYSVETRGSGRRIRGFTFHVVVAQGQQERGRRRAVPHCGVRSDSICHAAPRISSPNGRACTAGEEESL

SEQ ID NO: 181276 - protein, 57 aa, Triticum aestivum
  unsure (1)..(57): unsure at all Xaa locations
  Clone ID: PAT_TA_75694.pep
RRRRHQEGSRGGAPRVGFGKEVVLKQRRXRMRRRPRLGEEEKAAILLMALSSGVIYG

SEQ ID NO: 181277 - protein, 180 aa, Triticum aestivum
  Clone ID: PAT_TA_75695.pep
FLCSALSRGDCSRHEANGPAIGIDLGTTYSCAAVWRPVHQRVEVIANDQGNLTTPSYVAFTDAWRLIGDAAMNQAATNPANTVFDAERLIGRRFSEESVQGDMKLWPFKVISGRSDRPMIVVKYRGEEKQFTAEEISSMVLIKIRETAEAYLGTTVKDAVITVPVYFNDSQASPPSTLAP

SEQ ID NO: 181278 - protein, 47 aa, Triticum aestivum
  Clone ID: PAT_TA_75696.pep
RVLQRLARLRRHDAVPPIGRSREQLPPLTPPLDPARSHGGGAHAPRL

SEQ ID NO: 181279 - protein, 136 aa, Triticum aestivum
  Clone ID: PAT_TA_75697.pep
MARIRVYGFHGPEQRHHRRGRHGSHPNLRRRLARRPRHEPDDSPEAPSMSVTVRDALYVMDLRSEVHYFKVFSYGRPPPGHCRQEDWYWSCLRPPPLNPDDPPVRHRHPYAVSAYTVVGDSQIWMSIMGAGTYSFN

SEQ ID NO: 181280 - protein, 142 aa, Triticum aestivum
  unsure (1)..(142): unsure at all Xaa locations
  Clone ID: PAT_TA_75698.pep
DYNVWXREDVAVYTRIRXIGDLVRDDSPDVIFFQEVTPYIQSIFESFPWWEEYNSSPVPPEGQTGNHHFCLMLSKLPMERYARWKFATSPTGKCYLEADITPRNMYPIRIATAHLECPVPPASIHLRDRYMQAKHVVSALSS

SEQ ID NO: 181281 - protein, 163 aa, Triticum aestivum
  Clone ID: PAT_TA_75699.pep
GKARKKGASSRAAASRCGRGSRTRQGQNLGRRCEGGAVNTYAERHGVRRGRSRDDPRSQVTGAPQRGFVKQRQRRLAGESWQSGGDRDGRWTWGGTGLAGPRDEDQGEAGNEATTVVFHSSQCSFGEESWQRGRGRRATMVGGCAIRWSSRCRASRRKATTRR

SEQ ID NO: 181282 - protein, 116 aa, Triticum aestivum
  Clone ID: PAT_TA_75700.pep
DTAAHTTTPRQANIRGRGKGGKGLGKGGAERHRKVLRDNIQGITKPAIRRLARRGGVKRISGLIYEETRGVLKIFLENVIRDAVTYTEHARRKTVTAMDVVYALKRQGRTLYGFGG

SEQ ID NO: 181283 - protein, 97 aa, Triticum aestivum
  Clone ID: PAT_TA_75701.pep
GGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 181284 - protein, 74 aa, Triticum aestivum
  unsure (1)..(74): unsure at all Xaa locations
  Clone ID: PAT_TA_75702.pep
EPEGRVFSATTRTDXAALLGEPCDQILAGRASFADLTAQQSGSWGVKRTPVHALFWWISRRSGGVRRSAKPEKN

SEQ ID NO: 181285 - protein, 141 aa, Triticum aestivum
  Clone ID: PAT_TA_75703.pep
RALVVGGPAVAEPRAPFYNRREVLISERSSRPWPAPAAAPPRAMLLWTKHRAYGVTYGSRRRRLDPRTPTGTPPVISPLKSSAAPSPPIDRHLLFEASTPRLRRPPPLVGCHRPLPPASSSPPPASWTAHPASCRRTSSRD

SEQ ID NO: 181286 - protein, 135 aa, Triticum aestivum
  Clone ID: PAT_TA_75704.pep
MQIFVKTLMGKTITLEVESSDTIDNVKAKIQDKEGIPPVQQRLIFAGKQLDEGRTLADYNVQKESTLHLVLRLRGGSRGGRPTSIPPNLLQLALKHNEKRMVCRKCYARLPPRATNCRKKKCGHTNELRPKKKFV

SEQ ID NO: 181287 - protein, 111 aa, Triticum aestivum
  unsure (1)..(111): unsure at all Xaa locations
  Clone ID: PAT_TA_75705.pep
LGTTYSCVAVWRAWXHQRVEVIAXDQVNLTTPSCVAFTDTWRLIGDAAINPXHTVFDAKRLIGRRFSEESVQEDMKLWPFKVIXAPSDRPMIAVKYRGEERQFTAEEISSM

SEQ ID NO: 181288 - protein, 72 aa, Triticum aestivum
  unsure (1)..(72): unsure at all Xaa locations
  Clone ID: PAT_TA_75706.pep
HFIKDRRCNTARAVFALESXYKWALSGTPLQNRVGELYSLIRFLQIFPYSNYFCKDCDCQILDTTKKKKKKK

SEQ ID NO: 181289 - protein, 163 aa, Triticum aestivum
  unsure (1)..(163): unsure at all Xaa locations
  Clone ID: PAT_TA_75707.pep
EKQIKFMTYNVWSRDDLQSTXRMEDIGGCVKKHQPDVIFFQEFTPYILRIFQSFSWWKEYHCSPISLEERKGKSFCXMLSKVPMENHARWKFTTTATCKSYLEADISPGLGLGSATTXKPIRIATTQLEPPCPPESVRCMERYTQAEHSVAALSSAENVVFGG

SEQ ID NO: 181290 - protein, 101 aa, Triticum aestivum
  Clone ID: PAT_TA_75708.pep
PLLHFCVLLLVLFILSSPAAVPAAMARPVVDVLTPDVLLVSPPAAPSALAPGPDVHASDYDVYIVFVSRTGYIDSLDYDLRLLASVIGSTHEAKKAMIYHY

SEQ ID NO: 181291 - protein, 185 aa, Triticum aestivum
  Clone ID: PAT_TA_75709.pep
ASSHVAVNSDSRSRWIRRRPAETRFSRRCPLRLGTMSRRRNLRRFPMENMLRRRQLRRPMASSHRWILRQRPIETRRRLQLATRCHRIQRRRPTRTRRLRLRQPTAASRQQRRGQRTRSRRRGGTRRRSMRWRISSRSTARSLRRQLRRGGWWPRSPGKSTSALPILLHSPIWSMWSSGLPLLPP

SEQ ID NO: 181292 - protein, 62 aa, Triticum aestivum
  unsure (1)..(62): unsure at all Xaa locations
  Clone ID: PAT_TA_75710.pep
ILSLQEPRSSHQACNAATLLTSTVGLRAASPDASAIXERRKMPTNRTAPRCRPAWAQIDPTP

SEQ ID NO: 181293 - protein, 166 aa, Triticum aestivum
  unsure (1)..(166): unsure at all Xaa locations
  Clone ID: PAT_TA_75711.pep
VCASQCVCRAWRDIINDDHWLSLERYFPRRALPGLFVNKTGCRSDTSFFAPPATRGASGFRGPVYPHRAIVFQSCNGLLFLEEWDYYVLNPATARYARLPRPSKPWCSYXVSLAFDPAVSLHYHVFLFPKGGLLQEPLMATSTQGPVPPFREAHAEEFEEPKKNVL

SEQ ID NO: 181294 - protein, 166 aa, Triticum aestivum
  unsure (1)..(166): unsure at all Xaa locations
  Clone ID: PAT_TA_75712.pep
VTPSLPFPSXPASTRQPKQNDFYPRCTPRGPAPQSRDTPPKRDTGIASEKEWGINLLDEAVKESGTNEDXSTWYRESGEDLGENGYRCRLARMGGQTHDGSTEWKETWWEKSDWTGYKELGAEKSGKNAEGDSWWEKWKEVLHQDEWSNLARLQKSAEKQAQSGDR

SEQ ID NO: 181295 - protein, 193 aa, Triticum aestivum
  unsure (1)..(193): unsure at all Xaa locations
  Clone ID: PAT_TA_75713.pep
MGEDDAAPPVSEPPARDWSLLPLDXASSIFVRVGAVXVLMGAGLVCRSWLEAAKLPDVWRAVVMENHDVVFLKDELVLCAMAKAAVDRSDGQLRVFAGNQFVNNVLLKYILERSPSLATLRLVSCVEVFSTRLIDVXRDAPLLELRSLELDDAFITVGELTAVLESCPLLEVLRVHHCFEVYDEDEQVLRAKF

SEQ ID NO: 181296 - protein, 85 aa, Triticum aestivum
  Clone ID: PAT_TA_75714.pep
TNVSSRSKQTHNKLATGSSSTRTNQLLHRQQLHVAGRILIRLLAATCWQSPRGQELAPTRAWRRKRRCVLDIWADGAARPCRRQA

SEQ ID NO: 181297 - protein, 46 aa, Triticum aestivum
  Clone ID: PAT_TA_75715.pep
SSSHPVLSPALPVWPRLHCFARIGSSLRGGWSAAFNKVEHYGVQRV

SEQ ID NO: 181298 - protein, 118 aa, Triticum aestivum
  Clone ID: PAT_TA_75716.pep
ERRREDKRAGNENERVLYCRREQSVKEASTSVHRYYFLLRKAQMDQATGEDDRCSEDVRRPASFSLDRAPAGGGVGVLGPLEHEPQHVDDDVAVSSGAAAASQFNAPAYGDGASAGGC

SEQ ID NO: 181299 - protein, 112 aa, Triticum aestivum
  unsure (1)..(112): unsure at all Xaa locations
  Clone ID: PAT_TA_75717.pep
GLEIVPLPGCGFSDNSVVGNHNMNARLYSVRDGIMQRRGQRRSNRCRGDGVQVQAHPPPPQASWSSXIDSSEPTRRWSTADRWRRRRSTLNSTAGSCTRCAPSSSPLSLQYR

SEQ ID NO: 181300 - protein, 119 aa, Triticum aestivum
  Clone ID: PAT_TA_75718.pep
RVPSDEPPRTIANATESRPHPSPPPTHLSPGNTYKQIVLAGFLRRYLLLARVQIDCRRLETGDEDTELARAGGERETLPSFHSRGETRSRRYEAPASTRLCNKHAELPCFHTSMKPLNT

SEQ ID NO: 181301 - protein, 122 aa, Triticum aestivum
  Clone ID: PAT_TA_75719.pep
LYRPRRPLESSTAGAWPRRSPYRRRPRLDPTSSVTQPASCCSPESFCCSPMSSLLLHRRLHPPWPRLCSKQMNNSVRHSFLCIVQLAPSPVCGFRQVRASLNEGFCLAHFWDTTSSSSKERL

SEQ ID NO: 181302 - protein, 157 aa, Triticum aestivum
  Clone ID: PAT_TA_75720.pep
LFVASPRAAALREATRPLLLCVAPSLPPPPLSPSSSSLTTGPQVVEGQQAAVDEEIAATHRLEPCRRHPSTRPPLPSLLAEIAVGAALPVELAPRHCREETPPAKASIGASMVVGDLLLADLSPPHPSFMPVSLHSSRRLALALRRRSDEEARWNAP

SEQ ID NO: 181303 - protein, 184 aa, Triticum aestivum
  unsure (1)..(184): unsure at all Xaa locations
  Clone ID: PAT_TA_75721.pep
SCSTSYPYQREDAVNSLAYEADMRLRDPVYGCVGVISVLQHQLRQLQQDLXRARYELSKYQAAAAVAVSASVGCNGTPAMADFIGNTVPNCTQNFINISHSTAIGAGLGFGHDQFAAVQMLARSYEGEGAVARLGVNGGSGGGYDFGYTSAMGVGPVSGLGPXSGGQFLKPGTAGGDERHTAAQ

SEQ ID NO: 181304 - protein, 173 aa, Triticum aestivum
  Clone ID: PAT_TA_75722.pep
SAGATLLDDLPESILVEEILVRLPSKDVLRCRAVRKSWRSATSAPGFLANHHRRQLLLPLINIIPESADDLCYERNEEDVNSRYVAFRDGERKLWPVLRTRPAKGTTVHGACDGLLIVAYTNVPYEDAFYVCNPTTRQCAPLPQVPPRCSGTAIAGYYRHHQSQEYRVLYWLV

SEQ ID NO: 181305 - protein, 88 aa, Triticum aestivum
  unsure (1)..(88): unsure at all Xaa locations
  Clone ID: PAT_TA_75723.pep
PTSLSTFLPASPSQHAPKPNCRADHRKPLSYHRLPRRAHPDXPSNPPRVCMHHHAGPQPVQRRPRTAWIPAPPGADGYEEEGHYQDGT

SEQ ID NO: 181306 - protein, 87 aa, Triticum aestivum
  Clone ID: PAT_TA_75724.pep
SRRRSTVRLRRTSRRCVAASYVAILQAANYVSSSLGYALELQGKLAARDAEVAALEKQLEETKAELAAARAERDSARGARAGALEEW

SEQ ID NO: 181307 - protein, 40 aa, Triticum aestivum
  Clone ID: PAT_TA_75725.pep
CRRGHERVAVEVRSELPLSSRLTPVVVKRRRRLNHVAFAK

SEQ ID NO: 181308 - protein, 157 aa, Triticum aestivum
  unsure (1)..(157): unsure at all Xaa locations
  Clone ID: PAT_TA_75726.pep
LPAAAAAALPLDDDNLLPXILLRLPPLPSSLPRASAVCTRWRSLISDPAFSRCFRIHHRRNAPLLGFIQPFDVRPSFEPTLEAPDRVPPGRLSLQSDLHHFRVLGCRHGLVLILDTTRFQLLVWDPVTGHQHRVSIPTGFAWFGTVICGAVLRATPG

SEQ ID NO: 181309 - protein, 162 aa, Triticum aestivum
  Clone ID: PAT_TA_75727.pep
VSSSPSTNNLRCFVPLILLIFPLFLPLSPYNSRHSDWSGLRRALLPRQVAGAGQDLRAHGRHAPQERRPHSGALLTDQCVVVATAAASTARTPAPGTPTRGWSRPSASAPASVWEEGLVTRTQGMGAHSSCYMLDSTLRFFCSDLSEQKNRDKGTHVYFSIS

SEQ ID NO: 181310 - protein, 59 aa, Triticum aestivum
  Clone ID: PAT_TA_75728.pep
GTTFEKPASCRLSYDFLPCLQVRTEQKPNYLPMEVCALEAKLLLWWYGKTELNSSTVAK

SEQ ID NO: 181311 - protein, 90 aa, Triticum aestivum
  Clone ID: PAT_TA_75729.pep
PAASSLPTTPANPPSPFSPATDSRNLLALDHRASQLHTVARHDEPFFLEASCDSLLLSRSYSGRRLAVYNPATREHASLGRLPSDFRILG

SEQ ID NO: 181312 - protein, 50 aa, Triticum aestivum
  Clone ID: PAT_TA_75730.pep
CPPLLIGVSAAAAIAKTYPVVSAEYPEAVEKARQKLRALIAQKNCSPLML

SEQ ID NO: 181313 - protein, 178 aa, Triticum aestivum
  Clone ID: PAT_TA_75731.pep
ADARPRRLPGALISSSPSHDAMPGRRRRTPTARPTSASLGHEAGPGRRRCTSAAPHYSSLQLRPATTLRLDGAAACPQRLTGTYSASPVPLIGFPGPTISDRPHRLRPSGATVGTHPTPFQRHQGSCHYPSPFGPSSLCSGVELSKRTAYRTLGEEEERVFTVLLASATLFSYLHQTS

SEQ ID NO: 181314 - protein, 102 aa, Triticum aestivum
  Clone ID: PAT_TA_75732.pep
SFSTWASSKRAAASTLASVSRATLASATWSDCWSSAMCPRSAVPSSAAAWRGATRAGRKTTGSRWASALASAEHWSTCAVSVTTSPRVTTASLTSVPLSALS

SEQ ID NO: 181315 - protein, 168 aa, Triticum aestivum
  unsure (1)..(168): unsure at all Xaa locations
  Clone ID: PAT_TA_75733.pep
RELRLRALAALRGRSSTMCPCSGTSTRGRDYEDERTQAYMKSNAARALCQLAMGNAAVCKNITESRALLCFSILLEKGAPDVQYNSALALMEICRVAXQNSDLPRSAFKPTSPAARAVVDQLLRVVTMAEYDDLLIPCITSLGCLSRTFRATETRIIGPLANLLDQRE

SEQ ID NO: 181316 - protein, 100 aa, Triticum aestivum
  unsure (1)..(100): unsure at all Xaa locations
  Clone ID: PAT_TA_75734.pep
SSRPTPRRRKGDARVEVVDGDVLVISGQRAXEKEEGGGQDERWHRVERRGGGFERRFRLPGGVRVDGMSASMEDGVLTVTVPXQEEAKKPQVKAVEIQGC

SEQ ID NO: 181317 - protein, 91 aa, Triticum aestivum
  Clone ID: PAT_TA_75735.pep
QGRRQRHRKVLRDNIQGITKPAIRRLARRGGVKRISGLIYEETRGVLKIFLENVIRDAVTYTEHARRKTVTAMHVVYALKRQGRTLYGFGG

SEQ ID NO: 181318 - protein, 94 aa, Triticum aestivum
  unsure (1)..(94): unsure at all Xaa locations
  Clone ID: PAT_TA_75736.pep
LIIRPISGSMLLHHCAARRKHHTPAAHPGRPASALDRPSMSAIRRSHGLHPPAAAHDPSPRAGWRTTSNLAAACCTTLIPPSYALVCSAASXSA

SEQ ID NO: 181319 - protein, 36 aa, Triticum aestivum
  Clone ID: PAT_TA_75737.pep
SEWDEGNAPGGRRSGGVFWSEHLAGSLLSWSVIRFR

SEQ ID NO: 181320 - protein, 76 aa, Triticum aestivum
  Clone ID: PAT_TA_75738.pep
KRGGKAPVPAKKKTEKVTNPLFEKRPKQFGIGGALPPKKDLHRFVKWPKVVRIQRQRRILKQRLKVPPALHQSTRT

SEQ ID NO: 181321 - protein, 160 aa, Triticum aestivum
  Clone ID: PAT_TA_75739.pep
GTGDGSSPAAHPSAHAGWCTGRCCAAAPCSCRPASPSSLCLAPARSPSSLCLAPARHRRAVVVVMWLPGWRRRLLLESRGVFIFLSCLLPIARSAHLVEAVRGHLLRLQTHKGVMRKQQEKAGSTLKLSRYILAIIHACIANLDLYSTWCPSQLEMSINL

SEQ ID NO: 181322 - protein, 143 aa, Triticum aestivum
  unsure (1)..(143): unsure at all Xaa locations
  Clone ID: PAT_TA_75740.pep
QQLLRCNPLIKLLPAKKEVILELPLVEQHRRANIHSVGQQPHQPGXGGVLAAARLLACILRCHLCHRLVHCQQRVPEGREVGTDEHLIFREPTASREWRHHALIGRSVTEERAAHCTRKLLHAAAEVLVGRCLESPDGGSATA

SEQ ID NO: 181323 - protein, 38 aa, Triticum aestivum
  Clone ID: PAT_TA_75741.pep
THCQSEETVLEPLPPNLLCLSWDAWTRLVKQTQPLYLT

SEQ ID NO: 181324 - protein, 190 aa, Triticum aestivum
  unsure (1)..(190): unsure at all Xaa locations
  Clone ID: PAT_TA_75742.pep
AADELKRARGGGGGLGHSVDRLSALPDDILHAVLSRLNARQVVRTCVLSTRWRHLWRSVPCLRIDQREFHAADGSLAERQQFKNFTHILLHRHDVALLEDFRLLVHHGSDMPHYDDXWVRRGISQDETWPCRLKKLHLTNVFLDCYFLRHINSRCPALEDMKLENCSYLLTDDTSISSPSLKKLVIIGFR

SEQ ID NO: 181325 - protein, 66 aa, Triticum aestivum
  Clone ID: PAT_TA_75743.pep
LGHPRKLPARVDNDRRIAAPAGQHRRECAIVAEFSAMFGGFGVWQIRPEIGREAWWWRPRRRRAAA

SEQ ID NO: 181326 - protein, 57 aa, Triticum aestivum
  Clone ID: PAT_TA_75744.pep
GSSAASRRMAYLTEPATSVSASMGHGQGIAERVRVRELDMAWRCRLASVVVTDPGAG

SEQ ID NO: 181327 - protein, 145 aa, Triticum aestivum
  Clone ID: PAT_TA_75745.pep
TEAFYFARGHAEQWPHLPAAPEGHAHGVPCEVTAVDYFTDGEEPCARITLLPRPHNPPPAAIDIPAPGRFVFYAKQIQQGDWQRSYFQVPKECERLFPPHQAAGDKQDLLLRDISGNSWNMEHTHRGATRSLSRDWQDLVHQKGV

SEQ ID NO: 181328 - protein, 88 aa, Triticum aestivum
  Clone ID: PAT_TA_75746.pep
ATLTPRSTGGFCVDIEAEASMFLGSSLPNQPSPREPIRPDYSSRADSCTPSHRCPVQDEAKRHSSSLSLHEKKVAAISHSGVGRVSAA

SEQ ID NO: 181329 - protein, 159 aa, Triticum aestivum
  Clone ID: PAT_TA_75747.pep
RRPDPYYFTIDLYSRTKGIPTGESLKSCPFTVGGHRWLVLYYPNGDQAENAGYISLRLILAEDTSWTVRAQHQFRFAGQADNQALPFEAEPLNNFAGLASWGNSQFIRGEALEKSKHLRGDSFAVRCDLIVVSDFRAVETPEPAAPAFVTVPPSDLHLH

SEQ ID NO: 181330 - protein, 109 aa, Triticum aestivum
  unsure (1)..(109): unsure at all Xaa locations
  Clone ID: PAT_TA_75748.pep
MSAPATGGAEKPHRFRPGTVDLREIRKYQKSTELLIRKLPFQRLVREIAQDFKTDLRFQSSAVSALQEAAEAYXVGLFEDTNLCAIHAKRVTIMPKDIQLARRIRGERA

SEQ ID NO: 181331 - protein, 56 aa, Triticum aestivum
  Clone ID: PAT_TA_75749.pep
VHEVTAQSPGKERLTFFFSRACGRSSRRREEAGGGQRASHSRTHPLEPGGHGGDDR

SEQ ID NO: 181332 - protein, 82 aa, Triticum aestivum
  Clone ID: PAT_TA_75750.pep
ASANAASMHEVAQTHGRRWRDMQAGAARRSRGRSRGRGRAGGRICSAILGRLGPAARREAPSQQGRRCRSRRGPPLHHVHAV

SEQ ID NO: 181333 - protein, 79 aa, Triticum aestivum
  Clone ID: PAT_TA_75751.pep
PTAGHRLNRPPAWGQCLLPRCSKTAPPHARSASMVPCVGFASRSPPTMHLHQIRPAATALHAPSQHHRELASTAVQPLL

SEQ ID NO: 181334 - protein, 43 aa, Triticum aestivum
  Clone ID: PAT_TA_75752.pep
TELLGGGGTSALPKARAGHRRRISVFVTLKVVDQEQRLVRRTI

SEQ ID NO: 181335 - protein, 69 aa, Triticum aestivum
  Clone ID: PAT_TA_75753.pep
RWRSSTTPRGRLSARTPAASGGGRRSRESIGRRDQIDQPTGLTAHLCKYVVMYGVYLYFSIYLFRLCEW

SEQ ID NO: 181336 - protein, 142 aa, Triticum aestivum
  unsure (1)..(142): unsure at all Xaa locations
  Clone ID: PAT_TA_75754.pep
LASTWPRRKRKVRWLAARRARGCAAKGKKKGSVSFVIDCTKPVEDKIMEIASLEKFLQERIKVAGGXAGNLGDSVTVTRDKSKVTVTSDGAFSKRYLKYLTKKYLKKHNVRDWLRVIAAHKERNVYQLRYFHIAENEGQEED

SEQ ID NO: 181337 - protein, 134 aa, Triticum aestivum
  Clone ID: PAT_TA_75755.pep
GDPDEFKRFTDQKLEERIKHWSGNRTLSVPDGGEKMRKFLCRMKKELDRRRAAGPRKVDTGRRQSAQTPSGDDPYTFKESDHINCSRFSDKWHCHGKGEAAFADELGHFNTMQRASQVEDRKRVTNTVNHQPKR

SEQ ID NO: 181338 - protein, 87 aa, Triticum aestivum
  unsure (1)..(87): unsure at all Xaa locations
  Clone ID: PAT_TA_75756.pep
MEQQGTYPVRLIWGPPCAPTNTAVVEVASRILSLIEESSAGGGNGCFLSDVVLFGNXDRMNVDQDLTKIFLEKRVRRLQKCLMPSSG

SEQ ID NO: 181339 - protein, 75 aa, Triticum aestivum
  Clone ID: PAT_TA_75757.pep
ETSTISGPCTFIYFHRGHGGDMGADRGPRRDRRGVLHQGRGQAVRHATPGRRQPLVRPVWRARLRQARHDQSPLH

SEQ ID NO: 181340 - protein, 117 aa, Triticum aestivum
  Clone ID: PAT_TA_75758.pep
LRSTWFHGSNLPVRGEGEVGLAGVRGEVGHAADDASFVSLMASRSGGRADDRIDLVLPWLTRDESSHRRPPSRSCRRLADTAVWRSSAALCYKGAWPAPEERWRQQPVAQHWWRRSS

SEQ ID NO: 181341 - protein, 42 aa, Triticum aestivum
  Clone ID: PAT_TA_75759.pep
RRLASSPQRSRIERCTSRCCLHGRSQRRQCHSRAPHSNLQGS

SEQ ID NO: 181342 - protein, 98 aa, Triticum aestivum
  Clone ID: PAT_TA_75760.pep
TQLDGSVGAGDAAERRVRGWTLCHGFRLLNCGWTWTDHCDLWLSPPPLLSGSLAGRTPPVDEKLESSIPYAMHGVIVLLAGVLPVHVGSLLIPVLAAV

SEQ ID NO: 181343 - protein, 35 aa, Triticum aestivum
  Clone ID: PAT_TA_75761.pep
SDHGSQPKAQKPVAVHGTNTEPVEQCSVPQPRTKV

SEQ ID NO: 181344 - protein, 79 aa, Triticum aestivum
  Clone ID: PAT_TA_75762.pep
SADGIIRYSEDVGIINDDEPCRQTSCLSMYTVQAGLYSTKLVGFSVRCARLPYSPVHVYYIDTVIHLMLNLSYVFTWLW

SEQ ID NO: 181345 - protein, 88 aa, Triticum aestivum
  Clone ID: PAT_TA_75763.pep
SSVWRGTPSAHGKAYHNKLGVTRRRSPAPAPGRARPRAAGMVSARAGPDREARRQQVVRALWAGETRRPSLPPAIAPSRLSAGKLTGQ

SEQ ID NO: 181346 - protein, 127 aa, Triticum aestivum
  Clone ID: PAT_TA_75764.pep
RCGQSEVAGRTKPTQGTRKALAAGDALRACDGIVQARPCGRTQPSRVQQGGTTGVLRRRLGTRHGRAKAGSHGGAVGVGRCRPGAALWLRKAEAGHHGGDADVRVCVCGVHAQHRAPSQDDDEVVHI

SEQ ID NO: 181347 - protein, 39 aa, Triticum aestivum
  Clone ID: PAT_TA_75765.pep
VAAAGGLLAGAGDLCPVVSRRECHGCPLFYPGLEAEAVN

SEQ ID NO: 181348 - protein, 91 aa, Triticum aestivum
  unsure (1)..(91): unsure at all Xaa locations
  Clone ID: PAT_TA_75766.pep
SPDRSCGRASVSTGGLLARSFPQRVGRRGEPCLXPDTGRLLLARTSGMDALSRALHRAGMVAIAFGDWSGQLTSAAMVAVLKKKCGCSFVK

SEQ ID NO: 181349 - protein, 71 aa, Triticum aestivum
  Clone ID: PAT_TA_75767.pep
RKERSARSWRRESTWRKATEARTWSAGVGSRRKISSRRTARRSSVIEVHGCGHLPSPDGGLEEEEGVGAEA

SEQ ID NO: 181350 - protein, 90 aa, Triticum aestivum
  Clone ID: PAT_TA_75768.pep
LLTATVVHAYSQRPVAAPDLQMVPTRSQAARRHPSLLPLRASATAVTFLLIWASSGSAITDAALFPSATSRCYLIPDVVSVHQTSLSQPP

SEQ ID NO: 181351 - protein, 161 aa, Triticum aestivum; identical to SEQ ID NO: 129051
  Clone ID: PAT_TA_75769.pep

SEQ ID NO: 181352 - protein, 236 aa, Triticum aestivum
  Clone ID: PAT_TA_75770.pep
SARGLDMLNPSEEEVFAICGAFRVHPLTREDITTQETREKVELFKSYYFLCFRSFYSLDKESEDYLEPINIYAVVFREGLLTFSFCQNPHAANVRKRIGRLRDYVNLSADWICYALIDEIVDSFAPVLHDVENESEAIEDGIFTARFEDSRAIMQQLGSCRKRVMTLLRLLGGKADVIKGFAKKCNESYAMAPRGDVGLYLSDVQDHVVTMMSNLTHFEKMLARAHTNHLSQVQLA

SEQ ID NO: 181353 - protein, 85 aa, Triticum aestivum
  Clone ID: PAT_TA_75771.pep
GLMCRRHHLPSRPPRRYPIFDSDRRPAQDPPGTLDPATARSPAGDAAISLHRINAHIYTCTLFSVDTVGIFSVHVVGFFQFNRIQ

SEQ ID NO: 181354 - protein, 191 aa, Triticum aestivum
  unsure (1)..(191): unsure at all Xaa locations
  Clone ID: PAT_TA_75772.pep
MSAYCGKYKDELIKNAAYIGTPGKGILAADESTGTIGKRFASINDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFXLVRCKANSEATLGTYKGDATXLGEGASESLHVKDYKY

SEQ ID NO: 181355 - protein, 265 aa, Triticum aestivum
  unsure (1)..(265): unsure at all Xaa locations
  Clone ID: PAT_TA_75773.pep
EGGTRLCLVAQVYAPLAKLNIEERTLYVLVCPAPKCSPNPQSWKVLRVQKCHTGMQSNDNGDGSVQNIEKVCSNEPTPSCSAGKHNEEANKSSNSNDDDFDFDALAAALEQAATVASNTKKKNKSKRANNVPRKCVVVKEKVNDLSIPVLPCFYIYYDTEQSRGKTSVGCSSYEKLLAEEIMDMGNDEEEKWEGEKYEYDKAPGADRTFLKFKKRLDAYPQQCFRYSCAGSPLLATTNSQDVGTCKXCGSRYQYELQLMSPLSYF

SEQ ID NO: 181356 - protein, 178 aa, Triticum aestivum
  Clone ID: PAT_TA_75774.pep
MDNHTSSPPHEVTMDISSASGSKMCRGASCDFADSTNTSKDAKERSASMRKLLIAVILCVIFMAVEVVGGIKANSLAILTDAAHLLSDVAAFAISLFSLWAAGWEATPRQSYGFFRIEILGALVSIQLIWLLAGILVYEAIMRLVNGSGGEVQGSLMFAVSAFGLFVNIVMAVLLGHD

SEQ ID NO: 181357 - protein, 232 aa, Triticum aestivum
  Clone ID: PAT_TA_75775.pep
RHEGHLDELIDGVRLVGRHDGDVTDLSISQWMTTRLASGSNDGTVKIWDDRKLAPLSILKPHDGQAVYSVAFLTAPERPHHINLITAGPLNREIKIWASTNEEGWLLPSDSETWNCTQTLELVSSLEPKVEEAFFNQVAVLPQASIILLANAKKNAIYAVHVEYGSDPASTRLDYIADFTVAMPILSLTGTHVSQPDGEQVVQVYCVQTMAIQQYGLELSLCSPPTSDTTSF

SEQ ID NO: 181358 - protein, 151 aa, Triticum aestivum
  unsure (1)..(151): unsure at all Xaa locations
  Clone ID: PAT_TA_75776.pep
MSILPVIYALLPLLVLGSRGKLAALASGGVTSYNPTGGWVQPSHGTLHGCPKSCGNVSIGYPFGIGSRCSRGADFNLTYNDTARSPRLYLRDGITQVISFEESFXGSNSITASFSHTMPMQPGVSVYNLSLKLPIQLCCCQEKQDRLCMYQ

SEQ ID NO: 181359 - protein, 188 aa, Triticum aestivum
  Clone ID: PAT_TA_75777.pep
IRHEDFHSLYVYDTESAAPILIHAGLHYAAITDIAWSPDAKYLSLSSRDGYCTIIEFENEELGQPHALSGKKEVTEGNVTCRNTKPPTVDSMEVDVSTRKIKKSGSPVGTVTPPPVLAENSTLRMKEGNVACEHAKPKADSMDVDVGASKAKTEASPMSVEVTSPPVSAQKSASSKPTKKRITPIAIN

SEQ ID NO: 181360 - protein, 233 aa, Triticum aestivum
  unsure (1)..(233): unsure at all Xaa locations
  Clone ID: PAT_TA_75778.pep
TRQGTNDDASISRCSMVSRWLYWXDNYAPLLIKKSQKIKRPPLINRGTYVRTVIIDNLLKSFLKTFDGSQVVSFGSGSDTRYLRLKDQLSNSNCKYFEIDFPEVTAKKSMFLNKNKWLSDTARFTGCDVDSPQYSLISADLRDFKNVVSKFQDRAFDLSKPTFFLSECTLIYIDPVISNEILSWISSSMIGFVXFGIMMLQNLKARNLELPGIHAFPTLDSQKERFLSACFDH

SEQ ID NO: 181361 - protein, 253 aa, Triticum aestivum
  Clone ID: PAT_TA_75779.pep
GTRVFWASFEDLANDLKSCFLYFAAFSKNIGFYADEVVRMWIGEGFIKPQKGKTIEELGHGYLKELVLRCLVDILEMVDGDIKIIKVHPRLHVFLQSEVREAGFVELHDTNDVFVSPSVRRLSFRSFDRKKVKFTKKLPKLRSFICRVEESEPEQRNDRFYDLNFLRGSKFLRLIYVNGLRLCELPHDIGKMIHLRYLYVRCKDLKELPRSIKGLLNLQTLDIRETLVDKIDPGFWKIKTLRHVLAEQLTLPK

SEQ ID NO: 181362 - protein, 86 aa, Triticum aestivum
  Clone ID: PAT_TA_75780.pep
EAVIGVGVGTTERIVYPGDDFDATPSVVAGDGDGVVNLASAMAVETPWSRRGGDFRMVKVLNMSHNALVVDDRALEIIMREIQRAD

SEQ ID NO: 181363 - protein, 137 aa, Triticum aestivum
  unsure (1)..(137): unsure at all Xaa locations
  Clone ID: PAT_TA_75781.pep
SAEAALVELLLDEPERRVCELALAVLDRLCTCAEGRAELVAHAAGVAVVGKKVLRVSEAASERAVRVLRSVARXAATPAVLQEMAQAGVVGKLCLALRSELCGVKTKEKAHEVLKLHSRIWRSSPCLSPKFLALYPS

SEQ ID NO: 181364 - protein, 173 aa, Triticum aestivum
  Clone ID: PAT_TA_75782.pep
RLVSTNYDRKWIAKYRHALSMLSIYPVMDLDADNEVRCFPSVHVGTESHKELGIDSALSGKGYTTMGFRGLLRSAYSLKREWVTPIKSGRPRLVMVLRRNSRALTNEAEVIAAATEVGFEVVAAGPEVVRDLGKFAGTVNSCDVLVGVHGAGLSNMVFLPRNGTVVQIVPWGE

SEQ ID NO: 181365 - protein, 125 aa, Triticum aestivum
  Clone ID: PAT_TA_75783.pep
EQGIRHDRILCSPLYASPTRPSWTLGVDLLYGFALRLGVDVLYGFALRLGVDLDKGLRRHFRLTDLAAKLRHHWVPEGLHGFVTVVHLLQQNTTVNRLHQEVHLLRQPHSPPPDHRPQEKKDLVS

SEQ ID NO: 181366 - protein, 231 aa, Triticum aestivum
  Clone ID: PAT_TA_75784.pep
MATSTNMKGVALLLALAATLLSYCSASASSPVADAAPAPAPYADGASPPYGAFLLAPAAYAEAPTTAHHAPALGKHHHDAKSPAEPPAFRNASEHGKRHHHDSSPVEAPAPYHSNASEHKHHGHLGHGNASEHKHHGHLGHYHQHHEAPPPAHSAPPPHLPPPAYHSPPPPAHHLSPPAHPSPPPPAHHLPPPAHPSPPPPAHHLPPPAHPSPPPPAHHLPPPAHHSPPPP

SEQ ID NO: 181367 - protein, 224 aa, Triticum aestivum
  unsure (1)..(224): unsure at all Xaa locations
  Clone ID: PAT_TA_75785.pep
MGLDEKSVAIVGAGVSGLAACKHLLERGCRPVVFDAGDAVGGVWPNAMEGTRLQAPRHMYRYSDFPWPDSVTEMFPNQRQVADYLHAYARRFGVLDCVRLGHRVTSMEYVGVAEEEVVAXWEEWAGCGQAFGSSDREWRLTVADDEGHIEVHMVDFVILCTGRFSNYPNIPNFPPGRGPEAFDGKVIHSMDYSKMGSEKAQEMIKDKCVTVVGYGNSALDIANE

SEQ ID NO: 181368 - protein, 80 aa, Triticum aestivum
  Clone ID: PAT_TA_75786.pep
PRDCLLNSFEFNFLFCPENASGQLFPAVGSYSKYSCPNRIILISFVLLCPSHGKICTTFTFSLHKFSLLPLLTPVPISCF

SEQ ID NO: 181369 - protein, 157 aa, Triticum aestivum
  Clone ID: PAT_TA_75787.pep
PAYNKMPRLLLLLFLCVSVLAAAPAQAYQDKCDIKAAVGNDSDTGKNEAPGIDDLFYVMDIDIELEQATGLELGLSQGDAIEMDQPIPSTSAAFQSPDLINCRAINWTIEERRRACLARIVSHVYSREKKAIPLSPDTGFRLHGEPLEDGDYVYAAI

SEQ ID NO: 181370 - protein, 205 aa, Triticum aestivum
  Clone ID: PAT_TA_75788.pep
RHEDGPVINSVTVTVRTTDPTHVPALGSITMTSGSSSASSSSSTGSASTLQHYMSQLDVALSSHDSTSASTTSTSTSTSTVASAQAHVTRHVTQPTYDRGMFELAIRNLMQIWCTKHDHSTNPNANTNITPAPWTPSSRTAMLFDVTCWAAKQKYLDESAPFQLLEDIFDVLPLSQCDAFLAFFSNPNLSTHVHSCIFCGTNLPT

SEQ ID NO: 181371 - protein, 153 aa, Triticum aestivum
  Clone ID: PAT_TA_75789.pep
ARGTCRRRRRSTRSSRGTPRLGLYTTSFMLKFALGQVMGSYRKRTKRLFERLNPWVPDMYVNRKDIISMGHIEYFEQRQQVAKGFSRVAKTGSRLSYRDMFHSMFGAKTLKPHLLPSARLNSSTDSDAHSLRQWWKPDSRLSLSTKTYSYPHG

SEQ ID NO: 181372 - protein, 133 aa, Triticum aestivum
  Clone ID: PAT_TA_75790.pep
ARARARRSFVEHGGDQAMAELELERLVLPWLLRVPPLGSEKQLFVPFVESSTVLRTVASRCCKAYGLCCWLVCVVVFYRLQASHVLSVCSVLSFASCCVSSSPRASSRASSSWICRPRTHILESSLVISWSIT

SEQ ID NO: 181373 - protein, 166 aa, Triticum aestivum
  Clone ID: PAT_TA_75791.pep
RHEAVANAAGGSEGPDPREVEIYLEEILALTQLGEDYTEFMVNKIRGLRDVKPELGPQAMKAFRNGSFNKMEKDLTGYYVILEEFFMVENIRKAIQIDEPVPDGLTTSMVDDVFFLLQSCCRRAAFTASINSLLAVLGGATSLLSNEFQEALQWRMREPNLGAKLF

SEQ ID NO: 181374 - protein, 209 aa, Triticum aestivum
  Clone ID: PAT_TA_75792.pep
IRTRLLLLPPIPNQGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCAT

SEQ ID NO: 181375 - protein, 193 aa, Triticum aestivum
  Clone ID: PAT_TA_75793.pep
FGTRVALTRRVQKVRDEIEQLMDDDGDMAEMYLTEKKMRMESSSVFGDQSLATFNAAAAGTSVSAPVSPVSSPTESRKLEKTYSLCRGRHDSVKSSDNSVTEHIEELEMLLEAYFVVIDSTLNKLTSLKEYIDDTEDFINIQLDNVRNQLIQFELLLTTATFVVAIFGVVAGVFGMNFETDVFSIQNAFQWVL

SEQ ID NO: 181376 - protein, 166 aa, Triticum aestivum
  Clone ID: PAT_TA_75794.pep
RSGRATATQGHLKPRSLREPADLAPTSRCTTTQPQTLLATPEPGEDCHTIPKPARASYRAERNEAAAPAALPSHIQPPARRPSRHGLPPPWKSRIRSQPADLTSCSHRIAERAARSQPKVEREEDAQIRRRRRGAPPTHTRLAGERRRRKPTESTPARRAAKPRAE

SEQ ID NO: 181377 - protein, 168 aa, Triticum aestivum
  unsure (1)..(168): unsure at all Xaa locations
  Clone ID: PAT_TA_75795.pep
RHEGDVEEEAESDGEKKAAVAAAAKGKAWGTGTKKTRGPGKNSALSRKKAAAAAEEAASAAAEKKDNGDSDGAAAGGLPKKRIAVDFLKRLNQGKSSPPKKRGSPLTKRKRSAPAPEXEEEEQQPKARRGPGRKNTGRGGSKAGAKSSATKKSVGRPQKRGAAPATPP

SEQ ID NO: 181378 - protein, 118 aa, Triticum aestivum
  Clone ID: PAT_TA_75796.pep
FGTRGKLNSFNLPFYGPSLTEVKMVIKQSGLFDINHIELFESNWDPRDNSESNEVHDPLRSGMNVSKSLRAVMEPLFTSHFGESVLDILFNKFAYNVAEHLAREKTKYSIIVLSLKRK

SEQ ID NO: 181379 - protein, 175 aa, Triticum aestivum
  unsure (1)..(175): unsure at all Xaa locations
  Clone ID: PAT_TA_75797.pep
MIYLDTSCFLRFQFTSNCLVVQWSGDNPNSLAXVFGVTDVPEPSLDGNILPNPVDPSTYMVMLCYKNGSLTREDIRDRYAEKSWDVFNNLLEQTDPLNGGKLGFYYKEHEILPPLPVGFHRYIVDTLTSGPLAETKERQKDEFDPPSEFPPVVXQGVIQVRALIEGQFMSMRGHA

SEQ ID NO: 181380 - protein, 205 aa, Triticum aestivum
  Clone ID: PAT_TA_75798.pep
MMRGFRSVLARAAARTRAELQGTRGRRLSHCAAAPARPSFGIAFDIDGVILRGRSPIGGSPQAIRRLYSDDGTLKIPFLFLTNGGGVPEHKRALELSELLGVNISPAQVVHGHSPYRDLVKRFEDDLIVAVGKGEPASVMAEYGFRKVLSIDDYSSHFKEIDPLAPFKKWKVGQPNCKDFMSEKMHPPYDVYQERVKGVFVVSDP

SEQ ID NO: 181381 - protein, 137 aa, Triticum aestivum
  Clone ID: PAT_TA_75799.pep
MEVAVGAASSLLGKLLTKLSEDLVAAYVHSLELGHNSQQIKTKLLHTQGLLQVAEGRDVSNVTALQALLEELSKKADEAEDSLDELHYFKIQDQLDGTNYAAPDLGDSLRGHARHGGHAARHTIGSVVAFVPHILLK

SEQ ID NO: 181382 - protein, 177 aa, Triticum aestivum
  Clone ID: PAT_TA_75800.pep
VTTCYEHVDWHIVVDGGAAVAEPFELHVVVGLVRRDGDAAVADLGVVVDILRAEGSVQGAVGGAAGGDVGLATRSGEQRRLDVAPRDHQQVWGRGARPRQNGHGVLAEVVAEAPAAPRPPHDGAGGADVPGGVPKDRGSQHAHQPFFREDVTDLEYAALVEEQPGLARTGGVVASSE

SEQ ID NO: 181383 - protein, 88 aa, Triticum aestivum
  Clone ID: PAT_TA_75801.pep
FFFFFFFFFFFFFFFFFIPCNIDNKRGRYIVGLHSPRQTKYINNITSSNHSWSDYGAKIKDQPNMPHDPDRANWAPLLIIRERHIVTA

SEQ ID NO: 181384 - protein, 154 aa, Triticum aestivum
  unsure (1)..(154): unsure at all Xaa locations
  Clone ID: PAT_TA_75802.pep
MASPWDSSSSGLWAALGQASTMAQLVGVDALGLVSMVVQAALAARRHRDACMLLAQHVELIGGLLRELELAELMRREATSRPLEQLRGAXLRRCYALVTACQDCGYLRRLVLGARMADELRAAQHEIDMFIRLIPLISLVDNSTNSRRVQVAMF

SEQ ID NO: 181385 - protein, 122 aa, Triticum aestivum
  Clone ID: PAT_TA_75803.pep
SARGYDDTPKCISVGCHPGSCNGNHSGQAFGAPSSNALSNSTHPGLNSYIAELGNLLLGDPGDHDNSADTANSSATAGAPPKADHGLSKKRKKTSDVWDYFTKIFARDINGKVLTFAACNHC

SEQ ID NO: 181386 - protein, 59 aa, Triticum aestivum
  Clone ID: PAT_TA_75804.pep
QLLNRFLFASGSRWPFLPSRSPHGPTLYTDYFSAIFTLVLSCLSYPSGVGVHTRGSPRA

SEQ ID NO: 181387 - protein, 209 aa, Triticum aestivum
  unsure (1)..(209): unsure at all Xaa locations
  Clone ID: PAT_TA_75805.pep
SARGRSEVWYSERPASTDTVGHPHVARGSAEVYSQLYPYPGLLNYTSGVIHHVRLVGLTPSTRYYYRCGDSSLKDGLSDERSFRTLPAPAPDAYPRRVAVVGDLGLTGNSTSTVDHLARNDPSMILMVGDMTYANQYRTTGGRGVPCFSCSFPDAPIRESYQPRWDGWGRFMEPLASRVTMMVTEGNHEIEPQGHAXAVTFASYLARFA

SEQ ID NO: 181388 - protein, 207 aa, Triticum aestivum
  Clone ID: PAT_TA_75806.pep
GTRRERERERERERERERERERERERESIIRATRTQNVLGEKGRRIRELTSVVQKRFNFPENGVELYAEKVVNRGLCAIAQAESLRYKLLGGLAVRRACYGVLRFVMESGAKGCEVIVSGKLTVQRAKSMKFKDGYMISSGQPVNEYIDAAVRHVLLRQGVLGIEVKIMLDWDPKGKLGPTTPLPDLDTIHPPKEEDELRPPALVEV

SEQ ID NO: 181389 - protein, 94 aa, Triticum aestivum
  Clone ID: PAT_TA_75807.pep
QEGKRTTADGGGQVQRQSRQHGQAQEAGRRQERRGGRGGGHRRVRAAEPAAAVRQGARRALVAPRPRHGGAGDQRVEEGSIIHGVSRHFHSLCS

SEQ ID NO: 181390 - protein, 206 aa, Triticum aestivum
  Clone ID: PAT_TA_75808.pep
HEDGGYCGNYYHDFNDNIIPLFITTRHLGGEVQLLVKQKQAWWFGKYGEIVGGLTRHEALDLDGDARVHCYRRAFVGLRSHKDLSIDPRRAPNNVSMVDFKRFLMWRYALPREHAIRTDDEVVGGRRPRLLIITRRSRRRFMNLEEIVAAAEELGFEVTASEPDVAAQEAGRRGGPGGRRRAGADGGRVGDGERVRRDAGGARVRA

SEQ ID NO: 181391 - protein, 110 aa, Triticum aestivum
  Clone ID: PAT_TA_75809.pep
RSVDIRLLNYINKQGISHQMNPTGSQIHLRIQQITGYARNDALHAQKKKVVTSCTFLNRWNLEKMSVDWDLARPFSLHQHTRAKRNNKIPRLDSPRLDDPNESRHATDRG

SEQ ID NO: 181392 - protein, 72 aa, Triticum aestivum
  Clone ID: PAT_TA_75810.pep
TTNLLLFGVAKCVSLNLQVPPGCYIYFIGSWIIRRQIMVEIISLQVLYCQRSHNSFREAKPCMIIRGNMQHT

SEQ ID NO: 181393 - protein, 82 aa, Triticum aestivum
  unsure (1)..(82): unsure at all Xaa locations
  Clone ID: PAT_TA_75811.pep
ARGLRRPQQRPSQGDYTRKHGSRSWTPTAGXDLAAGVDPPPIATGGDWRTQLQPRGRSRIVNIIMEAMKNFLRVSKPEELNQ

SEQ ID NO: 181394 - protein, 93 aa, Triticum aestivum
  unsure (1)..(93): unsure at all Xaa locations
  Clone ID: PAT_TA_75812.pep
ICQVSGARRGIAAKDQSPLQRSRWLQRRRARHHGTSLRSWNLKIFNELIGQSIPXMPLSRPFGVCGVPNLRHGVGARDAKVNPDRRCNNGTCC

SEQ ID NO: 181395 - protein, 53 aa, Triticum aestivum
  Clone ID: PAT_TA_75813.pep
SFIPDPGLCQMPYFRIIGLTQGVYFPSERAFFDIFRLLHSLVIITMKKIVEIY

SEQ ID NO: 181396 - protein, 248 aa, Triticum aestivum
  unsure (1)..(248): unsure at all Xaa locations
  Clone ID: PAT_TA_75814.pep
FGTRAMYRGYWALGVSNYISLEETTTMGEEEGEDLKPSPLKRLRTVHSIARKNRAMHLLELQGTLERLEDVVAGMMEFVVLLGGCDRMLRRPYDAYLFSDKIMFGRHTEKQKLLNFMLQHXPPGGVPAVLPIIGAPVVGKRTLVAHVCKDERVRSHFSSILHLNGDSLGRIAQHGGLMPGXXLVVVELVSYIXEEDWAKFYSTVATSMDNGSKVIIISCLRNSERLGTVEPIFLNTLPYEEFSYLFKT

SEQ ID NO: 181397 - protein, 161 aa, Triticum aestivum
  unsure (1)..(161): unsure at all Xaa locations
  Clone ID: PAT_TA_75815.pep
MDKKKDADDVEPGPAPSRPVDRFGFIKTEQSNSXPEGVLKSRPTHEAXEREERRIRKWRKMIGTGGSDWKHYVRRNPHVVKRRIRKGIPDCLRGLVWQLISGSRDLLLMNPXVYETLVIYETSTSELEIIRDISRTFPSHIFFQQRHGPGQRSLYNVLKAY

SEQ ID NO: 181398 - protein, 72 aa, Triticum aestivum
  unsure (1)..(72): unsure at all Xaa locations
  Clone ID: PAT_TA_75816.pep
GANYISMIQMADVSFGIXCGQEGCQVVMASDLLWGQFFLIXALLAHKHWNHRSMTYMILYNFYQNAFFVLML

SEQ ID NO: 181399 - protein, 186 aa, Triticum aestivum
  unsure (1)..(186): unsure at all Xaa locations
  Clone ID: PAT_TA_75817.pep
MGEKVATLIIEANLECEKCYKKIQKVLCKLQEKEKIRTINFDTKKNTVTISGPFDPVKLSXELRCKACKAIKDIKIVEEKKPDAKKPEEKKPEEKKPEEKKPAADGCKCCCKKPDEKKPDEKKKPDEKKPEEKKKPDEKKPDDKKSEEKPKPKVEPKPAAPSTTVNLQFTQICNLCYPWPCSDPSH

SEQ ID NO: 181400 - protein, 197 aa, Triticum aestivum
  Clone ID: PAT_TA_75818.pep
MFTDMYLLPHSVNEYMMLIEHITTRLIEKCQEKYSALTKNIYAAQRLNDTKIYAELSRDPLYVAMRSVSMGNNNNNNNNNNNNNMMNNMMNNNEWKADEGVLESHFSESNPIYHPMFQRDFTLRRDQLIFDTRVLGQIALMCESLEWMSDLIYQMTDPFYTSNVMNSNNKRTMNITRNGGISMRNGNARVAIRNTFR

SEQ ID NO: 181401 - protein, 196 aa, Triticum aestivum
  Clone ID: PAT_TA_75819.pep
EAESTAAQQAPLSLPVRALRPQDSGAAGHGNGESRAQPRAHDTVLPSPIPWRSRSGRFDAPLTPSSPSPSPKKLSPASSMSDETLAKASEEHATVPKRRSTYKSSISSLPPPPPPPPPPFLVHGYHPAADRRTTAAKSFKEELQDHSTRGRGDHDHYSQQSFNSSSTYTNSSPATPRSSFDGSSSSPSVGRSVRTI

SEQ ID NO: 181402 - protein, 179 aa, Triticum aestivum
  Clone ID: PAT_TA_75820.pep
GTRLTPRSLSTLAPHHEKPKPKPHPKPHYEKPKTPKYQAPKPHHEKPKPKPHPKPTYEAPKPVKPKYTKPKAPKPHKPEYTKPKAPKPHPKPAYEAPKPAPKPHKPEYTKPKAPKPHKPEYTAPKPHHEKPKPAPKPTYKAPKPAPKPHKPEYTKPKTEKPKPAPKPEYKAPTYQAPHY

SEQ ID NO: 181403 - protein, 85 aa, Triticum aestivum
  Clone ID: PAT_TA_75821.pep
LQIVHIFVCIATGCSARVPGRNPKQYGSAIGTDRKPQLHPYVGCSSCSVRSLHQAPIGQTFSIFQTSQEFGAPLIHKMEETKSAV

SEQ ID NO: 181404 - protein, 179 aa, Triticum aestivum
  Clone ID: PAT_TA_75822.pep
ARGISLTCGVPSPNSARIEVPISRDPNNRIRMVAAPGSGHRYAKHAASRYKVREVFCAGGSALVEWRLETGRTHQIRAHAKYLGNPLLGDETYGGTKSMALSLLRPRTPSKYHGDLTNLVSKIDRPCLHAALLGFKHPHSGKVLEFSCPPPDDFTEVLDELRRVTPTSEGQDSDSAAQV

SEQ ID NO: 181405 - protein, 226 aa, Triticum aestivum
  Clone ID: PAT_TA_75823.pep
SARGYHEVAVKMLHPVRDDQLQVFSARFDEVFGKCQGLGNVCFLHGISTQNGRLCIVMKFYEGSVGDKMARLKGGRLPLSDVLRYGADLARGVLDLHSRGIFVLNLKPCNFLLDDHDHAVLGDFGIPSLLFGLSLPNPELIQRLGTPNYMAPEQWQPNIRGPISYETDSWGFACSILEMFSGVQPWRGKSPDEIYQLVVLKKEKPIFPYNLPAEVENVLSSCFEYD

SEQ ID NO: 181406 - protein, 127 aa, Triticum aestivum
  Clone ID: PAT_TA_75824.pep
TTVELESDVIAPHDLSLLQPAAFLHSKLIQRGNKLKPQCKVRWHNWPDTQDTWEDAFALHASFPALAAWGQAAPEGVGSDYVVAQPRQTAQGLKAQPPAGPRLAEEQVVVKGIKEGRRWREDREEDD

SEQ ID NO: 181407 - protein, 230 aa, Triticum aestivum
  Clone ID: PAT_TA_75825.pep
IRHEAKLNTAAGIGLAPSIRFVNVTGYNVSANPAAIAANGLIQHLVSFFGADNALQCKFYKNGGIPTYARNADMKAVHAGMNITATVWSEFVNSFRDTLLSFGVAPADITATIIPYMQSFLLGSTNQICNDPSCNCAPVVNGITYTKVNGTCTASGTVAPTTAAPTTAAPSGTPTTPAPAGNGTTSPPTGTGKNGATMVSASVPSMGGCCGSLVIGSPLKTPYYFHTQPV

SEQ ID NO: 181408 - protein, 114 aa, Triticum aestivum
  Clone ID: PAT_TA_75826.pep
PLNHAARGSVAGVGRLQTLVQKKIQSHACIKRCRCVTHHEWIQKLKIGYSADRNSLNQQIGFTIERTDGNIQSARSGRKRRNQHQTDRWEHIIKVARRVRGTVSSGLGAGGSRR

SEQ ID NO: 181409 - protein, 266 aa, Triticum aestivum
  unsure (1)..(266): unsure at all Xaa locations
  Clone ID: PAT_TA_75827.pep
RHEGRVCRKEPSLSKFRVLRVLDIENGEEMESNCFEHLRKLFQLKYLRLHVRSISALPEQLGELQHLKTLDMGWTKITKMPKSIVQLQHLTCLRVSNLELPEGIGNLQALQELSDIKVNRYSMASCLLELGSLTKLKILGLRWYIVSTHSNKDTFLDNLVSSLRKLGRFSLRSICIRSYHGYSMEFLLDSWFPSPYLMQKFQMGTYYNFPRVPXWIVSLDKLTYLDINIDPVDEETLEILGELPALLVLWLMSKSAAPKQRLIISS

SEQ ID NO: 181410 - protein, 135 aa, Triticum aestivum
  Clone ID: PAT_TA_75828.pep
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTA

SEQ ID NO: 181411 - protein, 230 aa, Triticum aestivum
  Clone ID: PAT_TA_75829.pep
GTRLLGNKWTEIAKVVSGRTDNAVKNRFSTLCKRRAKDDELFEENGTVCSNASAKRVLTQSGGVTCAAPGSSPPIKNMSSCKPDFKENIAPNMKSFAQQKSIQQDSRQPLASICPDNQSVNIVKTQSLVTKTSTKQLHGEEQSCVKHEGNFLKRNDPKLATLLQQADLLSSLATKVNTENTSQSMDEAWQKLQHHLVKKDDNDMSESSMSGTASLLDDLDDLIVDPYENE

SEQ ID NO: 181412 - protein, 133 aa, Triticum aestivum
  unsure (1)..(133): unsure at all Xaa locations
  Clone ID: PAT_TA_75830.pep
MRLLMLLHGAALLLLLAAVAHAQQTMRTDPADAAALHAVFAKLGQKAGPQWNISGDPCTGAAIDNTNIDNNDIFRAAIKCEVCTXGNTSVCRITRLKIYALDAVGPIPEELRNLTALIDLYELSTCTPEMKWS

SEQ ID NO: 181413 - protein, 234 aa, Triticum aestivum
  Clone ID: PAT_TA_75831.pep
FGTRPLILAPPLSPPPSPTQQALTTPLHPSLLAAHPDRPRNGAASVDRSVDMGDHQLMYSAPAMHNGGGGGGAVSHGMWWNTNTTAVPAAACSTELAGFNTWPAAQLAAGGGYDMAATDGGKAKSCTTTASSESPGNNSSVTFQETASISDPAAGFTDWNSPYMSNGGAGNMHGFLQVGHHDMSSRTDQQSHMNASSLMNDPSPNNLDLALQGHHHHQHQQAGDHHRQQQLLSS

SEQ ID NO: 181414 - protein, 81 aa, Triticum aestivum
  Clone ID: PAT_TA_75832.pep
QIVKRHRKEELPLAGEAGRPPPASHEPLLHSSLAAARSKQLWSLRCVRDGMTAHRSLPGCVRGGMAGCEEERRVRGEATGR

SEQ ID NO: 181415 - protein, 99 aa, Triticum aestivum
  Clone ID: PAT_TA_75833.pep
DFRTVRLQSICDGVTWTTGYSIAPIISTCINKRVDSAVVTPPVVGRSTQVQSLGLALKKSPSLARAASAPHVRMGTCRVLGVSCLLKIPNCLSRAEEFY

SEQ ID NO: 181416 - protein, 242 aa, Triticum aestivum
  Clone ID: PAT_TA_75834.pep
SARGHLPEDHAIVRGRLIWRWISEGLVYSDKQETSLYELGNSYFTELVNRSMVQPIGIDVEGNVEGCRVHDMVLDLICSLSSEENFVTILDDTRRKIPNSEIKVRRLSIQNTKIDVDTTRMEHMRSLTIFTSDVVGKVLDISSFQVLRVLDLEGCKNVSDVGYVGNLLHLRYLGLKDTHVKDLPMEIGKLQFLLTLDLRGSNIKVLPSSVVQLRRLMCLYVDYDMKLSSGIGNLTSLEVLDD

SEQ ID NO: 181417 - protein, 150 aa, Triticum aestivum
  Clone ID: PAT_TA_75835.pep
RHEGHGYEYAISNHYDRHCVWEEVAQNKKLNKFNHTIIDQQFEFYQADGLTRFNSSDPHKLLPSYVPEGSFIVREHTSMSNLFSCLWFNEVDRFTPRDQLSFAYTYLKLRRMNPKKSFRLNMFKDCERRSMAKLFHHRSEERHSSGQLTR

SEQ ID NO: 181418 - protein, 263 aa, Triticum aestivum
  Clone ID: PAT_TA_75836.pep
FGTRSGVSQKGDILINGRRQKLSYGTSAYVTQDDVLMTTLTVREAVRYSASLQLPSGMSAAAKRERAEETLREMGLEGAADTRIGGWMHKGISGGQRRRVSICMEILTRPALLFLDEPTSGLDSAASFHVVSRIARLARREGMTVVAAVHQPSTEVYGLFHGLCLLAYGKTVFFGPAAETNQFFALSGFPCPSLMNPSDHFLRTINKDFDNGIEEGLGGKKTTTAENIDALVVSYKSSVYMDKVTRQIADIRGTVSSPAGLHV

SEQ ID NO: 181419 - protein, 217 aa, Triticum aestivum
  Clone ID: PAT_TA_75837.pep
QPPISISSYFPTPTMSEPVDGRTGQAPLAVVIVYAFDCTTSTPDWYKVDNVFWLVQEKLTHIMGSSLGYTYVMSTPNTYTSDMKLVDSAEINGNGYKSSPSWKRIACVKYMTGLHEAHRLIKEHGNMNAIILFFSDGLVNKGDFFDGAEDFLSSVPVYTFTLGGDAYNQGLRTIAANSPGGMFSPLPVPDLPSLSVPFSQLLDNILNDTTMHSEKNP

SEQ ID NO: 181420 - protein, 109 aa, Triticum aestivum
  Clone ID: PAT_TA_75838.pep
HITKAICLIAPRARSHKVSQLKLLHSSVHPSSMADPPHAWLQVMVCHLHLTRHVTLITSISSRLCWHSSVTPNKYRIRLKTTKSVCCCLPYVQVFEIYLQSSKQHRWEK

SEQ ID NO: 181421 - protein, 192 aa, Triticum aestivum
  unsure (1)..(192): unsure at all Xaa locations
  Clone ID: PAT_TA_75839.pep
MASFPSAARLLLLVAAALVLSSVSAAAGAGGSPPLAKGLSFEFYRARCPQAEAIVFAFLKDAIRKDVGLAAALLRIHFHDCFVQGCDGSVLLDRTNGVDSEKVSPPNVTLRPSAFKAINAIRXLQKACGGPVVSCADIAALAARDSVQLAGGPRYAVPLGRRDGLAPASLDTILGALPPPTSKVPVLLSFLA

SEQ ID NO: 181422 - protein, 52 aa, Triticum aestivum
  Clone ID: PAT_TA_75840.pep
EAGSGSATANNNWYGQGSNAYAGGNGVGNGGGTNGGTGGGGGAGSGYGDAYP

SEQ ID NO: 181423 - protein, 202 aa, Triticum aestivum
  Clone ID: PAT_TA_75841.pep
NVLLATNDYAKSHLRCTVYAAKFIPKEKWVVAGDGNGCILVYSYEEHQDVTSFDAHRTSITCLAVHPTRPFVLSSSYDDHLIKIWDWEKDWECTRTFEGHNRVAQMTFNLDNTSSFASASSDGTVKIWSVDSDDGKIITLDGLCVDYFTRRDRQHLITGTKDGTAQIWNLEMEAGCVERLEGHRGRITIVHLHPELPLLIQA

SEQ ID NO: 181424 - protein, 153 aa, Triticum aestivum
  Clone ID: PAT_TA_75842.pep
RHEASVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 181425 - protein, 40 aa, Triticum aestivum
  Clone ID: PAT_TA_75843.pep
LQTLRVETQEDYEALLIFFFHGSSRGNPGYHVHILQPSLL

SEQ ID NO: 181426 - protein, 233 aa, Triticum aestivum
  unsure (1)..(233): unsure at all Xaa locations
  Clone ID: PAT_TA_75844.pep
GPRVCAFLVEPIQGEAGIIVPEAGYLMKAFNLCKKHNVLFIADEIQTGLCRTGKLLAVDYDGVKPDILILGKALSGGMYPVSAVLANKPVMECIQPGTHGSTYGGNPLGCAVAIAALKVLKEEKLAENAYNLGVKFRQALIDIKSPLITTVRGRGLLNAIVIDDTKMDKTAWHVCLMMKKYGLLAKPTHQNIIRLAPPLCITEEQXMDGVKIIDKVLKEIVSMNVKDIPGHEL

SEQ ID NO: 181427 - protein, 130 aa, Triticum aestivum
  Clone ID: PAT_TA_75845.pep
RPPPLLHLEHYGEDNGIHLAARSRSHPPPRLLSKGTKDCLETTLLFSSLEKQHQLGMQIHQYMYMRLMGGELLHGCKTILLLSVIDFRVMICLNSFPCIKSTSNGVLANYFTFVIVIGSYEYHINRFSIF

SEQ ID NO: 181428 - protein, 127 aa, Triticum aestivum
  Clone ID: PAT_TA_75846.pep
MSKNGGKVSKLESLRLSLSRARGGGGGQSSTTARPGGGGGGGNDAVSASPRRLSSSSSSTASPPSSCVSSEGSPDAAAGAPMVLAGCPRCMMYVMLSREDPRCPRCHSAVLLDFNDDQQQRRPRQRR

SEQ ID NO: 181429 - protein, 231 aa, Triticum aestivum
  Clone ID: PAT_TA_75847.pep
RKLLDKLTSMDQSQSNTNANSSDTPPKTPNKPSTPTSFHPQQPHPTYEKIDPISPIGIPFSVASLNTSDLDADTVAYATQAAAAAYQEAIASRTAKMAVGARETPPRLRTYVSSTPPTPTSPTRSLMSPFGDHLASPFFGKTTSTTLPNGGSFVAQSPNSTRSKVNAPIRSPGIINRVRADSTESGISNAEEPFLSRSPNGTSGDSVGSDEHEPPLTPNGSSIIKKLNLYK

SEQ ID NO: 181430 - protein, 209 aa, Triticum aestivum
  Clone ID: PAT_TA_75848.pep
MEAELCVLRSNKWELLRNLQIKYEAHELSDLIHWRTDRVIPFENYLCWVSYFSGGTLFCDVSEKKPKISHHRLPIHGRCRGADLHRLRDMNCSLCTTDSGGKLMFINVAPEDHEIVGPMLPGTDFIVTCHTWRTQDMVWEEAFVITSHEIWGFDASLSYNALMFPLVSAAKSNELYFLLPEKGERAIDKVSVIAVDTITKHVKIHQYIE

SEQ ID NO: 181431 - protein, 266 aa, Triticum aestivum
  Clone ID: PAT_TA_75849.pep
IRPRVQVDDPAGAFSVTAYDANHCPGAVMFLFEGEFGSILHTGDCRLTPDCAQNLPLKYIAKKGKENVCRLDFVFLDCTFSKCFLKLPSKELAIQQVIACIWKHPDAPFVYLACDLLGHEEILVEVSRTFGSKIYVDTRRNSDCFKALSLTAPEIITDDPSCRFQIVGFHHLYDNASKKLEGARASLQPEPLFIRPSTQWYACGRNQKPSLTEAQQDDFGIWHVCFSIHSSRDELEQAMQLLRPQWVISTTPPCFAMELSYVKKHC

SEQ ID NO: 181432 - protein, 173 aa, Triticum aestivum
  Clone ID: PAT_TA_75850.pep
GAHHAGGAADRVQEGAAAGGAAVQADLRVAAGRGSGALQPERHRDDDEQRGQLRRHRHWFVDARDAGDILRQLPAAALGTKQQPGVLPRSVLRPVTKLTYVNCKTGHERKVIIVNVNTCRYYVLSSTVFFISLFKLGNERYVLLWQGGDLTLQSHMARFTADRRVQVKPKCLL

SEQ ID NO: 181433 - protein, 159 aa, Triticum aestivum
  Clone ID: PAT_TA_75851.pep
EAWVHDRFDEMHPRGYHNGNMRNPRGRSGGRVGGPGGRTRGVGRGNFRGNRSRAHNHDGNQNYSYATPSVIRGRGSRRYQPRRSTTEISSEQNDKSQKPENALSNANLGKHQPQNSNSWPEQGFPNKQSFASNLNSASPPFYPSRPSHQEQLIGQRGNA

SEQ ID NO: 181434 - protein, 190 aa, Triticum aestivum
  Clone ID: PAT_TA_75852.pep
MTILSKDAPAEISHPAHPEHKLKLMATGAAEFQCNVCKELGAGDRYTCRPCDFDLHSDCALAEATLVHPLLKGREFQLRLEHPRHSDAGGRTCGACGGKVLGLHYHCAAKKGMDLHPCCAALLLVIPQEELTLELRKEASHRCSSCRERSRSRAWFYRSTCKTVYLHVACVKEIARRNRGAGAGESTDPF

SEQ ID NO: 181435 - protein, 259 aa, Triticum aestivum
  Clone ID: PAT_TA_75853.pep
FGTNGVNGFPALKELVFEDMSNFKRWASVQDGEFLPSLTELVVVDCPKITEFPLLPSMLVKLKVSETGFTILPEVHIPNSQFPSSLECLQIHQCPNLTSLQEGLLSQQLLALQQLTITQCLDLIDLPVEGFRSLSALKSLHIYDCPRLAPSGQHSLLPSNLEDLRISSCSNLINPLLQELNQLSSLTHLTTADCASLQSFPVKLPATLQKLEILDCINLIYLPAGLEDASCLTTITILKCPLIPCLPGRLTGSLKELYI

SEQ ID NO: 181436 - protein, 197 aa, Triticum aestivum
  unsure (1)..(197): unsure at all Xaa locations
  Clone ID: PAT_TA_75854.pep
MAQPSAAARKPSAAPTVVLTLVLALASASLLFLLVHLSPSSPSAHPHPHRRLRLRGAHLRHGGATPHQIPFDPVIADLEHRLDDREWERLAAAGLHAPGMESAPVPEDLADYEDEYINDAARFNMTLRVAALFPKIDVDPADDAVTGAELAAWNLASAAXEVLHRTARELDLHDRDHDGRVAFSEYERPSWGLAVRR

SEQ ID NO: 181437 - protein, 250 aa, Triticum aestivum
  Clone ID: PAT_TA_75855.pep
LLICLNTYKKKDDKGKELEALGWDIHFWLGETTSQDEAGTAAYKTVELDDFLHQAPVQHREVCGFESSLFLSYFEKTGGVCLLEGGIESGFNHVKPETFTPRLLHLKGRTNIRVTQVPIEVKSFNEGDVFVLDTGLNLYQFQGKGAGKNEKGRAGQLCRAIDDERKGKPQVHVFSQSDRNVKEFWDEVAKFDSSSSSWPNGVPAISPDDGKDEEWEKATEQKLFQLSDASGSLTFTEVVPAVKGKYQRGM

SEQ ID NO: 181438 - protein, 94 aa, Triticum aestivum
  Clone ID: PAT_TA_75856.pep
IWGQVPLMAESTTYLLYLISRSDHNDLPAASIIIARHGQNTRASPRDRNGLQVHPIPPPVHIHLGLCGDHHIRGHLDDAIRPAVNTKLLPTPRA

SEQ ID NO: 181439 - protein, 239 aa, Triticum aestivum
  unsure (1)..(239): unsure at all Xaa locations
  Clone ID: PAT_TA_75857.pep
IRHEVGKPVVSFCETVRGESSQECLSKSPNKHNRLTMTAEPLGEDFCKGVDNNDINPEEDMKTRARKLADDYGWDVGFARKIWAFGCPPDGKANVMVDNTKGVAYLNEIKDSVVGAFFQATAGGVYCEEAMRGIRFNLNDVTLHADAIHRGAGQLMPTTKRCLYACQMVSKPALMEPMYLCDITVPVSAXSGVYNTLNARRGAVEGKEDRAGTPLCQIKAYLPVLESFGFTQLLRQNTS

SEQ ID NO: 181440 - protein, 111 aa, Triticum aestivum
  Clone ID: PAT_TA_75858.pep
KTPLEEQYFQLWRGLVNDTATMLLKSSIYPCAVHKKFRAKTAVFDPSRCSAIRLACSTSVACMQSPPPWHSWTPAGRHLHQSWRRASPVFVVQLSMYACVLRYCACTVAAH

SEQ ID NO: 181441 - protein, 236 aa, Triticum aestivum
  Clone ID: PAT_TA_75859.pep
GTRNAAIKPLVNIPLERAHPNRGQSSRQPEVAAGPAQPAQLFPVPSMMFNHPPIGDEPLKNELHRLRLHIDSLDKIYELKQSQLQTECSQEIEKIKQKYDLLLEERDSVHLEQMKTLDGLLEKVVFHQSLAADFRAKFISSSAAQAKAYSRPIHQTPQASQQAPMRPPGVTSISPPVAWSSAGRPVVPGGAQPSQVDRPSTPASSQVPRPPLPSTPVVRPPINPGNLVRTTGAPMP

SEQ ID NO: 181442 - protein, 65 aa, Triticum aestivum
  Clone ID: PAT_TA_75860.pep
YFQLPIYSACCSFLRMATDPPDGDDLPHSCSDALFEYAEQVKNLGSTLSELFSEPLGLKPSYLAE

SEQ ID NO: 181443 - protein, 239 aa, Triticum aestivum
  Clone ID: PAT_TA_75861.pep
IRHEGSNEEHRRCIAACLVKATYIMEEDRPKCRVYDMGLAPPWWQSFHFELRDLLKCGTENADEFIFGAVFEYCPPAGWQRHPSAPNYVFALRGTMPRHPKSAHDLYNDIKVFLSDLPCCRRTQKARQAVANMLIRKGTERCVLWLAGHSLGASLALEVGRDMAEQHQAYLPTFLFNPPNVSPMPAFNLLNPSEVAKKDVFTGSYLVKAALGATVMRSYCTRMEKVFQRLSPWVPELYV

SEQ ID NO: 181444 - protein, 167 aa, Triticum aestivum
  Clone ID: PAT_TA_75862.pep
PLTPSHLIPFSCFDLQPPPRYAAATDGLERDDAVVAREVLHDLDLPVDRVLDVFASCRRTPRRGPWRGRPDGTEPYLSLTDLPVAVASRRLTHRRRLASSCIPLPYFPPGSGRRWSTFLGAAGCVEWRDERRRGSLLETRGKPKRGPTRRTAARNNGPPERWSPRAE

SEQ ID NO: 181445 - protein, 110 aa, Triticum aestivum
  Clone ID: PAT_TA_75863.pep
MTTSMVRHGCVVVSHGSVLSPLPELFALPVEAKQRNVSKWGPSSSYLGKVPGLLREYLRVEEATDDARIREFTNLLWPQGNSAFWLVVLFSVTLFFPLVFLAFYHHFNKI

SEQ ID NO: 181446 - protein, 128 aa, Triticum aestivum
  Clone ID: PAT_TA_75864.pep
FGGGAMCGEETSMAVGGTAVSTQMPLTGAALKHISMEIRTLLFKIEQKVAMEALLNRLAKWLPKPLDGLRDGGESCGPKAFYGWPGIEHDPDEQAGICDCRPSREWRCNFRSIYWQNGSTGVGMDQKG

SEQ ID NO: 181447 - protein, 110 aa, Triticum aestivum
  Clone ID: PAT_TA_75865.pep
PSGLASHLGAPEVRSRTRRSPAEAAEDQASLGSLDVACGGVEPGDELRGLPIDVPLPDVPQPVLVARPHLPRRPPRLLVRLVVVPAAAAEARHAPSHSCSRSPAAVLASS

SEQ ID NO: 181448 - protein, 99 aa, Triticum aestivum
  Clone ID: PAT_TA_75866.pep
RFQDELRGKLGELYKAKKDDVSVFGFKTHFGGGKSTGFALIYDSAEAMKKFEPRYRLVRYGMATKVEKASRQQRKQRKNRMKEFRGTAKAKGGAKKDKK

SEQ ID NO: 181449 - protein, 245 aa, Triticum aestivum
  unsure (1)..(245): unsure at all Xaa locations
  Clone ID: PAT_TA_75867.pep
MAPTVHHQGYPNPAGFPGKRPTPVILLLVAITCLAEIGCLPNVNTAATQTQTQTPCTEAISLSPFSVRILYNDTAIDIPAGQAPPKVMPDELKLYYTRCGKIPIADMYIDDTNNGVGTHYQYPRNQIRTFIKEAKAMKKGGRTGKYAWLYAALKAHPIKQQHVVLFGSMEPWFEAICLAHGAASVTVIEYNRLTYDYPKIRTYTPAEHAQIQPPPIYSVAFAMSAFDHDGLGXRYGDPLHPDQDL

SEQ ID NO: 181450 - protein, 194 aa, Triticum aestivum
  Clone ID: PAT_TA_75868.pep
MPVSSVAKPSSAKPNPFDSDSDSEFTSRPARASSSNSVDPGTNGRCKNGFRDSGGFDNQSVQELESYVAYKAEETTQKVNVCLRLAENIKEDATNTLIALHKQGEQMNRTHETAANIDQDLSRSETLLGSLGGFFSKTWKPKKTRQIKGPAVISRDDPFKRRANHLEQREKLGLSSSPRGKSNPQTYSDPTNAM

SEQ ID NO: 181451 - protein, 224 aa, Triticum aestivum
  Clone ID: PAT_TA_75869.pep
SARGAGWCYKKGQLLLVYEYMPNGSLDQHLFRRGGAQEQRAAPLSWASRYGIVADVASGLHYVHHEYGRTVLHRDIKASNVMLDASFSARLGDFGLARVIDFDRSSFTDIGVAGTRGYIAPEYSVGHKATSQTDVFAFGALVLEVVTGRTALRDDATCPLLVDFVWRMHGRGALVGAVDQDLGTAGYDSDEANRLLLLGLACSSPNPGDRPTMPEVLQIVSKKA

SEQ ID NO: 181452 - protein, 71 aa, Triticum aestivum
  Clone ID: PAT_TA_75870.pep
NEYLLQNPHTADGRRPSAPVVPKQSVIVNLLYSSIVSRTLTNNQKYKKYALLEYYVGLSNYANILSIPVSL

SEQ ID NO: 181453 - protein, 49 aa, Triticum aestivum
  Clone ID: PAT_TA_75871.pep
RGVEETLSLTLFDTKKGILDTHTRYDRFSYRLKICNHILLSLSFFSLKL

SEQ ID NO: 181454 - protein, 233 aa, Triticum aestivum
  Clone ID: PAT_TA_75872.pep
RHEAGLGWSERYKIIRGVCEGLAYLRLEIENPIMHLDLKPENILLNKNMVAKIADFGISKLFGEENTKKTMSVIGTMGYWPPEYIKHQIISKEFDIFSLGVIIVKIMVGQENYNYIVETPARKSIKFVHESWKNRLSKTISGHKLEAYCNQVKRCIKIALDCLKSNRQERPTIKHIVACLKEKDTMFYEDDGDSSTLPSDINDITINSTPCSALELVEHNTLAIMDTVHTLNE

SEQ ID NO: 181455 - protein, 78 aa, Triticum aestivum
  Clone ID: PAT_TA_75873.pep
IAPMLARNLPFELPSPLRRTDLAISTHSPHRRQLLDMLRHSLSSPPTPLIGTLNRKNIISVLGLHHELYLRFYEHIKT

SEQ ID NO: 181456 - protein, 156 aa, Triticum aestivum
  Clone ID: PAT_TA_75874.pep
GTRVRGGWFMAGLSCPIFQELGRYLKYLALSWCDLEEKDPLPVLACHVPALTYLSLNRVSSEGILVLSAGCFPLLKTLVLKRMPDVKQLVIEEGAMPLVDGIYITTLLGMNAVPDGIDTLGSLTKLWMLDLHREFKADWTQKQMDDKMKHVSDLRV

SEQ ID NO: 181457 - protein, 173 aa, Triticum aestivum
  Clone ID: PAT_TA_75875.pep
MPPRAISIKVAREEDLSSHIGNDGFYFDLVDFDRVRAFQIPDNTTMSRLKEEIAVEFSIPSQFQRLWLFCKRQNGTWRPVRPFSTEENNLSMTSLHKLLSRTFLFLNPDCVKLFLEVLNDSSPQNLSNDDGLVFLELYDPEQTQIRYIGMLFVKASSRPSDILPRLRSLAGFC

SEQ ID NO: 181458 - protein, 126 aa, Triticum aestivum
  Clone ID: PAT_TA_75876.pep
LLELDMLELNFPFEINKQIPCSLQLTNVSNDYVAFDIVMTGVLLYDVEPKKGIVPPQSKCNVMVTLQAQQKAPNSTAFKDEFFMRCAAVNEGIMREDITQDMLDKKSAKGVDEVTLKVVISAVGSA

SEQ ID NO: 181459 - protein, 137 aa, Triticum aestivum
  Clone ID: PAT_TA_75877.pep
QLQETCYSLMCDLPIIVDKQIFGKSISIILIILKYSLPPTNVCLRCHLPDFYFSKNGRYSTQPEKNSRTCLKTILFSVDVQDLLENYIRHNQKNSRTECQCGRHMKNYIENYSFPDSLISWQSQKIHQLFFTSSSTE

SEQ ID NO: 181460 - protein, 251 aa, Triticum aestivum
  Clone ID: PAT_TA_75878.pep
IRHEGRTGQRRRVGRGLGEPGAPQRARGRKAASGEAGNHSGGGRRRSGTWGQAGNSSSGWSGRAAVITDRERATAMAPICGSQEFLDDLTIKVSRSVVLVMSFETRGTHRQFMDMPPMEGEERDRYIQQNMRTTHYKSCTGFIIGASKRVIFIAVHHSQINTAAFDTFSVRFHDNNEKAAKIFIKKTKSVTILSVEQPDHPYHPVLRSRKRIGRDDVLILSNVHLGCLNSYQSSVINPTTEAIANPADSDS

SEQ ID NO: 181461 - protein, 201 aa, Triticum aestivum
  Clone ID: PAT_TA_75879.pep
MEWAYSGGGHSSSGTKSPAAGGREEGSYMTVSSAPPKRRAGRTKVRETRHPVYKGVRSRNPGRWVCEVREPHGKQRLWLGTFDTAEMAARAHDVAALALRGRAACLNFADSPRTLRVPPQGAGHEEIRRAAVEAAELFRPEPGQRNAATTEAPAASPADAGNAELVANSPYHLMDGLEFEMQGYLDMAHGMLIEPPPMAGP

SEQ ID NO: 181462 - protein, 226 aa, Triticum aestivum
  Clone ID: PAT_TA_75880.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTN

SEQ ID NO: 181463 - protein, 213 aa, Triticum aestivum
  unsure (1)..(213): unsure at all Xaa locations
  Clone ID: PAT_TA_75881.pep
MSSQGQKTFKILCRTDEDYCITVRWDDDGGIAVVMAPTNPRDQQQHWYKDTRFSSTEDEDGFPAFALVNKATGFAVKHSSGQSEPVTLVPYEYDPEAVHESVLWTESDDVGDGFRCIRMVNNIHLNFDALDGVTELQDGTPVVLWEWLEGANQSWKILPWGTDGGLHPALSSECTMRIFCSAGEEYSIAXKGNGAVCLAPADPNDDLQHWVKD

SEQ ID NO: 181464 - protein, 244 aa, Triticum aestivum
  Clone ID: PAT_TA_75882.pep
FGTRHGVDNDNQASWIHPTGSESPVSFNNDEQPSPVSVLESSLDAEEVYSGDFEKISADLQGLRMQLQLLKTETTDDADDTDHLTASDDEVASADEPLAEMEILPHAFVDEEERDFSYVLDMLTLLGIDDAFQDRLLDVRCFSEYPAGPDIYDILENKYSSLILWPASERMLLFELTNTVIADLIASLVHHGSKGLLRRFSSRWDQEGFVVDVWQRVFEIRQEMDGNQGDPLMMDFERHGSEDG

SEQ ID NO: 181465 - protein, 64 aa, Triticum aestivum
  Clone ID: PAT_TA_75883.pep
DCLAPHHCSYIISRCLLTLHILQYFSSSKPNKHGCNKDIFYQRSPLAGRIIFQSEPNKVGCTNK

SEQ ID NO: 181466 - protein, 227 aa, Triticum aestivum
  Clone ID: PAT_TA_75884.pep
NVRIITRRVGGGFGGKGMKGSHAACACALAAFKLRRPVRMYLDRKMDMIMAGGRHPMKAKYSVGFKSDGTLTALHVDLGINAGISPDLSPLIPAYTIASLKKYNWGALAFDIKLCKTNMSSKSVVRAPGDVQGSFIAEAIIEHVASVLGSDTNVIRRKNLHSVESLTKFYSDSAGDAPTYSLVGIFDKLASSAEYQSRAEAVERFNGGSRWKKRGISCVPITYEVTL

SEQ ID NO: 181467 - protein, 242 aa, Triticum aestivum
  unsure (1)..(242): unsure at all Xaa locations
  Clone ID: PAT_TA_75885.pep
MFYSHQLLARKAPLGQIWMAATLHAKINRKRLDKLDIIKICEEILNPSVPMALRLSGILMGGVVIVYERKVKLLYDDVSRLXLRSTRRGRSGRPWTTPSSPRARLKPXYEAVTLPENAMDMEVEQPVLFTDTDTARFRGMRLEDLDEQYVNVNLDDDDISRADRHHQAEAVNITLVDNFESGLAETDIFNRFERFDIADDDTTVHITLDEHPEAPSTLVPSPPRPEDPPQHRNSVLPHPPSA

SEQ ID NO: 181468 - protein, 244 aa, Triticum aestivum
  Clone ID: PAT_TA_75886.pep
MSRCQYENSNEIGVFAKLTNAFCLVSPGGSQNFYSVFESELADHIPVIQSSIGGCRIVGRLTAGNKKGLLVPSTTTDQELQLIRNSLKDDIVVRRIEDKLSALGNCIACNDHVALVHPDIDQETEEIIADVLDVEVFRQSIAKNVLVGSYCCLTNQGALVHPRTTVEEQKELSALLQVPVTAGTVNRGSEVIGGGLVCNDWAAFCGLDTTSTEIAVIESIFNLQDLDRASIVKEMRSSLIDTLS

SEQ ID NO: 181469 - protein, 255 aa, Triticum aestivum
  unsure (1)..(255): unsure at all Xaa locations
  Clone ID: PAT_TA_75887.pep
RAGRAAEQTFDRMVASGVKPDRLAYLVMLNIITRFGETKKLMALYRTMMNDGYVPDDTLYQVMLAALAKGNEHEEIEGVMQDMVVVCQMDRQLVYSVLIKAGCIFQGAMLLKQACLQGHEPDSKSLLSTLDAYETMGKHAKGLSLLQCIREHVPSSHKLISECSIMLLCKNQKIAAALQEYSSMQTLVCGSFGQDCNLYECLITCLEEAEFLPEASQVFCXVEPSQKIYESMISTYXKLGFPGTAHQMMDEGMNL

SEQ ID NO: 181470 - protein, 89 aa, Triticum aestivum; identical to SEQ ID NO: 130083
  Clone ID: PAT_TA_75888.pep

SEQ ID NO: 181471 - protein, 89 aa, Triticum aestivum; identical to SEQ ID NO: 130083
  Clone ID: PAT_TA_75889.pep

SEQ ID NO: 181472 - protein, 221 aa, Triticum aestivum
  Clone ID: PAT_TA_75890.pep
FPTITVPLSASATCSCLPRCPRAPIVLDVTSSSTPRLGRLRHCHQPQLRQRHHQDQVSTLHDPASLRWLRRLHAFALATQRQVHAGGAGRPHPPAPERLLDATRGCTPHTGTSVHAHEISPPSVLHHFLARLDAVGWASVRAPAYTTRWAGPGLRQGAGIRGGGAAHVVFDEMPTSEGDEEEEDQVKCHVGIFFFQLSLMSSNHLSPSVSVFCHFSVRCIL

SEQ ID NO: 181473 - protein, 252 aa, Triticum aestivum
  Clone ID: PAT_TA_75891.pep
VRFASMAALAQAPSPAESIDPPTRDHRQSVTAADGTGRGMVYNLAYLELPKCASWSLPGGLCVLHELEELGSFSSDKTSEISKPGRSDEEFIMVGSTFRMDAHNLVKTGCGSAKSDLSVGLILYTLVTRDHKIINNAPLGKPHSSECSRRLEVYTNDVSVTDRQKGEKHDGNTLKSTDARLALKRKSCKNDLVSKGNHAHPDNGFVTDSSGETSLSLNAATETPMHYRPEGGLVHSGAPSHPAAAQESGTTP

SEQ ID NO: 181474 - protein, 123 aa, Triticum aestivum
  unsure (1)..(123): unsure at all Xaa locations
  Clone ID: PAT_TA_75892.pep
SRKGGSFVYKPPQAGWLISGMAIFDTMQTVTPDIYTICLGIAASMASFILLGGEPPSIXHSRIMLHQPASAYYRARTPEFLLEVEELHKVREMITRVYALKTGKPFWIGRDRVDGRQSVVLPG

SEQ ID NO: 181475 - protein, 259 aa, Triticum aestivum
  unsure (1)..(259): unsure at all Xaa locations
  Clone ID: PAT_TA_75893.pep
RHEDQFKFFAELCRNKVGENDSVIIVTHEPNWLLDWYWKEITGKNVSHLIQDYLNGRCKLRMAGDLHHFMRHSATPSDKPTFVEHLLVNGCGGAFLHPTHVFKNFERFSGTTYECKAAYPSYEESSGIALGNILKFRKKNWQFDIIGGFIYFILVFSMFPQCNLVHILNEETWSGRLQSFSSTIWSALLFIFEHSYVSSVGSLTLLMASYSFVPSKLTRKKRAIIGGLHVLAHLTAALVLMLXLMELGIEICIRNHLLA

SEQ ID NO: 181476 - protein, 223 aa, Triticum aestivum
  Clone ID: PAT_TA_75894.pep
MFITDTDVDVVNQQISTLSFDEGASIEDEIKVTQEMLGFKLHRVMLTAVVVISEDNDRALVTNDIGFGKEVTMHVRSIDVHPREPWVLITEDGNRIHIWNWKTNGIMGILPGKSWSNLEGGKVGPEDVVAKFITRKSWVVMGLPNGFVDVRMYPTMDLVKEFRAHRLGVTLLAVHSTRPFLLTCGYPPSMKLWDWNRNWSCTGIFDISIPVTQVMFNPKDSSI

SEQ ID NO: 181477 - protein, 77 aa, Triticum aestivum
  Clone ID: PAT_TA_75895.pep
FGTREHAEGDAPHGCRPDPRRRAVPDLLGRSSRRRRCSGTTGGGSPVSARRERCASWPVSASAPSSHPEVLRVVARC

SEQ ID NO: 181478 - protein, 195 aa, Triticum aestivum
  unsure (1)..(195): unsure at all Xaa locations
  Clone ID: PAT_TA_75896.pep
EESTWVPASXRRERQQQLAALFRGAAANNSAAATAAAAVANKRPRELVRSLGRLPSATTAMVDATTSSGEGDGRFPPELSLEAVFRCVRIGPVDEPDAEFAYQTAVSIGGHTFKGILRDHGPAEEAAGQLPPSSGEYHELTGAAREGSSPAGSSEAAGGHGATVATSAAVLMDPYPTPIGAFAAGTQFFPHNPRT

SEQ ID NO: 181479 - protein, 232 aa, Triticum aestivum
  Clone ID: PAT_TA_75897.pep
MLARKFASKTLSKAPSSLLFSRLNSTTPATTRMDPKKHANTLLSYFPGDSLVAKAGSVLVSSSIAALLISKEIYIVDMEFFEMGCIFGAYYLWYKGGKEGFASYISERKEAIRSVLTSARTSHLNVVQERISHISKMANVVPVTDALYDMSREIATMEAEIYELKQKVGMTQEVKGVLDSWVRYENSLREKEQSDLVKKVMEGVSSQMKDPKMYNEIMAQTLVDVGKIAKSA

SEQ ID NO: 181480 - protein, 91 aa, Triticum aestivum
  Clone ID: PAT_TA_75898.pep
IRTRHHTRTPPAQIKNSCRPAGVPWPCDPACLRRRRCIRWDGSEAVADRSVPQYRRATPRRHHLCMLSSPADSGMHADAGASRCMHGCCSS

SEQ ID NO: 181481 - protein, 159 aa, Triticum aestivum
  unsure (1)..(159): unsure at all Xaa locations
  Clone ID: PAT_TA_75899.pep
MQGVGDQGGGMEMSFGGGGGRGECSSSSAXAVAVAAASAAEAEERQLLKGEMAVHPLCEQLVAAHVGCLRVATPIDHLPLIDAQLAQSSGLLHSYSAHHRPFLSPHDKQELDSFLAQYLMLLCSFREQLQQHVRVHAVEAVMACREIEQSLQDLTGASL

SEQ ID NO: 181482 - protein, 168 aa, Triticum aestivum
  unsure (1)..(168): unsure at all Xaa locations
  Clone ID: PAT_TA_75900.pep
LAMFALAIVMAVVADVSAQNTXPQDFVNLHNRARAVDGVGPVAWDNNVARFAQDWAAQRAGDCLLQHSGGPFGENIFWGSGQSWTAADAVKLWVDEKQNYHLDSNTCDAGKVCGHYTQVVWRKSTRIGCARVVCAGNRGVFITCNYNPPGNFNGERPFAFLTLGAEAK

SEQ ID NO: 181483 - protein, 165 aa, Triticum aestivum
  Clone ID: PAT_TA_75901.pep
FGTRQLLMAALYALSPADAVQPTSVVSTAPFYSWYPAVTDFLRSGLFRWAGDANSFVGDAYIELVCSPNNPDGAIRDALLGSGGAGKAVHDLAYYWPQYTPITRRADHDIMLFTMSKSTGHAGTRIGWALVKDREVARRMTKFVELNTVSVSKDSQLRAARVLRA

SEQ ID NO: 181484 - protein, 132 aa, Triticum aestivum
  Clone ID: PAT_TA_75902.pep
FGRGTAKTAFPHLEQYDADLILGCNGFIWVGEHVAVDEGTNLNEDQHKLSMEVEAFTPLETRRHICRLANAVRVLSALGFTLTVELIIQTAEASLSSHVEISDMLGAEFYVQTAEREAKRRADLSRRMNGPR

SEQ ID NO: 181485 - protein, 243 aa, Triticum aestivum
  Clone ID: PAT_TA_75903.pep
LIGGHCFTKRLPTGERRRVSIARELVMRPHVLFIDEPLYHLDSVSALLLMVTLKKLASTGCTVIFTMYQSSTEVFGLFDRICLLSNGNTLFFGETLACLQHFSNAGFPCPIMQSPSDHFLRAINTDFDRIIAMCKNLQDDQGDFSSVSMDTAVAIRTLEATYKSSAEAASVESMIAKLIEKEGPYLKSKGRARDAARIGILTWRSLLIMSRDWKYFWSRLVLYMLLALSIGTIFIDIGHSLSS

SEQ ID NO: 181486 - protein, 209 aa, Triticum aestivum
  Clone ID: PAT_TA_75904.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRVGVIKNREKHKGTFETIH

SEQ ID NO: 181487 - protein, 139 aa, Triticum aestivum
  Clone ID: PAT_TA_75905.pep
HNRARAVDGVGPVAWDNNVARFAQDWAAQRAGDCLLQHSGGPFGENIFWGSGQSWTAADAVKLWVDEKQNYHLDSNTCDAGKVCGHYTQVVWRKSTRIGCARVVCAGNRGVFITCNYNPPGNFNGERPFAFLTLGAEAK

SEQ ID NO: 181488 - protein, 271 aa, Triticum aestivum
  Clone ID: PAT_TA_75906.pep
RHEDSDYHDIQLNWITFTTSENQQDVENAARTLKAHEENYLVKAASKVFNFQKLLYCESTEALRPGAFHALTDYHLHTAVSAEVSLHQYVVSMSAMAARGATTYNHLFELFVILENFSERYHNSLPALSTTRTQMIQIISEARSEMWQTSVSFHPKAFNLYKTYQPDAPKLDYSESSLSEEPAPNGWAIVQKETKLALDHSLGLDRGLSGGLLEIPNGAPVYIEFEFIQNNKHQIWQLHRAKRTGANNEPFLSIRSSLDTNYEFGMFTFRW

SEQ ID NO: 181489 - protein, 259 aa, Triticum aestivum
  Clone ID: PAT_TA_75907.pep
EGSYAIGELRNDYIRPPSLETPTKIAGNHRFDPYFKDCIGAIDGTHVRAGVTKDVEHSFRGRKAFTTQNVMAAVDFDLRFTYVLAGWEGSAHDATVLADALTRERGLQVPPGKFYLVDGGYGAKPGFLPPFRGVRYHLNEWGNNPVQNDKELFNLRHSSLRVTVERAFGSLKRRFKILDDAKPFFTFPTQVDIVIACCVLHNYALSQGIDEFIIPEVTWTTQPIRTSRQQASDTRAVVDRRLQMAAQMWEDRQLMYANL

SEQ ID NO: 181490 - protein, 112 aa, Triticum aestivum
  Clone ID: PAT_TA_75908.pep
RSQGLRLKRRRGNCRLASAEAVVLCCKRGGGRLDASSILSSPITEIRLGMGWEILGWLGRTPRAAAPTRRGGREGGGCCSPAPIDDELESSPAAASIPSLQTGKRGEGEESL

SEQ ID NO: 181491 - protein, 224 aa, Triticum aestivum
  unsure (1)..(224): unsure at all Xaa locations
  Clone ID: PAT_TA_75909.pep
SARGKLSDPFSKKEWYHVLAPAPFPKTALGRTDVTKTTGQRLARDSLLGRVFEASLGDLKDHAEDEAFRKFKLKVEDVQGNVCLTNFHGXSLTTDKLRSLVRKWHSLIECYSDVKTTDGYILRLFDIGFTKGRPNHNKKTSYAQTAQVKQIRNNMIXDRRTXAANVELKDLDGKLIPEIIGKEIENATQGIYPLQNVFIRKVKVLRSPKYDMSKLMELHGGAAA

SEQ ID NO: 181492 - protein, 66 aa, Triticum aestivum
  Clone ID: PAT_TA_75910.pep
VFVRYFLTLEMMYKATKLTKACIDMPHLSPPCIYITLQIVYPTVLQCREFSNAMQSITSSSKKKKK

SEQ ID NO: 181493 - protein, 147 aa, Triticum aestivum
  Clone ID: PAT_TA_75911.pep
EFGTRARSSPASPLDYSAGSASLRSGASTSGGEDGAFCSPWHRRAATAPATATTKTTTKVGSIRRPQLTFQAPPPRPAGQRQRKKMRLPEVQQLVRSLAVENESLHEQKGKQQQQLDQQQQQSPHDSFALPDLNLPAQDGADGSAPC

SEQ ID NO: 181494 - protein, 187 aa, Triticum aestivum
  Clone ID: PAT_TA_75912.pep
KELVVIDPHFVHGVNFVLWTGMAYVAAGDSVFQALREQHAQEVKYQNDFGHLLVESQALLLRKMIAQVQIPAIIRDGVAEYNAAAKAMVTYRNLSLRHAARDAIVKKLEAVERREEEEKLNAATKIKEGAITYVRQQFAKAPSAQQQNWLEKSIAFLSNPTSVNLIKEYNVPRVLDEYYTTKPWTKK

SEQ ID NO: 181495 - protein, 67 aa, Triticum aestivum
  Clone ID: PAT_TA_75913.pep
SARGFDSMYLVWIFLMLLYTRFICMVNSRSYLVRRELKYKGGSRTCHLVWRTRNSIVQFCFSFSQGE

SEQ ID NO: 181496 - protein, 262 aa, Triticum aestivum
  Clone ID: PAT_TA_75914.pep
MAGGAGGGGAAEITLERTPTWIVASVCSVIVLISLFFERLLHRLGKRLTKGRRKPLYEALLKVKEELMLLGFISLLLTVFQGATQKICVRESLMQHLLPCPRNGAGAAKSVQHYAAGATVFTGVVGSTRRLLAGGGASSDYCLNKGKVPILSIQAIHQLHIFIFVLAATHVILSAITIILGITQTRKWKHWEDKIQQSDDNGPQMVRHVQEFKFIKKHFKGHGRRWEIFGWLRSFFKQFYGSVTEEDYTTLRLGFVMKHSKG

SEQ ID NO: 181497 - protein, 209 aa, Triticum aestivum
  Clone ID: PAT_TA_75915.pep
GVLASPDSFLRRPRLWLELISEFKATCTPVPSFTLPLVLRRGGGRSASAHGLQRPVQLGSLRNLILINEPIYKACVDEFVAEFGLHGLRSESVSPSYGLAENCTFVSTAWRSTSGRVDRLPSFKKLLPSARLPSSRAHEASEIEIVVVDEKTGEPVRDGTEGEVWVSSPSNASGYLGHPSASHEAFCGRMPGRAGSRFVRTGDRGVVTG

SEQ ID NO: 181498 - protein, 170 aa, Triticum aestivum
  Clone ID: PAT_TA_75916.pep
MDLSKNCDHGLAEIEALLRREQELVTQLRALILPQLHNVDSGSAELAVQLFDDVIGCSTSVVSKLFTAGSGATTELIDDKSLVRKNSTSTAAAIDDKMDEQARPSCVVGRKRRRNDSKRSRSLVTNVPHYDGHQWRKYGQKNINGRQHARSYYRCTYTERNCSATKTVQQ

SEQ ID NO: 181499 - protein, 100 aa, Triticum aestivum
  Clone ID: PAT_TA_75917.pep
FGTRHSVTPLQDIYGVHDSPCLTRDFYLLPNASRALAPIYVQLLTSRNVTLDSICATSSTTQSLISLLEISKVLRDCALAKINMVGSKKKKKKKKKKKKK

SEQ ID NO: 181500 - protein, 247 aa, Triticum aestivum
  Clone ID: PAT_TA_75918.pep
GTRVTSAMAEYALALSTPEGYQGYGPEQGQKSLRKAIADVVYPSMGIRDTEVFISDGAQCDIARLQMMFGRDVTIAVQDPTFPGYVDNGVIMGQTGPAADEESGGSRYAGIEYMRCAPENAFFPDLSRVRRTDVIFFCSPNNPTGHAASRDQLRQLVDFARRNGSIVVFDSAYASYVSPGGGDDKPRSIYEVPGAREVAIEISSFSKFAGFTGVRLGWAVVPDELLYADGTRVARDFDRVVTTCFNG

SEQ ID NO: 181501 - protein, 256 aa, Triticum aestivum
  Clone ID: PAT_TA_75919.pep
GLTSQATRELTFPIDDHGTVKTVLKYFQETYGFNIQHTTLPCLQVGNQQRPNFLPMEVCKIVEGQRYSKRLNEKQITALLKVTCQHPQQRELDILQTVNHNAYHEDPYAREFGIRIDERLASVEARVLPPPRLKYHDSGREKDVLPRIGLWNMRNKKMVNGGRVKEWICINFARNVQDGAARSFCRQLADMCEISGMDFSKEPLLPPLCTRPEHVERALKAHYQDAMSALKPLGRELDLLIAILPDNNGSLYGNLK

SEQ ID NO: 181502 - protein, 140 aa, Triticum aestivum
  Clone ID: PAT_TA_75920.pep
YLTKLDIHSNQLINLPDTFGELSSLIDLDLHANQLKSLPASFGNLTSLANLDLSSNQFKILPDCIGKLMNLRRLIAETNELEELPYTIGSCISLVELRLDFNQLKALPEGIGKLEKLEILTLHYNRIKGLPTTIGSLTRL

SEQ ID NO: 181503 - protein, 52 aa, Triticum aestivum
  Clone ID: PAT_TA_75921.pep
SSFPGNSNKAGIADLHRLGHFYSQSFPGVRGGVQLVSPAERRPAEMRGPSCR

SEQ ID NO: 181504 - protein, 167 aa, Triticum aestivum
  Clone ID: PAT_TA_75922.pep
MAMMKMTHDDYVHLCLMALASVATGGDQAQAAKGQWLQTVTAAAPAASELRFRCSVCGKAFPSHQALGGHKASHRKRAALVLPLQSVSPAEETVASSTSSGVGGHRCSVCHRSFATGQALGGHKRCHYWDGLSVSLTASASRSGSGSSVRDFDLNLTPVPEKAVGGM

SEQ ID NO: 181505 - protein, 217 aa, Triticum aestivum
  unsure (1)..(217): unsure at all Xaa locations
  Clone ID: PAT_TA_75923.pep
MAPMPPFSATTPESLLQGATAAGTAPAKTILVTGAAGFIGFHTCVALLNRGDNVVIIDEMNDYYDVKIKQSNLDYLTNTYSSERVKIYIGDLCDEQLVRRAMKETSPTSMIHLAARAGVRPSIDNPLLYIHSNVTATTVLLEACRHFGITRFVYASSSSVYGGSDKTFFSEKDVVDFPVSPYAATKKDXELLAHTYHHLYKIECFGLRFFTVYGPRG

SEQ ID NO: 181506 - protein, 194 aa, Triticum aestivum
  unsure (1)..(194): unsure at all Xaa locations
  Clone ID: PAT_TA_75924.pep
GELARKHFIHHVFRENDFEDGAQSLYRFLEHDPAVPRYYNFRGSTNDGEPKPAAAVGQRMTKIMVAILEAYASEDRRRVDYARVAASEEFRRYANLAXDLXRADVFALPAGERLSFFLNLHNAMAIHAVIRTGQPGGRXAVDRRSFFTDFQYVVGGYPYSLTTIKNGILRGNRRQPYTIVKPFGASDKRLELAE

SEQ ID NO: 181507 - protein, 199 aa, Triticum aestivum
  Clone ID: PAT_TA_75925.pep
DLLVEKTLNHDKEGQTSAETGATRGLNDVYAEIIAKNNRVGNVLHSGAEVITDDYNDHTTCSKDMHASFSEACASMHHLPQNAESISALTSDESISFLVNLEENCIKADSEYSTIRDTALQGKKTGGKTEEGDGKDKMSSVNLKDQRSFGEDSASKFVQKSRKETSDAQRIEGRDDIRKAESEIEKDVSLRPDKDKERE

SEQ ID NO: 181508 - protein, 199 aa, Triticum aestivum
  unsure (1)..(199): unsure at all Xaa locations
  Clone ID: PAT_TA_75926.pep
MTFSVSPAMAGGQGHEYMIRFHSHFDDPSPSTATAEPPPFAGRAISPEQEHGAMVAALLHVISGYTTPPPDFFFPAAASKEVCPVCRVDGCLGCEFFGAAEATGATAAALDAPKSAPAAVTAGGPQRRRRNKKNKYRGVRQRPWGKWAAEIRDPRRAXRVWLGTFDTAEDAARAYDRAAVEFRGPRAKLNFPFPEQQQQ

SEQ ID NO: 181509 - protein, 76 aa, Triticum aestivum
  Clone ID: PAT_TA_75927.pep
ASHGLLDKKRCRNFFSSIYCIFTSLTIEIVLPLFVFIRSMVFRIHCQKLMHAHDFFQKVYCYISFLGDAYHIFPPL

SEQ ID NO: 181510 - protein, 215 aa, Triticum aestivum
  Clone ID: PAT_TA_75928.pep
FGTRWEIEQPSKPKEMTCLRKTNVPPRLSRLNHDTGFNRLAVAMPLKSHELFQYLFESSRTLRTTQKVPGTEYLARMIDNPCGLRSAILMAGMHFSFQFGDLATFESTFLYHKIEVMRVINRWIASGDYKLEAAIIREMATLAFTEACHGELVAAETHISGILALIETARPDKSDPTRSDCCSTDRELANRYFVMSYVYITGLKSLLSGICRTGG

SEQ ID NO: 181511 - protein, 218 aa, Triticum aestivum
  unsure (1)..(218): unsure at all Xaa locations
  Clone ID: PAT_TA_75929.pep
GENNFSGPLPSEMFQSSRGLDVSYNXILNGNLPNNPPDRKWSINYIGTSIDASTTINSENLTLLNCLHMKECNKFNTKPITSFAVNCGGKQRISSDPLPITFDDDTSILGAAGFHVNTDRQWIVSHVGSDPFTNSSGPGTISTTQVILGTDMPDLYETARTSTSALSYYXXGLLNGKYTVQLFFAEILIDSQLNNGTGRRLFNIDIQDQNIKRDFDIT

SEQ ID NO: 181512 - protein, 211 aa, Triticum aestivum
  unsure (1)..(211): unsure at all Xaa locations
  Clone ID: PAT_TA_75930.pep
MKFLLFAMAANAARYFTRDSPIDGQYIVVFKKHLAKDAMTNHMEVATLKSVQINRQYSIGELFNGYAARMSQDSLNYLLDQPEIDYVEQDGTAHATDYFKPADLPSKNNDVCATQDGATWGLVRTSEVELNINGKYNYDKDGSSAYAFVLDTGIYVEHNDFNGRASWGANFVDTDNTDGNGHGTHCAGTIGGXKYGLAKKCRLIAVKVLSA

SEQ ID NO: 181513 - protein, 223 aa, Triticum aestivum
  Clone ID: PAT_TA_75931.pep
RHEVKDDIFWNFFKTCVFGSESSENYPELECIGRRILPKLKGSPLAAKTLGRMLSMDLQESHWKFILESELWQLKEKETEILPALRLSYMYLPFYLKQCFAFCAVYPKDYIFQKQHLAEIWVAEGFVEPQGGVPIQDIGCQYFEDLVARSFFRKVSGGYVIHDLLHDMAQQVSEHDCFILRNESDFDKVPQNVRHLYVLPSSDFDDSSLLRLCKYTKLRTLIL

SEQ ID NO: 181514 - protein, 162 aa, Triticum aestivum
  unsure (1)..(162): unsure at all Xaa locations
  Clone ID: PAT_TA_75932.pep
FGTRAPCVSSNASQFLYLALASAYISDLPXSCVAISKGIPIPFSYDKHGPNSDPSSEIAKAVDNFGATTFTWHLSNITDVCQQCEHQGRYCGFSSQRRQAFCQHHGTHVIPIAASSVAAFVVLSLIVATVIYLSLKSRYNEEINMNVEMFLKAYGTSKPTRY

SEQ ID NO: 181515 - protein, 132 aa, Triticum aestivum
  Clone ID: PAT_TA_75933.pep
VYTREEFLYWSTLQKSAHDFPSPSSSSMVCQVLSMLLDPVDRSGKMSSGGWKEGRSVKRHILESERSNMICVGDQRCVLYTCTTRCTLESLTSVYLQGLREEVEEDGVVGSSADRLRRQARSGHGGGSKVWR

SEQ ID NO: 181516 - protein, 187 aa, Triticum aestivum
  Clone ID: PAT_TA_75934.pep
MATRREPLARLSLQPGTRPPSNVPALKPVEGRPSLSGKRESLVGTKRESLAGRPSISSYSRQSLSGAPARLSLAPAAPSRLSLGGNPPNRRTSLAVINKATDPRPIGKKEYTTQCVKTILAFLTARNYDQACTSKNLLSPTRADFKSIVTFIFRQLDPNFDFGSNMEDEFRCYMKFFGYPIAISKTA

SEQ ID NO: 181517 - protein, 83 aa, Triticum aestivum
  Clone ID: PAT_TA_75935.pep
QYRAQIKACISNTNLAWFPGLTYNNERNLTHCFLDEVSNHLFYFFSNYHVTFLPLCQLLPRYALDLVLACFMCLLFSIDNHHT

SEQ ID NO: 181518 - protein, 161 aa, Triticum aestivum
  Clone ID: PAT_TA_75936.pep
ASKSRCRCRCIQTNKLLPTVVCNFDTQLRYERAEPRLVSVPHPASSSSSSSSSSSTLGLVLLLLLFTTTTSFPLLLLPHHHLHPLSANIAAAAAASISIPASSSAFSFLGLPRPLSIPDTAPSRLSSFLGLPRPLLLALVPPVAASPASPHTPLLFPASCR

SEQ ID NO: 181519 - protein, 170 aa, Triticum aestivum
  Clone ID: PAT_TA_75937.pep
GTRGAPAPAAWSSGLFDCFDDCGLCCLTCWCPCITFGKVAEIVDRGSTSCGTSGALYALLGSLTGCHWIYSCTYRSKMRAQYALPDEPCCDCCVHFCCETCGLIQQYKELKARGYDPDIGWHLNVERGNGGAGWLAASTRPACRRWAARSSNSAARVGWRIARASVPGAW

SEQ ID NO: 181520 - protein, 103 aa, Triticum aestivum; identical to SEQ ID NO: 107316
  Clone ID: PAT_TA_75938.pep

SEQ ID NO: 181521 - protein, 191 aa, Triticum aestivum
  unsure (1)..(191): unsure at all Xaa locations
  Clone ID: PAT_TA_75939.pep
KNRQDYFHFGDVITFDTTYKTNLYNMPFALFVGVNNHFQSVIFGGALMREETEAAFNWLFKTFVALMNDKHPVTILTDQALAMKGAIESALPNTKHRWCKWHVLRDVKGNIVHVYNKSSGFKKEFNKLVNDVMCVDEFESKWLSLVNRFNXQYMVRLYDKRVMWAKPYFKGNFXAGMTSTQHSESANHMLK

SEQ ID NO: 181522 - protein, 120 aa, Triticum aestivum
  Clone ID: PAT_TA_75940.pep
DSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPGYCYSE

SEQ ID NO: 181523 - protein, 32 aa, Triticum aestivum
  Clone ID: PAT_TA_75941.pep
IYSNFHGPALLPQDPAKRQFADELIAYADAFT

SEQ ID NO: 181524 - protein, 69 aa, Triticum aestivum
  Clone ID: PAT_TA_75942.pep
SARGQSQALHQSANCFSSPQLFPYQARASSRAGAQDLSSARRKLLWDWPAISCEGHSRSKFDKRGIPSS

SEQ ID NO: 181525 - protein, 214 aa, Triticum aestivum
  Clone ID: PAT_TA_75943.pep
MAPLQGGMLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLEAGAKKVLITAPGKGDIPTYVCGVNADLYTHADTIISNASCTTNCL

SEQ ID NO: 181526 - protein, 206 aa, Triticum aestivum
  unsure (1)..(206): unsure at all Xaa locations
  Clone ID: PAT_TA_75944.pep
SARGRTLFLVKPDPIVLRDHGGALLTGNLTVKVNVLYYGRFAPAQRAVVADFVRSVSAPAPGGAAEPSVASWWRTVSMYRGGGARLRLGRELLDETMSLGRSLSLENVTALXRGAGHHRGAITAVLTAPDVLVAPFCMSRCGVHDHATAGAHGRARYAYLWVGNPAQQCPGQCAWPFHRPSYGPQVPPLVPPSGDVGTDGMVISLA

SEQ ID NO: 181527 - protein, 217 aa, Triticum aestivum
  unsure (1)..(217): unsure at all Xaa locations
  Clone ID: PAT_TA_75945.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGXARVGGGPLGEGLDIIYPGGAFDPLGLADDPDTAAELKVKELKNGR

SEQ ID NO: 181528 - protein, 109 aa, Triticum aestivum
  Clone ID: PAT_TA_75946.pep
GTRVNLYAEYPAELSHPIPGFIISSLFFSRVPSFLLLFVGRIMLISLSIVLFSFFVCFGAHSCDEDNKLPLLKELTTLLAESNQLNIATTEQLCVLNNISLLLLIVCFF

SEQ ID NO: 181529 - protein, 158 aa, Triticum aestivum
  Clone ID: PAT_TA_75947.pep
KWPELQLLRRPTILMKLRPRGWTPREKQACRGGGLGSPVDGRQLQPHPLVVVHRRRDGEGGGVQACVCTIGVAPVGRRSLGRLARRRWIAQHHGVAGIYILLLEEAGRGEAADLGFQWLPRERAVGGRQDGDGGHGGRPVVEDARGFRGGEDEGGGPS

SEQ ID NO: 181530 - protein, 169 aa, Triticum aestivum
  unsure (1)..(169): unsure at all Xaa locations
  Clone ID: PAT_TA_75948.pep
MRHKTFQNIVKARKSHTGSLESLLSNPNETTLYNNAFVFYDLGMCVRAGVHFYLYLRALQLLGTEKHQELISRGFHLKDYGCFALTXLTHGSNAKGILTEAHYDHKNXQFVIHTPSKXAMKFWIGGAAHTANMAVVMAQLYIDGVNHGVHAYVVPLRDSQTHKLLPGVL

SEQ ID NO: 181531 - protein, 204 aa, Triticum aestivum
  Clone ID: PAT_TA_75949.pep
SDEGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFV

SEQ ID NO: 181532 - protein, 223 aa, Triticum aestivum
  unsure (1)..(223): unsure at all Xaa locations
  Clone ID: PAT_TA_75950.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGXPWLVAALLGEGLDIIYPGGAFDPLGLADDPDTAAELKVKELKNGRLAMFSM

SEQ ID NO: 181533 - protein, 156 aa, Triticum aestivum
  unsure (1)..(156): unsure at all Xaa locations
  Clone ID: PAT_TA_75951.pep
MDADHGGGVDEAEAAFFARRGSRCCCFPCWPSSTSSSSSALSHQRVGGAAATLGGEEEHWWQGAVDALLKVREWSELAAGPRWKTFIRRFGRGPGGPRPHHNFGGRKLNYDALSYALNFDEGHGATPEAGDHAXGYRDFSSRFAAPPASAKSSMDL

SEQ ID NO: 181534 - protein, 180 aa, Triticum aestivum
  unsure (1)..(180): unsure at all Xaa locations
  Clone ID: PAT_TA_75952.pep
MATTAMALSPSSFAGKAVKDLPSSALFGEARVTMRKTAAKXKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGXAVEGYRVAG

SEQ ID NO: 181535 - protein, 230 aa, Triticum aestivum
  unsure (1)..(230): unsure at all Xaa locations
  Clone ID: PAT_TA_75953.pep
FGTRESQLHDLYEKEEIYYKQRSRIDWLXWGDQNTKYFQNRASHRRRKNMVKALRREDGTLCTSDDDMRTMAMKFYASLFSSEGSNAAASVLQHIDTLVSEEMNGKLTTMITDCEIETALFQMGPTKAPGPDGFPALFYQRHWSLVKEDVCRSVKXFLDGVATPEGFNDTVIVMIPKVTSXGSCLSLFRPISLCNVLYKIATKVLANRLKGILPXLISEEQSAFVPGRLI

SEQ ID NO: 181536 - protein, 119 aa, Triticum aestivum
  unsure (1)..(119): unsure at all Xaa locations
  Clone ID: PAT_TA_75954.pep
SDEAPANPAAARSDPPPRRPTPRSGWPEPGPCPRGSGSRRFFPGRGARRRPPSDLYPSVSPRVAPGAARRVPPSPTPAAPPPHRIAAPXPPPPPARGRGPPVARDNGVPSLPFGKIWVG

SEQ ID NO: 181537 - protein, 129 aa, Triticum aestivum
  Clone ID: PAT_TA_75955.pep
MDAGSDLMSPEKSGRRGARPPLREAGATPSMPPLQEPGSRPRPYMPSLCSTPRNPAVKCYGDRFIPDRSAMDMDMAHYLLTEPRKDRKNGATPSPGKETYRKLLAEKLLNNRTRILAFRNKPPEPENSI

SEQ ID NO: 181538 - protein, 213 aa, Triticum aestivum
  Clone ID: PAT_TA_75956.pep
ATVRGRGGKPTAPATTLNCSYRRGGTGSTLFIDDVDYTESRTPQLLSSRCDIDPAQESGDRGQRTGERGGRGSSPPALDATVAGVPGRVEEEGGVGGEHGGRRRTASRHRSSRMPSWAELQVPEEARLAKIFASGRSHRDSILARAPPSPRMERPMAAPGSAGGSREGPRWLEAVKHHRHRSGVVAGRGRRCCANPRMGAGCGAGGRRGSGVV

SEQ ID NO: 181539 - protein, 174 aa, Triticum aestivum
  Clone ID: PAT_TA_75957.pep
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 181540 - protein, 222 aa, Triticum aestivum
  Clone ID: PAT_TA_75958.pep
GPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLEAGAKKVLITAPGKGDIPTYVCGVNADLYTHADTIISNASCTTNCLAPFVKVLDQKFGIIKGTMTTTHSYTGD

SEQ ID NO: 181541 - protein, 131 aa, Triticum aestivum
  Clone ID: PAT_TA_75959.pep
MAGATMALSSPAMGGTPVKASRAAPFGEGRITMRKTAGKPKVAASSSPWYGSDRVLYLGPLSGDPPRYLTGEIPGDYRWDTAGLSADPETFSKNRELEVIHCRWAMLGALGCVFPELLARNGVKFGEGVWF

SEQ ID NO: 181542 - protein, 75 aa, Triticum aestivum; identical to SEQ ID NO: 106874
  Clone ID: PAT_TA_75960.pep

SEQ ID NO: 181543 - protein, 151 aa, Triticum aestivum
  Clone ID: PAT_TA_75961.pep
MKKALPLKGGSGGSRHGTKSPKELESILKQYFGYSEFRGRQLEAIEAVLSGRDCFCLMPTGGGKSMCYQIPALVKTGVVLVISPLIALMENQVSSLKSKGIPAEFLSSTQTTANKNKIHEDLDSGNPSLKLLYVTPELVATSGFKAKLTKL

SEQ ID NO: 181544 - protein, 205 aa, Triticum aestivum
  unsure (1)..(205): unsure at all Xaa locations
  Clone ID: PAT_TA_75962.pep
GTRVTFHFINAYEEKDEEGRVTAIIADCCEHNANTSILDNLRLHNIRSFTGEDVLTDXRVGRFRIPLDGSPFGELEAALDPEEHGRGMDMCSINPAHLGKEYRYTYACGARRPCNFPNTLTKIDLVEKTAKSWYEEGAVPSEPYFVPRPGAVEEDDGVAISMVSAKDGSGYALVLDAKTFKEIARANFRYGLPYGLHCCWVPRDK

SEQ ID NO: 181545 - protein, 184 aa, Triticum aestivum
  unsure (1)..(184): unsure at all Xaa locations
  Clone ID: PAT_TA_75963.pep
SARGTRTLSPPANRAGSERTLPTRTNPSRRSPLLRPPTTTALLSCASSPNHPTQTPAASSPSSAAAPASPSFLSKGREGKGXDXGRGGKAPDRAERRPDPQRHRHQRAVAPSSTWSSRKAMDGGGTLAGDSFSWPPNPCLELHRHPSLYMFLDSLPLRAVLLDHVQVIAIGEQGWLGIYGGHGA

SEQ ID NO: 181546 - protein, 176 aa, Triticum aestivum
  unsure (1)..(176): unsure at all Xaa locations
  Clone ID: PAT_TA_75964.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGXCEESGKA

SEQ ID NO: 181547 - protein, 95 aa, Triticum aestivum
  Clone ID: PAT_TA_75965.pep
SARGLSSPSLLRASVCPTHKDPTLIRVFRRLPLFQSGVTGGARTGHWGSPAWGLSRGRKELRGQRLVMAPGLVSSRLGRRRRRRAQRSGELIQLF

SEQ ID NO: 181548 - protein, 187 aa, Triticum aestivum
  Clone ID: PAT_TA_75966.pep
GTRAQTMASMTGLSQGVRLPGPAGRRASRFIVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRLRASYLRYDLKTVISSKTTKEEKKDLKDLTGKLFATLDGLDH

SEQ ID NO: 181549 - protein, 106 aa, Triticum aestivum
  Clone ID: PAT_TA_75967.pep
RHEGPADHASPSTSASFSGPSTTTTDRSGSAEHEAVPEAVRWVRRGFEDARPVAEMVDPALLREAPALPKKEIVAAFHVALACTEADPELRPKMKTVADSLDKVGS

SEQ ID NO: 181550 - protein, 133 aa, Triticum aestivum
  unsure (1)..(133): unsure at all Xaa locations
  Clone ID: PAT_TA_75968.pep
DQRAGPARVKHTTDLARFDQIRPLHAGGAPPRQPAPNPRHLHVPSPXEPPRQAAPARALAWPPPGQATHHARSPLDAHPRRRQIRSPPPWQAAPRPHRRQIRPHLAAPTPDPIASTPYLAMRATTGAGRPLVP

SEQ ID NO: 181551 - protein, 52 aa, Triticum aestivum
  Clone ID: PAT_TA_75969.pep
PPTQHAGEHSATEVVRLVQRRLAGLQVEHGARADAQLPNGPRKTVSSSLVPN

SEQ ID NO: 181552 - protein, 148 aa, Triticum aestivum
  unsure (1)..(148): unsure at all Xaa locations
  Clone ID: PAT_TA_75970.pep
PSPTALAGKPPPPPAPAAAAAAAARRRGSREGRGCGRGAGPSRSRAWRPAAGRRRGXRCRRPSEGARPSRAGGRRGPPPRAAPRAAPSRRPRPTPSAAPAPSPPPTARTPSAPQPQPEAGRGAVDCGEGRTEWGRLCGLSARMHRPRA

SEQ ID NO: 181553 - protein, 173 aa, Triticum aestivum
  unsure (1)..(173): unsure at all Xaa locations
  Clone ID: PAT_TA_75971.pep
QGRILPPSEARKTAAAALPPPRDFLAYLEAYLARHDGVDKLLKISHYATRLALGPSLXASAPQASARLKSFESSLGLRRKAFRLSKFVXDVNALRAHSGPLPLPFVLLAYGGEGVYYIIGQFVWLAKAALLPAQLLPRLQRLSAWAELLGYVGSNTIKLEVVMKMESSIKMRL

SEQ ID NO: 181554 - protein, 235 aa, Triticum aestivum
  unsure (1)..(235): unsure at all Xaa locations
  Clone ID: PAT_TA_75972.pep
GVDVIIKRYNLRSDVRSINLSGMGCSAGLISVGLARNLLQVLPRGSRALVVSTETITPNYYVGNERAMLLPNCLFRVGGVAALLSTSPAKARFRLKHVVRTFTGADDSAYRCVYQEEDEQGNIGINLSKNLMAIAGNSLEANITRIGPLVLPASEQLLFALSFVARKVLRVRVKPYIPDFSTAFKHLCIHAGGRAVIDELQKNLSLSDEXVEASRMTLHRFGNTSSXSLWYELAY

SEQ ID NO: 181555 - protein, 172 aa, Triticum aestivum
  unsure (1)..(172): unsure at all Xaa locations
  Clone ID: PAT_TA_75973.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVVEGMDVVKNIXEKVGSRSGTCSKQVVIADCGQL

SEQ ID NO: 181556 - protein, 210 aa, Triticum aestivum
  unsure (1)..(210): unsure at all Xaa locations
  Clone ID: PAT_TA_75974.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWAXCQVVLMGXAVEGYRVAGGPLGEIVDPLYPGGSFDPLGLAEDPEAFAE

SEQ ID NO: 181557 - protein, 201 aa, Triticum aestivum
  Clone ID: PAT_TA_75975.pep
MDGCRDGFSGDFMVLRPDKGGVRSLLHLLRCSDVGASDAVDCAPGEEVVLDRWRRWIIFLSVVAQMLLLWVKTPLAKLGSAVEYWMNLITDNGGGVLKLIRNAMQGKLRIPDRESPNYRSLIGLIDMRVELDKKIKPEDGSYLAALGIMASKLAYENELVIKNVVEKHWHMKFLEFFNCWNEFRGDQGDYTTQAFMFADKP

SEQ ID NO: 181558 - protein, 233 aa, Triticum aestivum
  unsure (1)..(233): unsure at all Xaa locations
  Clone ID: PAT_TA_75976.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKXVKEIKNGRLAMFSMFGFFVQAI

SEQ ID NO: 181559 - protein, 234 aa, Triticum aestivum
  unsure (1)..(234): unsure at all Xaa locations
  Clone ID: PAT_TA_75977.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWAXCQVVLMGXAVEGYRVAGGPLGEIVDPLYPGGSFDPLGLAEDPEAFAELKVKEIKNGRLAMFSMFGFFVQAI

SEQ ID NO: 181560 - protein, 161 aa, Triticum aestivum
  Clone ID: PAT_TA_75978.pep
GAAQLSTNLAAAVAHWFPGIAPNLPVDLLAPSCPPTVICLATPPPQTTTCLEPPPPQTTTYLAPRRPLATTCLPPPRPPRGRPTGCSLGDSPLSLFHHRQRLPHPLCPTLFPNLVFAAGLIPCLCSPLVLTPWAFPLLITIHFIQSGVMMHLLCLDDGQRA

SEQ ID NO: 181561 - protein, 158 aa, Triticum aestivum
  Clone ID: PAT_TA_75979.pep
MGEERMTAKPEAVELPGFVMSADEAERAAAAAGVETVEDLLPLLIPSAMRRARPPISRFPVGAVGLGESGRVYAGVNLEFLGAPLSQVVHAEQFLIANAAAAGEPALRAIAVSHMPCGHCRQFLQEIRGAAGIRILVTSDAADGCAAEWRSLASPSCR

SEQ ID NO: 181562 - protein, 103 aa, Triticum aestivum
  Clone ID: PAT_TA_75980.pep
FGCHVIKLIWLANIGSSESIYNLNLLETSKGSSVRRQAYHIYLWCHWKQCRYADHGNLHAFSSYITQSSQKDHLWIRMYTTNFFSCPNIRDQANCMHVSSVMD

SEQ ID NO: 181563 - protein, 221 aa, Triticum aestivum
  unsure (1)..(221): unsure at all Xaa locations
  Clone ID: PAT_TA_75981.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGXKMCCLFINDL

SEQ ID NO: 181564 - protein, 154 aa, Triticum aestivum
  unsure (1)..(154): unsure at all Xaa locations
  Clone ID: PAT_TA_75982.pep
MPTARLSSIFTSSFRDPSRAPLAALAAATERVRAGTLTREDAHHLFGELLGQAAAVPERGLNNFLATLARAPPSPACSDGPGLAIALFNRMSRGAXATXVSPTLCTYSILMDCCCRAGRXGLWWLPSSVASSGWGLRLEVISVSNLLKGLCQAK

SEQ ID NO: 181565 - protein, 169 aa, Triticum aestivum
  unsure (1)..(169): unsure at all Xaa locations
  Clone ID: PAT_TA_75983.pep
YVLTERRPVRAEHHRLELVRHVHVAALRXASWPAPLASSLPPAGASRGERRRTXRCRAGARPRRXAAVXRADASLRERRRPLRRRVVLLARPPGGGVAVLRLLLLLKPGAHEQFLVRRREPGGGRGKLPRLGARVAQRHHPVAVAVVQPNLLGLILRSWSVNRTHMVTS

SEQ ID NO: 181566 - protein, 197 aa, Triticum aestivum
  unsure (1)..(197): unsure at all Xaa locations
  Clone ID: PAT_TA_75984.pep
MVLMPRRAPRLAAAVLPLLFLLLAPAEAVPFVVLHGIGGQCTDSSVAEFTRLLADWSAADGHCIEIGNGARDSWLMPLNEQADIMCNKVKEMEELSGGYNIVGLSQGNLIGRAVVEYCDDGPPVKNFISLAGPHAGTASAPXCGSGFFCVIVDALIKSEIYSDYVQVLISWLSHFPNPSRASTPSVRKNLSQACSLK

SEQ ID NO: 181567 - protein, 107 aa, Triticum aestivum
  unsure (1)..(107): unsure at all Xaa locations
  Clone ID: PAT_TA_75985.pep
FGTRAAGRPPRPEREGAAITTSPPWPPPPRLRSPHXPPPCRRGRVRGGCPSTPSPSAPAAPQSPPPPPHPPRSSCRHWATATTPTGPPACPCPSPSPATPLSRCLGR

SEQ ID NO: 181568 - protein, 117 aa, Triticum aestivum
  Clone ID: PAT_TA_75986.pep
MASGGGGGGKDAGVAFNKMRAEGRDVRKDRSMELKNRRANPISTTSYVQILGTGMDTQDTAPSILLFFDKQRFIFNAGEGLQRFCTEHKIKLSKIDHIFFTRVCSETAGGLPGLVLT

SEQ ID NO: 181569 - protein, 100 aa, Triticum aestivum
  Clone ID: PAT_TA_75987.pep
TASPAYYNSQPVWTTAENLDILAYLPLEPLAELRWVRLPCHDHDSNADVFILMPLLSLELLSLHLQPPFLLSYEPLTKHRSYPIHRHGSIGFRRRGTSVQ

SEQ ID NO: 181570 - protein, 198 aa, Triticum aestivum
  Clone ID: PAT_TA_75988.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLP

SEQ ID NO: 181571 - protein, 75 aa, Triticum aestivum
  Clone ID: PAT_TA_75989.pep
SSISHDSIGKADGEKCKYLSDAVSWNMPSHVEATTLFQGCVVQVLIMVWQHTFQRRSEQTMMQGCSSLYCMSSST

SEQ ID NO: 181572 - protein, 173 aa, Triticum aestivum
  unsure (1)..(173): unsure at all Xaa locations
  Clone ID: PAT_TA_75990.pep
TLKLVDRFLLSYMYTLYNDATGTLPLHRCDLHGRIKCFHRVNTVSLGEEEESERQKGTEAAKDGRQLLVRFDRRLQAMPTAQGARXRRRXPQARVEVPVREGRVLCFRAVIAAAGAVVEVERVAERVVPELPRGRHAPPPPVPAAVLWPLPAATRRRRRAEAAAYGGPQLVAQ

SEQ ID NO: 181573 - protein, 207 aa, Triticum aestivum
  unsure (1)..(207): unsure at all Xaa locations
  Clone ID: PAT_TA_75991.pep
MLRAAASRCAGGAIRRLSVASYPEAVGARRKPPLDEGDWSYYKEWWGEDDGPGVGAHTVFCRHSEHGNGVVSVVAYPATRPASDQWPVTERWLQERNSAMYPESSGADQFKILGYQWRVMRFNDHTRQSTAKVMACYRSGGDRALYSMQQPNCLAVPYVKSMVSAGLTXLPSCSYDLPQAVSEPNTMKILCIGHGGGSIPLFLASKF

SEQ ID NO: 181574 - protein, 99 aa, Triticum aestivum
  Clone ID: PAT_TA_75992.pep
LLLRGLVPSAPPAARRGRGEPGRRAPPAAGEAAAVVGPRGPAAEVQARPADGDAGARGRGGVAEEETGGHRRRRGEEKNVNFLLAFSTRQLNSLRTLVP

SEQ ID NO: 181575 - protein, 78 aa, Triticum aestivum; identical to SEQ ID NO: 106952
  Clone ID: PAT_TA_75993.pep

SEQ ID NO: 181576 - protein, 176 aa, Triticum aestivum
  Clone ID: PAT_TA_75994.pep
MASVSRALRPRPRLAAPRLGCGLRVGCSVPAYGSAATEKADWGLAIAPSPATTLVPVVRSRQIFCKAEANISSNLPASEPTGASQYEKIVELLTTLFPVWVILGTVIGIYKPSMVTWLETDLFTVGLGFLMLSMGLTLTFEDFRRCLRNPWTVCFLPLGRMYLYKNIDAVLYLITS

SEQ ID NO: 181577 - protein, 234 aa, Triticum aestivum
  Clone ID: PAT_TA_75995.pep
SDEAAFLVVAAKLIVLAAAAATAANAASYARFRRRHLRRIRSPIDESADPVADFRSLPSSAAAAEDDDFFFGLATAPAHVEDRLDDAWLQFATEQSVDDKESMRNQKQVDAVMASAGGDGGSQPSSRLRGDEKGTDGEKRKPLRVAMEAMLRGFEKFSEGEESSGGDNCSHNVAAWHNVPCPQERLKFWSDPDTELKLAKETGISVFRMGVDWTRIMPKEPTEDFKSSVNFAAL

SEQ ID NO: 181578 - protein, 155 aa, Triticum aestivum
  Clone ID: PAT_TA_75996.pep
MDYPMQEVHQHPGFRAVHPWQWWQWQLSVLASSSSPPAPSSRPPNHVSWDETGAAHIYSADLPGVKKEEIRVEIEDGRYLVIRTELDAGDAEVHGRRGSFARKFRLPGMVDADGITAEYAHGVLTVTVPRMHTRARPVVNLIGLGPACDPVARAA

SEQ ID NO: 181579 - protein, 105 aa, Triticum aestivum
  Clone ID: PAT_TA_75997.pep
PRLVYFSRPINRDEVVPIVGAAAGRSGPFRRPKAGTAALCRDPRVTADGWERACPLALFSAGSGLTTPPLGAGLKFGSSSGLPPPCPIALCKSVLITCENEPRAE

SEQ ID NO: 181580 - protein, 187 aa, Triticum aestivum
  Clone ID: PAT_TA_75998.pep
TSVIERHWPAETKPRHCIVDPIEGSTHPRPHNAATPPVSWGTIERSHGAETAPRRLCATGEVEGHRQANQTRTLHRRRNRKAPRIRDCTTPRHHLCHGVHSKGHARPDSATTPVRHRRGRWALPSRDTRGGTPSTNNKNTNDEEVRPKERDSHPTSHDPPGWEEAASMTATANPWSSPPRQTSAHRS

SEQ ID NO: 181581 - protein, 204 aa, Triticum aestivum
  Clone ID: PAT_TA_75999.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILL

SEQ ID NO: 181582 - protein, 107 aa, Triticum aestivum
  Clone ID: PAT_TA_76000.pep
RRRRRERRGIPTLLGREARRLLLRLALAGGAAALDPGLPSPSKRAPFRSVCLLRFGLVIIKASASRLLGLLLSVCGSRFDYLKEKLASRFRFEGRFVWDLFLVVSRW

SEQ ID NO: 181583 - protein, 100 aa, Triticum aestivum
  Clone ID: PAT_TA_76001.pep
DLRPHGMNRPDSFRSHRHLPPYRTPVAVIHRRLCRRRCFPGLPDHTIVFYVSHCTFPLCSPFLLGPRGFTPRRHGHHLVAGEWLAGPPVQPGLLPRRSGP

SEQ ID NO: 181584 - protein, 186 aa, Triticum aestivum
  Clone ID: PAT_TA_76002.pep
MEQRQSITMSKLDSSGVTVLDDLPESIIAGEILIRLPAEDILRCRAVCKLWCHATSAHDFLLAHHHRQPSLLLINCFNRDNRFCDGHLCVFCGDHAGSTGRKLCRPILWYADHTQDVDSLAIQAACDGLLIVSYKDNGRRFDICNPTTRQRAPLLLLPGPRCRASAKSIRIAGFYQHCPSREYRLL

SEQ ID NO: 181585 - protein, 121 aa, Triticum aestivum
  Clone ID: PAT_TA_76003.pep
INSAAVVSRHRSRCELLDTMRERASWSGPRSTASTRAPQAQAAPYDSCRRQGPWSSGRRSPPSYAIKHHQVNSMQGDASSSSRGAVPPWKVSLSLVSIWYGAIVGSLPSLMRFVTPLSFDL

SEQ ID NO: 181586 - protein, 158 aa, Triticum aestivum
  unsure (1)..(158): unsure at all Xaa locations
  Clone ID: PAT_TA_76004.pep
MSYRMMGEEEEDAFEASSCASSGGESGDEGDRFPASGGARRQSAPPQAPLRRMNSDSIYDMSGMTAHLPAKKGLSAYYQGKSQSFACMAEVRCLEDLQKKEKPRGHKMKPCKSYXALGGVAMARKPPGSSCANLGLMDAGNGFMAPRNIPVNDDCYHQ

SEQ ID NO: 181587 - protein, 198 aa, Triticum aestivum
  unsure (1)..(198): unsure at all Xaa locations
  Clone ID: PAT_TA_76005.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGXAVEGYRVAGGRLGEIVDPLYPGGSFDP

SEQ ID NO: 181588 - protein, 216 aa, Triticum aestivum
  Clone ID: PAT_TA_76006.pep
GKRKVRKVTRCGCDARIIVKRCTDNKYKITSWIEHHNHGFVPPDKCHLIRSNRQLSDKVKPTVSTHCKASTGTSQANKPDHVSEGRSDNVGCTKRDLQKYHHDLCSKIKNEDAQIFVAQLCRKQQEDSAFFFDCDVDDQGMLVHVFWADATSRKNYIYFSDMLTFDCTNTLNQHGMIFAPFTGTNHHLQSVFFGAAFLADEKIESYAWLFQTFLRA

SEQ ID NO: 181589 - protein, 210 aa, Triticum aestivum
  Clone ID: PAT_TA_76007.pep
RHEAKKDKVHINLVVIGHVDSGKSTSTGHLIYKCGGIDKRTIEKFEKEAADMGKASFKYAWVMDKLKSERERGITIDISLWQFETPKYHFTIIDAPGHRDFIKNMITGTSQADCAILMIASPQGEFEAGISKEGQTREHALLAFTLGVKQMIVCCNKMDEKTVNFSEERYLEIKKEVSEFLKKVGYKPDTINFIPISGWNGDNMLDRSTN

SEQ ID NO: 181590 - protein, 241 aa, Triticum aestivum
  Clone ID: PAT_TA_76008.pep
FGTRAPASPCPAPSRPTDPDFLSCVLQPPTPSSSTSRPDPDYAALRRLLLRRKSSSALNHRMEWRCNGKGYVVYRNFLLRRIEAASSSAHSTPSNSGRWFASPTTFSEADSWSSIRDLRSNSGKLSRTLSVSSKHSEPERHVRFAEPAYSFVGMHCIFDNCKASVTVLQFGRTNSDLLAYGSSDGSLTVCQVSEPPSVLQKLTGHSKDITDFDFSSNNQYIASCSMDKTVRVWEISKGTCI

SEQ ID NO: 181591 - protein, 179 aa, Triticum aestivum
  Clone ID: PAT_TA_76009.pep
MAFAPKASSSAPSLSRPMRCGTVASVAVPVPLPGRPVVRAVAAAAVASLEPAVTVPAPALAGRSASLSAAGKRGLSVAEAMSRGRANGKTAFIPYITAGDPDLATTAEALKLLDSLGADVIELGLPFSDPSADGPVIQASAARALAAGATTDAVMSMLKEVTPELSCPVVIFSYFSPIL

SEQ ID NO: 181592 - protein, 187 aa, Triticum aestivum
  unsure (1)..(187): unsure at all Xaa locations
  Clone ID: PAT_TA_76010.pep
MGAEHHSPSSAKTSPRGSGVGGGGEQYSPSTKSPRGGXEAEASTTPRRASPRALAASAVXSSLLPSGGVSSLLXSGAVATLLESRWTLSGAITVFLFLAVTLTVTTSSSSLSPVSASFFSFLPAGRAALVEPPQAQQQPQAPPPPPPGAGVPRLAYLVSGSKGDLDRLWRALHALYHPRNLYVVHLD

SEQ ID NO: 181593 - protein, 72 aa, Triticum aestivum
  Clone ID: PAT_TA_76011.pep
CIHGGLRTAVCGVVWSCSFFFCLSGINPCLSITWLAFGQSCRSSRFLRPFNHSYNESLTDIYGQDLESCSDR

SEQ ID NO: 181594 - protein, 227 aa, Triticum aestivum
  Clone ID: PAT_TA_76012.pep
MSSAAPAPEEQPPRPVRFGIMGCASIARKLARAMLLAAPACAVTAVGSRSEAKARLFAADNGLPAEARLHGSYEALLDDPGVDAVYLPLPTSLHVQWATAAAARGKHVLLEKPTALCAADLDAILAACDASGVQFMDSTMWMHHPRTAKMHELLPADVGDVRVVNSLFSFRANEDFLQNDIKVKPDLDALGALGDAGWYCIRAILWAVDYELPKHVIALSEPVKNQA

SEQ ID NO: 181595 - protein, 250 aa, Triticum aestivum
  Clone ID: PAT_TA_76013.pep
SAIKDMAVALHFQLRVVKSDRSRFIAKCNTEGCPWRVHVAKCHGVPTFTVRTLQGEHTCEGVQDLHHQQATVNWVARSVEARLRDNPQIKPKEILQDIRDQHGVAVSYMQAWRGKERSMAAVHGTLEDGYRLLPAYCDQIGKTNPGSVAVYKGAGPENSFQRLFVSFHASIYGFLNACRPLLEIDKADLKGKYLGTLLCASAVDADHMMFPVAFGVVDSESDENWMWFISELRKMLGVNTDKMPVFTIIS

SEQ ID NO: 181596 - protein, 149 aa, Triticum aestivum
  Clone ID: PAT_TA_76014.pep
MRVNEIRDTRTATTTFTYALVSRPPQGITPPPPPPPPPPPPPAPKPPPKPPNGPAPAPKPPCGPKPAMPPPRGPPLTAPPKSPPSPPLLPAKAVLASPKPAPSWPLRPAARATVSQSSRAGMLLPATATARHSRREAMHHHLLMAASCR

SEQ ID NO: 181597 - protein, 228 aa, Triticum aestivum
  Clone ID: PAT_TA_76015.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQQ

SEQ ID NO: 181598 - protein, 231 aa, Triticum aestivum
  unsure (1)..(231): unsure at all Xaa locations
  Clone ID: PAT_TA_76016.pep
FLGQQQPXFPPQQPYPQPQPFPSQQPYLQLQPFPQPQLPYSQPQPFRPQQPYPQPQPQYSQPQEPISQQQQQQQQQQQILQQILQQQLIPCMDVVLQQHNIAHGRSQVLQQSTYQLLQELCCQHLWQIPEQSQCQAIQNVVHAIILHQQQKQQQQPSSQVSFQQPLQQYPLGQGSFRPSQQNPQDQGSVQPQQLPQFEEIRNLALQTLPAMCNVYIPPYCTIAPFGIFGTN

SEQ ID NO: 181599 - protein, 84 aa, Triticum aestivum
  unsure (1)..(84): unsure at all Xaa locations
  Clone ID: PAT_TA_76017.pep
SPPACSPSCPPCRSTPPPPPPGPPPASXPGQPPLDAVHEPXPASPSPPPPSCVGNLRGRRWYGWMDRWRAALRLGCVYPFQCAR

SEQ ID NO: 181600 - protein, 228 aa, Triticum aestivum
  unsure (1)..(228): unsure at all Xaa locations
  Clone ID: PAT_TA_76018.pep
MISSMSWVPRGAARSAPIQADPPTQEEIDEAMRSIALATENDGSAAADENYGEMEVDGADEEDSEDVARAKAAAEALGKTGSGGGVSDGLEELNMEEYDDEDDVEPELLSTERGDLYYENNEEDPHLVRNNDDDDGDEDEEIEDMAIKPTDMLIVCAHNEDEFNSLQVSIVEELEDGDLNMYVHHEVPLSDFPLCTXWMDFNFKDAKKEGNFIAVGTMDPAIEIWNLD

SEQ ID NO: 181601 - protein, 116 aa, Triticum aestivum; identical to SEQ ID NO: 134375
  Clone ID: PAT_TA_76019.pep

SEQ ID NO: 181602 - protein, 266 aa, Triticum aestivum
  Clone ID: PAT_TA_76020.pep
FGTRLILALLAIVATTTTTAVRVPVPQLQPQNPSQQQPQEQVPLVQQQQFLGQQQQHFPGQQQPFPPQQPYPQPQPFLPQLPYPQPQPFPPQQSYPQPQPQYPQPQQPISQQQAQLQQQQQQQQQQILQQILQQQLIPCRDVVLQQPNIAHASSQVSQQSYQLLQQLCCQQLWQTPEQSRCQAIHNVIHAIILHHQQQQQQQQQQQQQQQQQQQQQQQQQQQQQPSSQVSYQQPQQQYPSGQGSFQPSQQNPQAQGFVQPQQLPQF

SEQ ID NO: 181603 - protein, 239 aa, Triticum aestivum
  Clone ID: PAT_TA_76021.pep
FGTRAKRMGQERRRAPGAGMVVNTCRALEGEFLDVLAAQSASSSDGHTLFAIGPLNPVLPATDAAAAAQAPAERHECLEWLDRQPPLSVLYISFGTTSSLRTEQARELAAALRDTNQRFVWVLRDADRADMRESGGARGLADAAASLLGDAAAQGTGVVVTGWAPQLEILAHVATAAFMSHCGWNSTVEGLSHGKAILAWPMHSDQPWDAELVCKYLGAGVLVRPWEERGQVTPAAAIR

SEQ ID NO: 181604 - protein, 153 aa, Triticum aestivum
  Clone ID: PAT_TA_76022.pep
SARGLSPHASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARARAR

SEQ ID NO: 181605 - protein, 160 aa, Triticum aestivum
  Clone ID: PAT_TA_76023.pep
RPMLQFAKRLAHHGLRPTLAVSRYILATCKPDAAALGAVRLAAVSDGCDAGGFGECNDVTAYLALLEAAGSETLGELLRTEAAEGRPVRAVVYDAFLPWARGVAQRHGAAAVAFFTQPCAVNVVYGHVWCERVGVPVEAGSTVVGLPGLPALEPEGLPWF

SEQ ID NO: 181606 - protein, 107 aa, Triticum aestivum
  Clone ID: PAT_TA_76024.pep
MARAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLSYTI

SEQ ID NO: 181607 - protein, 247 aa, Triticum aestivum
  Clone ID: PAT_TA_76025.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQQLQCAAIHSVVHSIIMQQQQ

SEQ ID NO: 181608 - protein, 81 aa, Triticum aestivum
  Clone ID: PAT_TA_76026.pep
CITVWGDDGIVEAVKTAMERAASAHLNHPSLLFQSFARYPPPPPPPSLDRLRPFSSLIVLGSIHLCFMIHYSLSRIIMYYG

SEQ ID NO: 181609 - protein, 256 aa, Triticum aestivum
  Clone ID: PAT_TA_76027.pep
LFLPRRQQLPLGSSPQSPAHSLLSSFSVTTQFTPDSRSIHLNGWIVIQRPRGAPCSSRSHSLLDPIWIGRGAPVLLLVASLPLSMASSAALVASRPDSSDPASSPSSCRRHNPVIRRPRHALPLLSFSFPSSLSHLCLVAAVCRGQRRRLELLRPAVLRHDWPRHHAAPATTSPTSGALPCRRRQAPREAAPRWPSLHVRRRKFRHRSAPCRPFARRRSSIPAPRSSSVLFEQATSRSIRVDQAKQAPGPVCFFLP

SEQ ID NO: 181610 - protein, 183 aa, Triticum aestivum
  Clone ID: PAT_TA_76028.pep
PRRHPMDEGRGWARMGRTSVFCLKLYSSVFAHHIAGKQEATISVDESVAATLAVDDYPSVLTLEAKSAEIEMVAENKQRQWLGAFLSTVEAKAKNMCVFILGSTLLLIGEPNSPMQKRSGRVRGSLGLRRLTGVGSAGGCGGVGEALCGRSSRLFEGACDAGGGGGGRRRIAVAGEASGASCR

SEQ ID NO: 181611 - protein, 132 aa, Triticum aestivum
  unsure (1)..(132): unsure at all Xaa locations
  Clone ID: PAT_TA_76029.pep
EARQQAVEAMCPGVVSCADILALAARDAVALSGGPSWSPLLGRGNGRVXLASDTTSALPGPGASFDQLRQAFHALGMSVKDLVVLSGGHTLGITHCSSFQGRIHGFRPGADMDPALNPSFTDALSRACPTNN

SEQ ID NO: 181612 - protein, 136 aa, Triticum aestivum; identical to SEQ ID NO: 106789
  Clone ID: PAT_TA_76030.pep

SEQ ID NO: 181613 - protein, 115 aa, Triticum aestivum
  Clone ID: PAT_TA_76031.pep
QKNCCSLVEEVNGSDIPMEPLTTPHGGKLPAMTASSADGQICAAEVVAEATIREPTQASKHSIEQTAQKRSGLGLLSLARHRPNRISAMEKSTRGFAENTGDYVIVPKLGTTFIH

SEQ ID NO: 181614 - protein, 237 aa, Triticum aestivum
  unsure (1)..(237): unsure at all Xaa locations
  Clone ID: PAT_TA_76032.pep
ASGGNFHQLDAFYESVIDSHLKRRASSSADDEEDLVDVLLRLHADPAHRSTFSSRDQIKGILTDMFIAGTDTSAATVEWTMTELVNHPDILAKAQHEVRSVVGDNGMVREPDLPELTYLKLVIKESMRLHPPVPLLVPRETTEPCTVHGCEIPAGTRVLVNAKAIGAHAGAWGADAAQFVPERHEHGEDLGDFKPWHDSFALVPXSGFGRRSCPGVHFATAXLELVLANLLFSFDWS

SEQ ID NO: 181615 - protein, 221 aa, Triticum aestivum
  Clone ID: PAT_TA_76033.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQQQILQQILQQQLIPCRDVVLQQHNIAHASSQVLQQSTYQLLQQLCCQQLLQIPEQSRCQAIHNVIHAIILHHQQQQQQQQQQQQQQ

SEQ ID NO: 181616 - protein, 213 aa, Triticum aestivum
  unsure (1)..(213): unsure at all Xaa locations
  Clone ID: PAT_TA_76034.pep
MAGKIKTVVVVVQENRSFDHMLGWMKSLNPDIDGVTGAETNRVVVADPRSKAIPFRDGSEYVDPDPGHSIQAIYEQVYGTPFVDAQATPITPPGVPAPPMSGFAQQAEREKPGMAETVMSGFRPDAVPVYRELAQEFAVCDRWFASNPASTQPNXRLFVHSATSHGLVSNNTQALIAGLPQTTIFDSLHDAGXSFGVYYQYPPSVLFYRNLRQ

SEQ ID NO: 181617 - protein, 223 aa, Triticum aestivum
  unsure (1)..(223): unsure at all Xaa locations
  Clone ID: PAT_TA_76035.pep
MAASAADDIAELAITSLLLNTRFRPFHLRQYDGFWLLEEFLMDVPAVHSVFEPRPSDVLLXAKCGTTWLKAIVFATRNRAEHPPCDLNHPLXPWQPHDVVRYLEMAFAQSTDDSGAGDAFAALPSPRVVATHLPYSLLPRRITAEESGCRIVYICRNPKDAFVSSWFFAKKGAATVARARARADKDMDMQLQQQPPYTFEEAFELFCDGICVCGPQWRHEMGY

SEQ ID NO: 181618 - protein, 253 aa, Triticum aestivum
  Clone ID: PAT_TA_76036.pep
MRPPLTSVGTAYASCSSPQTLRRPRAAMAWVPPSSRMRHPRSCIPASPRLLTAKMKAGTERGTGSRRHGRKDGRGLAPPQQRQQHSPTTASNQLLLHSLLRLGPSPWRRQRKSSTYQDDDEDDDYYDNLGPEEHRLLRRRRQRELRARRLLASGLEPCAGIGGGCRQVGEGPATAPAAATNLHHGRPGVQLHGRPRSTSGAFVTGWAVLRYHSGKEAAAASSSCSSCPLPIWHIDNSGGRRLQTTEGRRGGRR

SEQ ID NO: 181619 - protein, 195 aa, Triticum aestivum
  Clone ID: PAT_TA_76037.pep
MKTLLIVTILAMATTIATANMQVDPGYQVHWPQQQPFPQPQQPFCQQQQQFPGQQQPFPPQQPYPQPQPFLPQLPYPQPQPFPPQQSYPQPQPQYPQPQQPISQQQAQLQQQQQQQQPSSQVSYQQPQQQYPSGQGSFQPSQQNPQAQGFVQPQQLPQFEEIRNLALQTLPAMCNVYIPPYCSTTIAPFGIMSTN

SEQ ID NO: 181620 - protein, 72 aa, Triticum aestivum
  Clone ID: PAT_TA_76038.pep
ILQTYTTPGNSEKKGTKRDYRRRSRIMQINCHVPNGPLPVPKFGTRSLSYIQNWEVVVCPVPKFGTRCSGIL

SEQ ID NO: 181621 - protein, 249 aa, Triticum aestivum
  Clone ID: PAT_TA_76039.pep
IRHEAHGPYLGTTTFCSLASLLILLMKACVYSPAQDIGPELSPSLADHRLNMKKLWGMPALFLSSLIFALGHFVVAYRTSCRARRKLLIHRIDPESILAYKNAFPGCYKVPRSPTPHSGKLYSRSESETKRKTLVHDDRDIPISFLADSDSMFIACQGITVHYKMSDPSSCISPAPELFPETNHDAVSSSISPRRQRHESPPTASSSTRRLLHRSFSHQYHQTSLYAPLLVEPLISPTVSDGIPFLSLD

SEQ ID NO: 181622 - protein, 223 aa, Triticum aestivum
  Clone ID: PAT_TA_76040.pep
GPDPLRLLRHLFRALKSGSVLSSDLEGVVKPNVTFLQECGLGACDIAKLYVLMPSTLSVSTEHIRTAVACVEGLGVPRGSRMFKHALRAVAFLSEEEITTKIEHLKKTFRWSDAEVGIAVSKAPGVLSKSKESLERRFEFLISEVGLEPAYIAYRPAMLMYSLEGRMRPRYYAVKFLKENGLIDHDRDFFNTVMVSEKVFVEKFICPHKDAAPHLADDYGAAC

SEQ ID NO: 181623 - protein, 87 aa, Triticum aestivum
  Clone ID: PAT_TA_76041.pep
RHEVLKLISPETWEMSSPGASSPSKRSAAELAAHEGTAPSCSGTACLRSSQPGLSSYPPPSSSLSAGLLQCIWKDGLPHFELSLDNP

SEQ ID NO: 181624 - protein, 116 aa, Triticum aestivum; identical to SEQ ID NO: 134375
  Clone ID: PAT_TA_76042.pep

SEQ ID NO: 181625 - protein, 166 aa, Triticum aestivum
  Clone ID: PAT_TA_76043.pep
SARGSAPASPPRAPICPADTACHERPRGSNGGEDGIQGAAAFPVFLIWSLSNPSGPAGVPPVSASICPMPLAHPPRARDRPPSVRSSGDVALRLRWFFVVLSVVRLTGGRLVGNSASVVRVTVCWFHRFRYIRSCSFSSLNLISVFFYFVILCFICEICRYYDSIM

SEQ ID NO: 181626 - protein, 201 aa, Triticum aestivum
  Clone ID: PAT_TA_76044.pep
RPTRIKREGRNPRWTPASKPARSRRRTAGSASSPSAPPPPPLPLPPPPPRHLPRRRRPRGISRSPTWRPPPRPRARARGSTSTPTPARPSPPPPPPSRRSARTPTPRAPIPPRPRLTGTMVTIILLHTSTIWPNLRWKVRQGIVHGEVLCSSRLLCLDTEEHLLDLHLTGTHILLLQLKIRIHIKPTLGSEALMLAEGAAR

SEQ ID NO: 181627 - protein, 138 aa, Triticum aestivum
  unsure (1)..(138): unsure at all Xaa locations
  Clone ID: PAT_TA_76045.pep
RPRPGGGGGSRSGRSCARSSAGRTGTPGAPRPPTRTSTPPPAWPRTAPASPAAAAAGRXRPSPHPPPQHRRAAGPTTPPPPPPRRQVDVAPAPLPPSTMAAAPVSLPLAPRLPAAARARPCVQCSAAQCGCGCGTCAG

SEQ ID NO: 181628 - protein, 136 aa, Triticum aestivum
  Clone ID: PAT_TA_76046.pep
PFFVRKVTAALFNYSQQTGVQYELQVICTVNPVVVEGTSVALFKKNGKYEYSHINFWATPKGSNFSAPGPVLFFAQCSNGDKDEDERPSMCVPVSSSWISDAFRYVFITGMPCTACVLPRCQPVPLLPCDLLLIGF

SEQ ID NO: 181629 - protein, 155 aa, Triticum aestivum; identical to SEQ ID NO: 111377
  Clone ID: PAT_TA_76047.pep

SEQ ID NO: 181630 - protein, 116 aa, Triticum aestivum; identical to SEQ ID NO: 134375
  Clone ID: PAT_TA_76048.pep

SEQ ID NO: 181631 - protein, 108 aa, Triticum aestivum
  Clone ID: PAT_TA_76049.pep
IRHEAMANFVGVNAVAYAALVIATVAATRKPDCAKTQEDFEHSLDAFMESCDCPDDMFSGLEQITHIHLAIAKELQAATNTEEKEVHEEKDTIATPPMSVMVPAFEEK

SEQ ID NO: 181632 - protein, 194 aa, Triticum aestivum
  Clone ID: PAT_TA_76050.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRVGV

SEQ ID NO: 181633 - protein, 201 aa, Triticum aestivum
  Clone ID: PAT_TA_76051.pep
YVGKPHPMAHGKQGHRVSVPDPVTPRAACMDAQLILSKPSMEKHRTRSRNERRRKGRTTHHTIESLRSLPRRWASGLWTRRRLRPLELEFASAGDESTPFMTTTSAPHDSARSTGRRQRLLLISSSHHVVQLWGCCAIPRAHVLATVTLHRSPGTRGRTDGPGAMIKHLASLLAAGGWRLEQRDRRTFTIMGPPTATQLRP

SEQ ID NO: 181634 - protein, 87 aa, Triticum aestivum
  Clone ID: PAT_TA_76052.pep
QTPLRNGESTHPKARKIHPSRIITNQWFFGNCVPAHVLFPHEDSCRCPTSVLAKSLTYACFSAQLVPIPSSKRVPATELTWLPDPPW

SEQ ID NO: 181635 - protein, 134 aa, Triticum aestivum
  Clone ID: PAT_TA_76053.pep
MEPAPQLKAEPWRPPHRAGAAGGRAAGEASSAVTGQSSGSRPRRRQREPPASEDDSASARPVSTSGGGGQDLTDAEAKRFKANKSSDENGSFRKDAEADSRNASKAVDQNPPPPKQDFIHVRARRGQATDSHSL

SEQ ID NO: 181636 - protein, 155 aa, Triticum aestivum
  Clone ID: PAT_TA_76054.pep
MDASATVATGKGKKGAAGRKAGGPRKKSVSRSVKAGLQFPVGRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSPKKTAKSPKKA

SEQ ID NO: 181637 - protein, 108 aa, Triticum aestivum
  Clone ID: PAT_TA_76055.pep
MAYPAAAAAAATASSLSNGLSSIFSPSPPTVKPPKAEPDADQILRKPLRGVLKAFIRQRDPDKLVSMFVQASSASPRFGDRHDLYDAAVSRLTSFGRPDGIQAIIDVQ

SEQ ID NO: 181638 - protein, 174 aa, Triticum aestivum
  Clone ID: PAT_TA_76056.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKH

SEQ ID NO: 181639 - protein, 229 aa, Triticum aestivum
  unsure (1)..(229): unsure at all Xaa locations
  Clone ID: PAT_TA_76057.pep
RHEAQLLLLTVLSARLRASLPLRPSPRQLPRRSPLSTSPTLAVLLRFSPLLLSRSRARPPPSRRSSPRSSPTPSPRLPPSRSSLPKSTPSTCSSPPLSTSSRMSSASRSTSPTSRSFSASSSNFSTSSSVSPRRSXASLVSTTLSAALSSSSSRPSPPSSASSHSSSATSFPVSSTSSPTSSTPFRAPLLDPSSSPSPTSSMASLATSPRALLKRHVQDMRPGYAGYAP

SEQ ID NO: 181640 - protein, 243 aa, Triticum aestivum
  Clone ID: PAT_TA_76058.pep
GKSCNIQGIPWKCEWCGVTLLRATNLGPPSDSCCIENVSEDATCGNMLCQWHNHKMDCGGTYVVTKPRGQRMVRKGGELLLRTGTTEMTKSQGAVQQSDSDEVQKAIVLSAAPRSRRRLKPKQEFVAWENIELLSMGSRSDAKSVGSSSSKKAEDVLSSQLKRKQTSVTSEKHGFLSLGSCDNAKSSGSNTSRKAGKFHEPDDVKPYASQKKLKLVQDLAASEEYGAFFLGTCNSAKPPRSST

SEQ ID NO: 181641 - protein, 172 aa, Triticum aestivum
  Clone ID: PAT_TA_76059.pep
MGDEIVSKSKEPAPDTDTTSCEEASSSTAVKPTRLLAVNGGLVLESSLRPVTGRNSHILKQQKINLLNIEAALPEEAFRASKSQQMRRRSWRSFVKRAESISEMVLATSMLERAIKSEFLKNDCMYWSSFTVAIKTSTLSSLALRIYTLRDCIMYTKEPNIVLATKVVNMGR

SEQ ID NO: 181642 - protein, 119 aa, Triticum aestivum
  Clone ID: PAT_TA_76060.pep
CIQRVYSLGRQARVILGNFIILQEQQQVQGSIQTQQQQPQQLGQCVSQPQQQSQQQLGQQPQQQQLAQGTFLQPHQIAQLEVMTSIALRTLPTMCNVNVSLYRTTTRVPFGVGTGVGGY

SEQ ID NO: 181643 - protein, 216 aa, Triticum aestivum
  Clone ID: PAT_TA_76061.pep
GTAAASPGAWHAIRYNGTLRCGALQRETASSQPRRPARMATSLRRQGRPYTAVGLHASAMSNEIGNAALQIASNAAVHRPLTAKARMLWHACILHWKMRPLHLSGTALGLSSRRAATEERSGLQPVLEFDSMRQRHREQMRMQRRSRATALGSARSLRSRGSPQNDCDTGARPASVMATAQRSSHAWPAATAHDITVRQTTCSGGCAASDSRSAGK

SEQ ID NO: 181644 - protein, 246 aa, Triticum aestivum
  Clone ID: PAT_TA_76062.pep
PYPGCFFCVMKEANPSKRRASVLKFFRELPSQDDDGQVLPISGLWNTAMAHPNDPEFINLGIFECMAALIWKGLKNRRWLSHDQNIYIPYYAAHVIGSYTMNMEEFAERAVRAGVIPPLVELLRGRLTWVEQRVAVRALGHLATYPSTFPAVADHGEVLELAIQLASSSLEIVYSHFYQFVDRRLGYHCDLLTRGMGGAEMESRKAEEWASQLQCWSLQLINCFAFKPEFLHDICKPEFLAKLPGM

SEQ ID NO: 181645 - protein, 230 aa, Triticum aestivum
  Clone ID: PAT_TA_76063.pep
MGSRALAVLCLVAVLLVPALAVPGGGDDGCEAESAGRDKAQALRLKIIAIFCILAGSAIGAGLPSLGRRFPALRPETDLFLAVKAFAGGVILATGMVHILPAAFEALRSPCLVGGPWKRFPFAGLVAMLAAVATLIVDTVATGYFHRTNAKRAAAVTDEPAHDDPESAPDGHAHGMSVLAAPPDGDELVRHRVISQVLELGVVVHSLIIGMSLGASDFPSTVRPLVPALT

SEQ ID NO: 181646 - protein, 64 aa, Triticum aestivum
  unsure (1)..(64): unsure at all Xaa locations
  Clone ID: PAT_TA_76064.pep
MSSSEVACTLAALILHDDGIPITSEKIATVVKAAGIKVEAYWPALFXKLLEKRSVDDLILSVGS

SEQ ID NO: 181647 - protein, 230 aa, Triticum aestivum
  Clone ID: PAT_TA_76065.pep
QPDPPIELVPCFLFLSLAAAAASMYSGDELETEMKRPPSPSTPPSDGVDSAMSTASIEDDDHQAVSDDEEEYEDLEKYQPFTVDDFPRVSSEFDEQSDAVFQNPDIQLRGPSAMFLFRTFNDPLIEKHKHFFGSQYQLYDESEVNVNNNVRAIDCSHGCHCVPSGVLQFIDLKIAGYRHVQPGCANIFGFFAVRENAEPLRNYVYRRGIDNYEAVNVKRDTDHSSKLGVC

SEQ ID NO: 181648 - protein, 233 aa, Triticum aestivum
  unsure (1)..(233): unsure at all Xaa locations
  Clone ID: PAT_TA_76066.pep
SARGANLLEFDVYDLXELTTVPTNSHLRRLLVSTTPKSVVVVEDIDCSLDLSDRKKNSGGADEDNTQLAMLSPAAAAAMAAIGRESISLSGVLNFVDGLWSSCVGERLMIFTTNHPERLDPALLRPGRMDRKIELGYCTPAALRVLAKNYIGVGEDPEDEPDAVVDGLMAEAEGLLAADVRITPADIGEVFMGCDGAGASAALKRLVGELRGRRDAPAADTVQSGAMTEEKME

SEQ ID NO: 181649 - protein, 223 aa, Triticum aestivum
  Clone ID: PAT_TA_76067.pep
FTYRDILAATGNFSDDRVIGRGGSGVVYRGALPDGRAVAVKKLSRPRDGVDGDGEREFRAEMEVLADRMGFTWPHPNLVTLYGWCLSGGAKILVYERLDGGSLEALICDTAAFGRAARLDAAVGVARALAFLHHECVPAVVHRDVKASNVLLDGDWRAKVTDFGLARVVRPGDTHVSTVVAGTVGYVAPEYAQTWRATTKGDVYSYGVLLMELATGRRAVDGG

SEQ ID NO: 181650 - protein, 251 aa, Triticum aestivum
  Clone ID: PAT_TA_76068.pep
MRNTPLGLLLLVCVAVLHADASQEARLRRFIRSRRSSSNANNIDEPRVGITTTTRSPTEYYVHDLANLKAADKIHVLPGQPSGTIGLNQYGGYVTVHEKNGRALFYYFVEAASDAAAKPLLLWLNGGPGCSSLGYGAMMEVGPFRVNKDNRTLSENLHTWTKVANVLFLESPVGVGFSYSNTTSEYDSSGDKRTANDAFVFLLNWLKRFPEYKGRPFYISGESYAGHYVPQLAATILIHNLNSSTRTSINL

SEQ ID NO: 181651 - protein, 98 aa, Triticum aestivum
  Clone ID: PAT_TA_76069.pep
HLHFSDSVLREEPCCKTHLITTFPGDHWMRGRDLAVSHVIGTAKGVLIIAVFHTIHFVIIQEKDAITRQPILRHRDSPGAPSPKKQNLVIPHSCHLHP

SEQ ID NO: 181652 - protein, 126 aa, Triticum aestivum
  Clone ID: PAT_TA_76070.pep
MRWDWETPATEAEAEALQERIWDLHDKLSHAILALSACAGLPACRCRGAPNGHVILKGQRPPQGGGHVDLAAAAAAMADARGLHAIRTALEDLEGHLHFLRDVQSQQRADRDAAIARVQQSRILLA

SEQ ID NO: 181653 - protein, 117 aa, Triticum aestivum
  Clone ID: PAT_TA_76071.pep
MPGLAALAARPSSRPWPSPLACLAAAPLAVPMAAPMVASPWPRARPRRARRGRPALCPRPGRVHPSDAAVDHEKDSIELLLARRCIERNGPFLGICRGSQVLNVACGGSLYQDVGHG

SEQ ID NO: 181654 - protein, 83 aa, Triticum aestivum
  Clone ID: PAT_TA_76072.pep
YKMRATHVLLLVLALFMLSPDLAKAKLHCTDFIIVNQCDVDEITCQHYCYSQFNGTGKCIPNKGCQCHFCYATPPQPSPASSS

SEQ ID NO: 181655 - protein, 241 aa, Triticum aestivum
  unsure (1)..(241): unsure at all Xaa locations
  Clone ID: PAT_TA_76073.pep
MVVMSAVAGELVSRFISFLLNKYHSSRSHSEEKVMERLQHLLMRVCTIVXEADVRYITNSGMMMQLKTLSEAMYQGYHALDNLRYRALQVTAGFEEVSINDSSGSSLYLAKRSRSTNDKVTRLESHGALESLEIAIANMSEFIVLLGGCERMSRRPYDVYLYTENFMFGRHIEKQKLWSFLLQHNSPGDDAPAVLPIIGGAAIKKKTLVAHAXGDERVRSRFSSILHLNGDNLLRRPDHGM

SEQ ID NO: 181656 - protein, 253 aa, Triticum aestivum
  unsure (1)..(253): unsure at all Xaa locations
  Clone ID: PAT_TA_76074.pep
QQPQEQVPXVQQQQFLGQQQQHFPGQQQPFPPQQPYPQPQPFLPQLPYPQPQPFPPQQSYPQPQPQYPQPQQPISQQQVQQQQQQQQQQILQQILQQQLIPCRDVVLQQPNIAHASSQVSQQSYQLLQQLCCQQLWQTPEQSRCQAIHNVIHAIILHHQQQQQQQQQQQQQQQQQQQQQQQQQQXQQPSSQVSYQQPQQQYPSGQGSFQPSQQNPQAQGFVQPQQLPQFEEIRNLALQTLPAMCNVYIPPYCS

SEQ ID NO: 181657 - protein, 114 aa, Triticum aestivum
  unsure (1)..(114): unsure at all Xaa locations
  Clone ID: PAT_TA_76075.pep
EGGALRPGGGAPLRLPRAARHRLSQGPTIFDPPHPPFSCSRIRRXAPVAPPPVFAAAVPPPSPPAGRAGAVPAPLLLAAGGQPEVPPLDLNSPAPSEPEPGVVPVSPRRSPRIM

SEQ ID NO: 181658 - protein, 112 aa, Triticum aestivum
  Clone ID: PAT_TA_76076.pep
VATPVLAAGARRVRGRGWRWELPGAWGIGRRCGGLPRRDPRPARGCTRPRRHRRRRSTNRAPGVMACMRGHAMLASFHQSISPAYSRVLRGYALQDKEQLAAVYHSTSASVK

SEQ ID NO: 181659 - protein, 116 aa, Triticum aestivum; identical to SEQ ID NO: 134375
  Clone ID: PAT_TA_76077.pep

SEQ ID NO: 181660 - protein, 90 aa, Triticum aestivum
  Clone ID: PAT_TA_76078.pep
TCKRDIVCHASLSLSCSPSIIPSLDRVWLGLIIYLFFCLLLNRLCKPTRGILSYDQHIQHTGSPRRVETLHLVLQRGVVRLRSMKQPTEF

SEQ ID NO: 181661 - protein, 214 aa, Triticum aestivum
  Clone ID: PAT_TA_76079.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRLLACISSRPGQCGRADGYILEGKELEFYMRK

SEQ ID NO: 181662 - protein, 67 aa, Triticum aestivum
  Clone ID: PAT_TA_76080.pep
SARGSSSRVGWPGLGTNSTGNRGQCHKEADASKSLEMSAEMNVSCISDQTSSPPVPNLEFTLGRTHH

SEQ ID NO: 181663 - protein, 41 aa, Triticum aestivum
  Clone ID: PAT_TA_76081.pep
HEGDKPDAQIEVIPVDAWVTQDFRPDRVRVVIAVARTPTVG

SEQ ID NO: 181664 - protein, 116 aa, Triticum aestivum; identical to SEQ ID NO: 134375
  Clone ID: PAT_TA_76082.pep

SEQ ID NO: 181665 - protein, 118 aa, Triticum aestivum
  Clone ID: PAT_TA_76083.pep
LASHSPRHMPGTTQFLCLVVALLVSLSCNAKHTDPDTYRESMWESKRQVHDFGGHNCQNTCVRKSIDTDIYCEYMWECNKPVHDHDQRKCRNFCVSMGYDYLRSYCEHHPYPYCCCHK

SEQ ID NO: 181666 - protein, 137 aa, Triticum aestivum
  Clone ID: PAT_TA_76084.pep
LPSLATTHSQGGCLAAAATAGAAPAASAATAAAGARCSPTWRPPPARPPWSCPPPPTRGAPAGSRWPAGRPAAATAPRASAAPRAAAPAAAATEPAPRRPAGRGEHEDEEEKQAIIITITTTQRISTTSRRMRSRAR

SEQ ID NO: 181667 - protein, 222 aa, Triticum aestivum
  Clone ID: PAT_TA_76085.pep
MKTLLIVTILAMATTIATANMQVDPGYQVHWPQQQPFPQPQQPFCQQPQQTIPQPHQTFHHQPQQTFPQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIH

SEQ ID NO: 181668 - protein, 253 aa, Triticum aestivum
  Clone ID: PAT_TA_76086.pep
SARGRVTSPQQSFSHQQQPFPQQPYPQQPYPSQQPYPSQQPFPTPQQQFPQQSQQPFTQPQQPTPLQPQQPFPQQPQQPQQPFPQPQQPFPWQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLFQLVQGQGIIQPQQPAQL

SEQ ID NO: 181669 - protein, 215 aa, Triticum aestivum
  Clone ID: PAT_TA_76087.pep
MDWYEWLRRAGLGEDLAAEYALLFARNELGAADVRHLDHAFLATMGVAVAKHRLEILKLARKESSASAAITVLPWRATRLLAAAAQRSARSLAGCLRSAARRGRSKAAVAPRPLALCHQGVAGPARWKGAPTAADGREVTKRKLAALLTRVGKPMHTLTNSAQKPTTKKGAVASPTTYMATAIVAGCFASTETCDSDYDADDDEDEDAEMGDGGG

SEQ ID NO: 181670 - protein, 224 aa, Triticum aestivum
  Clone ID: PAT_TA_76088.pep
MKTLFILTILAMATTIATANMQVDPSGQVQWPHQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLFQLVQGQGIIQPQQPAQLEVIRSLVLRTLPTMCNVYVSPDCSTINAPFASIVVGIGGQ

SEQ ID NO: 181671 - protein, 251 aa, Triticum aestivum
  Clone ID: PAT_TA_76089.pep
SARGFPPRHPSPWRRALAALQDPSPRQLRDNRARLSDRHCHWILQSLGQAVHIIAPDGKLLYWNRYAEHMYGYSASEAIGQDAIELIVHPTDFDAANVVIQNIFMGKCFRGKFPVKNKSGERFFIVVHNTPLYDDDGSLIGLICVSLDVRTLQEIFSPSTTEKSCQSSSKPHFHVNNWPKSGSQNKGSFDSQQPLQSASTSKITTFATKLTSRVRSRIRTGQNCERRCASGCEDQYSEHDVRADLTSSEAS

SEQ ID NO: 181672 - protein, 238 aa, Triticum aestivum
  Clone ID: PAT_TA_76090.pep
FGTRPRHTSPHTSPPTGMRLLDAGLAHNGTISSFIEIQNQFIGPNITHAIEACQLFYIPAILQEGWALYIWDMLSRIIHIIDPGAGPRGCNADQKDRHELIASRLHDALFLRLNDYFAGWPTPKENWTTKYPLLMQNPVTREESGLCVMHIIRYHDGEKARNALTKNTLAVTRLCAIQETMKLQGNQSSLPADALWVASRSFRKTSSTITLSRWSTTAEWLWTVVTKMHWLLPTAALF

SEQ ID NO: 181673 - protein, 142 aa, Triticum aestivum
  Clone ID: PAT_TA_76091.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGGYGGQRGGGGGYGGGGGYGGGGGYGGGGGYGGQRGGGGGDSGGQWRN

SEQ ID NO: 181674 - protein, 188 aa, Triticum aestivum
  unsure (1)..(188): unsure at all Xaa locations
  Clone ID: PAT_TA_76092.pep
MRPPSPPRPLAFPTLDSLAAYLRPRLPGPALASWGSAPGTKNLLNLFLELSCGGCTLLPAASSPPALVVRAVHVATVRIRNRRGALLVETRQLLSDGTLRRRAARPLSEKMRPGETPEAAAARAVVEELGERARVRIVGAVPEPRVEXERESVSYPGLPARYVLHAVDAELVEGVLEEGEFDTEEGGE

SEQ ID NO: 181675 - protein, 127 aa, Triticum aestivum
  Clone ID: PAT_TA_76093.pep
GNCVDTLEEAEGSSWMTRSIATVGKTKARRVQSRPAGGTRILVTSSTAAPRGPRASGTITILYSRNQRPQDSGLMSRASDLDGDIGRRGHRGDRGLEGESITWIGHASFCASYEDGAYASFSTWLAS

SEQ ID NO: 181676 - protein, 245 aa, Triticum aestivum
  Clone ID: PAT_TA_76094.pep
RVGSIKVSAEYVTNVKFIARKGWFVPVSCDRVVHVYNYEKEMQKVTSFRAHDCHQPYCSLAVHPTQSYVLSGCDTQIKLWDWEQDWNCVQIFEEHSSAIIALKFNPEDTNSFASASNDNTVWSLDCPQSKYTLHGHSVAVLSLDFFTHDGQQYLISGSNDKTAKVWDMQKKCVRTLTHEAAVNSVVSHPSLPVLMTGTDNGAVHVWSSTNFRLKAIFKLGIAESVCGLVHLMGSGRVAVVHETGV

SEQ ID NO: 181677 - protein, 130 aa, Triticum aestivum
  unsure (1)..(130): unsure at all Xaa locations
  Clone ID: PAT_TA_76095.pep
SARGPVLLQQQIPFVHPSILQQLNPCKVFLQQQCSPVAMPQSLARSQMLQQSSCHVMQQQCCQQLPQIPQQSRYEAIRAIVYSIILXKNXQQVQGSIQTQQQQPQQLGQCVSQPQQQSQQQLGQQPQQQQ

SEQ ID NO: 181678 - protein, 198 aa, Triticum aestivum
  Clone ID: PAT_TA_76096.pep
FFFFFFFLKLGVFGIDKDNSLEFCWAISGHRSLESLTVHSALNLPSIKEVVHLCVLVSPMFIIVIKVNMAEEEALDDPSSSAAVTVLYRACEPLPVTVLGAEEAHSCSGRSCPRPACSSAPWPPPAPRGTAAPPPASPPWPPCATTWKRPTVSAASLRAAAGEVDDGDGDAVRHGVRGEGVGVVVEDWRRGRSSCRRR

SEQ ID NO: 181679 - protein, 117 aa, Triticum aestivum
  Clone ID: PAT_TA_76097.pep
FFFFFFRCNPSSLRTRNSLFHLFQGSLDCLSFPFITRYQHALPREHLRLRAMESFSDDSPRGLGRWMRTIQISDRRAARCHPIHATTMVLNVAIRSATSRQWQEGLYAYAHKQIALI

SEQ ID NO: 181680 - protein, 75 aa, Triticum aestivum
  Clone ID: PAT_TA_76098.pep
SPAGRAAPGEAGEGIRGAPRRSGRCGEAGGGRRRSACGRCRRRRVGARSWLACWIPFPRESGPGLVAIGLSTSCR

SEQ ID NO: 181681 - protein, 222 aa, Triticum aestivum
  Clone ID: PAT_TA_76099.pep
RHEAKPFCQQPQRTIPQPHQTFHHQPQQTFPQPQQTYPHQPQQQFPQTQQPQQPFPQPQQTFPQQPQLPFPQQPQQPFPQPQQPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVTILRPLYQLAQGLGIIQPQQP

SEQ ID NO: 181682 - protein, 231 aa, Triticum aestivum
  Clone ID: PAT_TA_76100.pep
TGDTGETLVAAGSRPPPAPPPIAAAGGPAGEAAPRPGMAATGRFCPSPRAGPPSPSPRTSPSPSLLRVAAAGGPAGEAAPRLRLWAAGWLRPLRAGAPLPQPPRHPRSDLPSRPPLQLLCSSCRSDAAVRPCSVLGHARARVEVAGLAKAQSCPLVDHPSSPTAPPPSYDVDLCACVVKVLFGSGLKLRGGSLPASLWSRRPRTSVLQHPWPVGVPYWCDLGPGAPDAVSP

SEQ ID NO: 181683 - protein, 216 aa, Triticum aestivum
  Clone ID: PAT_TA_76101.pep
MKTLLIVTILAMATTIATANMQVDPGYQVHWPQQQPFPQPQQPFCQQPQQTIPQPHQTFHHQPQQTFPQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQL

SEQ ID NO: 181684 - protein, 47 aa, Triticum aestivum
  Clone ID: PAT_TA_76102.pep
HLWTRHALLCQARVLSVHLGRDNNSFELLEDLPLVSPHLTRMELCNV

SEQ ID NO: 181685 - protein, 111 aa, Triticum aestivum
  Clone ID: PAT_TA_76103.pep
MDDQQLLLGISRSDMLARIERCGRDPAMLDLGSNMLLHFAYEYLPDPPVSPTAPLSLAGASWVPDGVDRISRLPDVLLRDIISRLPAKDAARTPALTSRWCPLWRSAPLAL

SEQ ID NO: 181686 - protein, 185 aa, Triticum aestivum
  Clone ID: PAT_TA_76104.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQQKQLVQGTSTQPQQQQQQGQQEHGQGSSQPQHQQQQQQLDQGWIVAIGTWVIQTVPAMCDVHVPPY

SEQ ID NO: 181687 - protein, 219 aa, Triticum aestivum
  Clone ID: PAT_TA_76105.pep
LPQQPYPQPEPQYPQPQQPISQQQQQQQQQQQQILQQILQQQLIPCRDVILQQHNIAHASSQVLQQSTYQLLQQLCCQQLWQIPEQSRCQAIQNVVHAIILHQQQQRQQQQQQQQQQQQQQQQQQQQQQQQQQQQQQQQQQPSSQVSFQQPQQQYPSGQGSFQPSQQNPQAQSSVQHQQLPQFEEIRNLALQTLPAVCNVYIPPYCSTTIAPFGIFGTN

SEQ ID NO: 181688 - protein, 234 aa, Triticum aestivum
  Clone ID: PAT_TA_76106.pep
MAALMLLRATRRRDLASPLATLTTNVQSTYAAANVCSRWATFARAFSAKPIGNEVIGIDLGTTNSCVAVMEGKNAKVIENSEGARTTPSVVAFSPKGELLVGIPAKRQAVTNPQNTFFGTKRMIGRRFDDPQTQKEMNMVPYKIVKAPNGDAWVETTDGKQYSPSQIGGFVLTKMKETAESYLGKSISKAVITVPAYFNDAQRQATKDAGRIAGLDVQRIINEPTAAALSYGTN

SEQ ID NO: 181689 - protein, 248 aa, Triticum aestivum
  unsure (1)..(248): unsure at all Xaa locations
  Clone ID: PAT_TA_76107.pep
RRACTMLTCQLPLLFTSFLLMSLGAGGIRPCALAFGADQLDKRDNSTKNVRRLQTFFNWYYTVLGISLVVAVLVIVYIQDHMGWVVGFSVPVVLMLAALMLFLAGSPLYLKAEADRSVLVGIVQVLVASYKNRGELLPPETAEASCFHNKAGSRPRVPTKKMVSMNRACVLRNPSKELNSDGSACDPWRLCTVQQVEDAKAVIRVLPIWSTGIXPGVIVAQVMFPVLQAGTMDRQMGKANIPAASYSV

SEQ ID NO: 181690 - protein, 221 aa, Triticum aestivum
  unsure (1)..(221): unsure at all Xaa locations
  Clone ID: PAT_TA_76108.pep
KYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIXPGMVVTFGPTGLTTEVKSVEMHHESLLEALPGDNVGFNVKNVA

SEQ ID NO: 181691 - protein, 180 aa, Triticum aestivum
  Clone ID: PAT_TA_76109.pep
SSTTRCTQTMADHGKERRAEDQLPPSSTGRHQLLAMARGQGLGPSRPGAWAAAILAPWPGPPPAELHGHGLRSPREREREIGRAARELVGRREVAAATHAGRELRGGAHRTGDGRDLRSGAMASGRRALYVGCWPAGHGDGRAPLDLEHGRARTEEQGPDCFFHKTFRDPIAFLKNLQKY

SEQ ID NO: 181692 - protein, 106 aa, Triticum aestivum
  Clone ID: PAT_TA_76110.pep
RHEESRCQAIHNVVHAIILHHHQQQQQQPSSQVSYQQPQEQYPSGQGSFQSSQQNPQAQGSVQPQQLPQFQEIRNLTLQTLPAMCNVYIPPYCSTTIAPFGIFGTN

SEQ ID NO: 181693 - protein, 119 aa, Triticum aestivum
  Clone ID: PAT_TA_76111.pep
MKSSLLLGKKQREEKRENCPRFGFYMMFGSFSIAGFHISLDHTVTAKVFSNCKQPSSETATLLTASSQPDDPILSLLPHPQLELDKHLKHQLITPDPWKLLPLLGGRISCTGRLFCLVP

SEQ ID NO: 181694 - protein, 62 aa, Triticum aestivum
  Clone ID: PAT_TA_76112.pep
MDRAVGNQAGQVSKKGKKKHAKDESDRQKQAEKKRRRLEKALANSAAIISELEKKRQQKQEE

SEQ ID NO: 181695 - protein, 156 aa, Triticum aestivum
  Clone ID: PAT_TA_76113.pep
MAQAERECMRVVMFPWLAHGHINPYLELAKRLVAASPDDHHLDVVVHLVSTPANLAPLAHHQTDRIKLVELHLPALPGLPPALHTTKGLPAHLMPALKRACDLAAPRFGALLDQLCPDIVVYDFLQPWAPLEAAARGVPKKKKKKKKKKKKKKKKK

SEQ ID NO: 181696 - protein, 230 aa, Triticum aestivum
  Clone ID: PAT_TA_76114.pep
SARGYEPILPQQPPFSQQQQLVLPQQPPFSQQQQPVLPPQQSPFPQQQQQHQQLVQQQIPVVQPSILQQLNPCKVFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFGVGTGVGAY

SEQ ID NO: 181697 - protein, 227 aa, Triticum aestivum
  Clone ID: PAT_TA_76115.pep
SARGYGFGTGLPVIAALYLAYSPLGRKQARDPDAEPSSSGEEANGHGGAPENGGRDVEIRIYNRSVVVSRPEWSGGLCDCCDDGTVCALSATCTFCVFGWNMERLGFGNMYVHAFTFILLCVAPLLIFSVTALNVYDDDIRDTVVAVGVLLCFCGFLYGGYWRTQMRKRYKLPAGGGGRRAAVGDCAKWLFCWSCALAQEVRTANFYDFDDDRFVGHGARNEEGRAV

SEQ ID NO: 181698 - protein, 201 aa, Triticum aestivum
  Clone ID: PAT_TA_76116.pep
SCYMETFDEFSRTISPIELIDTSALNVANQHGSQEILTQESSITICSSEESRDDSIAFAADEITSGEQRCNKGVLALGKFLPQKHSSPAVECKEVKPKNTPDNNPFKKRKLPTDQGKVPDQNELLIDLDEEAVVLCSSLSRESVGPAESLDRNGVSAGLCWPLTQESVASIPNERSSKRQSQQEAFRNKTNKNKDERSGLL

SEQ ID NO: 181699 - protein, 169 aa, Triticum aestivum
  unsure (1)..(169): unsure at all Xaa locations
  Clone ID: PAT_TA_76117.pep
DVAMNSEALTGRIAGIHRTPPRGPRPPDLRFRVTSCGRYSPIPSPEEEEVVDAEGERRLLLLXAAADGGHAGGPGGGGGXAEDAAARVGAARGTFMGEMGGRAENRRRGRGAKWQASSEMGAGGEPAPDGAMPRARGRGQPRGRKVAGAGWEARGGRSWRFFRMGPRAE

SEQ ID NO: 181700 - protein, 181 aa, Triticum aestivum
  Clone ID: PAT_TA_76118.pep
MKTLLIVTILAMATTIATANMQVDPGYQVHWPQQQPFPQPQQPFCQQPQQTIPQPHQTFHHQPQQTFPQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNP

SEQ ID NO: 181701 - protein, 197 aa, Triticum aestivum
  Clone ID: PAT_TA_76119.pep
GTRGIPEVATSDGIPEVVVQQESRPAVTPDVVTPIVPPAVIFGGLHNPVVLSSSSTPAKAVAKEGHVPVCALFSKVKTKDSIAAVHPKVFLLQSLNVISLMSILSCCFQMALLRIVMRKMLLMLLGFLLLLSLIVLLVFSLLLMSAITPQFMLMENLLWKIQILLETCHPLFQFACRSISVMSWVMSSVLSMLPTDI

SEQ ID NO: 181702 - protein, 227 aa, Triticum aestivum
  Clone ID: PAT_TA_76120.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQ

SEQ ID NO: 181703 - protein, 210 aa, Triticum aestivum
  Clone ID: PAT_TA_76121.pep
GTRPGYYSTSPQQLGQGQPRYYPTSPQQPGQEQQPRQLQQPEQGQQGQQPEQGQQGQQQRQGEQGQQPGQGQQGQQPGQGQPGYYPTSPQQSGQGQPGYYPTSPQQSGQLQQPAQGQQPGQEQQGQQPGQGQQPGQGQPGYYPTSPQQSGQEQQLEQWQQSGQGQPGHYPTSPLQPGQGQPGYYPTSPQQIGQGQQPGQLQQPTQGQQGQ

SEQ ID NO: 181704 - protein, 36 aa, Triticum aestivum
  Clone ID: PAT_TA_76122.pep
LLRRSELQSIQERAPINPGASQLASSSAVASSNRSS

SEQ ID NO: 181705 - protein, 111 aa, Triticum aestivum
  Clone ID: PAT_TA_76123.pep
SARGFLGALGPARPSAALQLPEAGDEPEPPAGPAKLGVAVEDAAALPSPPDEQRAERVALRVGENLFNFMQSFCAADGGKLVVPTDILDRWFRKFQERAKKDPTYLKSFDF

SEQ ID NO: 181706 - protein, 99 aa, Triticum aestivum
  Clone ID: PAT_TA_76124.pep
MVPSGYDCAASVLLCAEDNAAILGLDDDEEDCSWAAAAATPPRIAADAAAAAEGFLVDHPVQSDECVAALVETEKEHMPADGYPQMLLRRPGALDLAAV

SEQ ID NO: 181707 - protein, 169 aa, Triticum aestivum
  Clone ID: PAT_TA_76125.pep
SARGLVEALLQRGEAKLLTEDWEGAVEDLKEAAQKSPQDMAIREALMKAERQLKLSKRKDWYKILGISKTASAADIKRAYKRLALQWHPDKNVENREEAENMFREIASAYEVLSDEDKRVRYDRGEDLEEMGMGGGGGGFDPFGGGGGQQYTFHHGGGFPGGGFQFNFG

SEQ ID NO: 181708 - protein, 136 aa, Triticum aestivum
  Clone ID: PAT_TA_76126.pep
SAALDVGTYVCGVGGSSYCVVLTPHVRRGRWWHQILPRLACRYSRQVARFMVRNPLSSPLRPHDTGQPPRLRHDGHQQRRTRRHVEEGRLHHLPLRWIIHLGPQEVGVAAIPGDSGLEQVEDDLGWRDGRPKGPCG

SEQ ID NO: 181709 - protein, 116 aa, Triticum aestivum; identical to SEQ ID NO: 134375
  Clone ID: PAT_TA_76127.pep

SEQ ID NO: 181710 - protein, 114 aa, Triticum aestivum
  Clone ID: PAT_TA_76128.pep
GTRAIIMHQQEQQQQLQQQQQQQLQQQQQQQQQQQQPSSQVSFQQPQQQYPSSQVSFQPSQLNPQAQGSVQPQQLPQFAEIRNLALQTLPAMCNVYIPPHCSTTIAPFGIFGTN

SEQ ID NO: 181711 - protein, 262 aa, Triticum aestivum
  Clone ID: PAT_TA_76129.pep
GTRPQQAFPQPQQTFPHQPQQQFPQPQQPQQPFPQQPQQQFPQPQQPQQPFPQQPQQQFPQPQQPQQPFPQPQQPQLPFPQQPQQPFPQPQQPQQPFPQLQQPQQPLPQPQQPQQPFPQQQQPLIQPYLQQQMNPCKNYLLQQCNPVSLVSSLVSMILPRSDCKVMRQQCCQQLAQIPQQLQCAAIHGVVHSIIMQQEQQQQQQQQQGIQIMRPLFQLVQGQGIIQPQQPAQLEVIRSLVLGTLPTMCNVFVPPECSTTKAP

SEQ ID NO: 181712 - protein, 220 aa, Triticum aestivum
  Clone ID: PAT_TA_76130.pep
MKTFLILALVATTATTAVRVPVPQLQPKNPSQQQPQEQVPLVQQQQFPGQQQQFPPQQPYPQPQPFPSQQPYLQLQPFPQPQPFLPQLPYPQPQSFPPQQPYPQQRPKYLQPQQPISQQQAQQQQQQQQQQQQQQQQILQQILQQQLIPCRDVVLQQHNIAHASSQVLQQSTYQLLQQLCCQQLLQIPEQSRCQAIHNVVHAIIMHQQEQQQQLQQQQQQ

SEQ ID NO: 181713 - protein, 263 aa, Triticum aestivum
  Clone ID: PAT_TA_76131.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYQQQQPQYLQPQQPISQQQAQQQQQQQQQQQQQQILQQILQQQLIPCRDVVLQQHNIAHASSQVLQQSTYQLLQQLCCQQLLQIPEQSRCQAIHNVAHAIIMHQQQQQQQEQQQQLQQQQQQQLQQQRQQPSSQVSFQQPQQQYPSSQVSFQPSQLNPQ

SEQ ID NO: 181714 - protein, 174 aa, Triticum aestivum
  Clone ID: PAT_TA_76132.pep
RHEGPSSLVPPPAPSPCAAAPSASGAGHPAYGMHLTGPRRRFHCPRWPGWASETSRRAPTVPDRRRPPLSGHIIHLPPRRRQLHMRGTARRGRRGDLGSVLLIRDATGRWALACPPRPQGVRRIARPRPRREPTGVSALMNTCDSANHVYLLLVLSCIYQGREFQKLESGRLFQ

SEQ ID NO: 181715 - protein, 210 aa, Triticum aestivum
  Clone ID: PAT_TA_76133.pep
MQIFVKTLTGKTITLEVESSDTTDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLAD

SEQ ID NO: 181716 - protein, 184 aa, Triticum aestivum
  Clone ID: PAT_TA_76134.pep
FGRGRDENLISEILPERSLSQLSRFVLTNAIYFKGVWETRFPENLTEKHEFHRLGDADPVDVPFMTPPGECKLFVSHGKGFKVLKLPYKVATPAAMSSRYSMCVFLPDDNDGLHAMVTALAEAGGSLLDHVPKHRSSVRKLMLPKFKMSFFCRLTKVLQGLGLRDAFSESADLSGLATKIDCDV

SEQ ID NO: 181717 - protein, 219 aa, Triticum aestivum; identical to SEQ ID NO: 134364
  unsure (1)..(219): unsure at all Xaa locations
  Clone ID: PAT_TA_76135.pep

SEQ ID NO: 181718 - protein, 131 aa, Triticum aestivum
  Clone ID: PAT_TA_76136.pep
MVFAAAEGGRGGTEWSPVRRRSSKKMAGRKGGERKKAVTRSVKSGLQFPVGRIGRYLKKGRYAQRVGSGAPVYLAAVLEYLAAEVLELAGNAAKDNKKTRIIPRHLLLAVRNDQKLGRLLAGVTIAHGGVI

SEQ ID NO: 181719 - protein, 229 aa, Triticum aestivum
  unsure (1)..(229): unsure at all Xaa locations
  Clone ID: PAT_TA_76137.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQXPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQQL

SEQ ID NO: 181720 - protein, 77 aa, Triticum aestivum
  Clone ID: PAT_TA_76138.pep
NGGSWEDRVPTTIEVVDPKLSVQYVCEWHVYLPTLLHFLHYVGEFVDLVLCSESSRAIEYESPHQDRRGPGPPLRAR

SEQ ID NO: 181721 - protein, 185 aa, Triticum aestivum
  Clone ID: PAT_TA_76139.pep
DKPNRKKTKEWGAGVWPHPVGLGPLGGEVDRLGCGCRPRRGRPRRGQRAWFLRCRENRGSSPCLTGGSYDAGTRSTKTFEAEAMQMRSGRGAGLQDGGSGPKRLGRRLATQEDEDGGVLEAAVGLKELGEGPRQQMPQPRGWKQAPAACAGRRGGACSGGNEVEATNSSGGAGMALAEEAWFPSR

SEQ ID NO: 181722 - protein, 271 aa, Triticum aestivum
  Clone ID: PAT_TA_76140.pep
FGTRHAVESLALHIKGTRPPKLVVRTVRGRRAVEELVARMAHRRRRELAALADRHAVSRFGHKGRIQSMLRLKLLRHGDAINDEVWNLLRPVRPHPPKCRPEASRDDSSKTDSQDANECSLQNNRADEQHSDDRNPSAEKSIGLAIESLVNSDGSGNRQYDEKIDTKGNQCQEDRVNLVNSCVHYQESSKASNFARYDDHRVVYDNQYMDDISPSTISTSCELQETPSSRGETLREEDNQSLNGSWDERALWMSSLGWPAPVDSMSPDSWH

SEQ ID NO: 181723 - protein, 86 aa, Triticum aestivum
  Clone ID: PAT_TA_76141.pep
LPNPSDLGFLPASPRANVERRRRLQARGVGGAHCHRLPRCALAPLSHRRLCLLLLHHPQGLPPPQLAPTPQALLLPSPAAPAGSRG

SEQ ID NO: 181724 - protein, 146 aa, Triticum aestivum
  Clone ID: PAT_TA_76142.pep
RPAFAFECHRCTNLPPAVQPGRQRRDPRWQIRLRQQHGHLQGLEMFGAVPPHLPPFRKRFAEPVILPVCRHHRRWGWGQPVLPAFPSVSAGSPWPAHPEINVLTSTAAPWTVRRDCTACISALFSSSLSSSLFLLLLLLALLPTLG

SEQ ID NO: 181725 - protein, 223 aa, Triticum aestivum
  Clone ID: PAT_TA_76143.pep
MATAMDAGVLHPGAIVVTVVALASAYMVWFWALSRRLSGPPMWPLVGSLPSVVVNRKRVHDWIADNLRATGEAATYQTCILPLPFLARRQGLVTVTCNPRNLEHILRARFDNYPKGPMWQAAFHDLLGQGIFNSDGETWLLQRKTAALEFTTRTLRQAMARWANRSIKDRLWRILADHCHAAASVDLQDLLLRLTFDNICGLTFGKDPETLSPGLTENPFANA

SEQ ID NO: 181726 - protein, 201 aa, Triticum aestivum
  unsure (1)..(201): unsure at all Xaa locations
  Clone ID: PAT_TA_76144.pep
ACRRRRRRATRGSASASASGGGGGGRGGSDSARGTGSRCGGCGPSCXRSSASSAGTRATSPGGSPGEAAAPAHGAAARGRSWAATGPSGGALRAARRRPRSSSRRRGGQRPSCGPTPSTRRPSPSASSSSSATPCRSRTTAAPSSPAAAAPSGDRPHRSGLRLDRVGSGTTSWNKCVYARPGLPSRSSMESRDVKLASIVY

SEQ ID NO: 181727 - protein, 178 aa, Triticum aestivum
  Clone ID: PAT_TA_76145.pep
IRHQAGARVWPRTGCTFDGSGRGHCITGDCAGALSCRVSGEQPATLAEYTLGQGGSQDFFDLSVIDGFNTPMSFQPVGGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 181728 - protein, 141 aa, Triticum aestivum
  Clone ID: PAT_TA_76146.pep
RFYSSIAILQISNARAKEAVVTDCGAGCVGRAHSPAVNADILSDRPWRRAAPGCGYGVGWFKRPLLQLHGISSGPSAELFRKHTEQAIYSTNLCNDALCLFLNTHQVHLKTIFCNRGTKFGAEMFPVIQRQKKGRIECTCL

SEQ ID NO: 181729 - protein, 109 aa, Triticum aestivum
  Clone ID: PAT_TA_76147.pep
RHEELQPVGGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 181730 - protein, 104 aa, Triticum aestivum
  Clone ID: PAT_TA_76148.pep
SARGAYEGERLEFGDGAFRSLQKLRLGLPDLEEWAVSAGSMAALARLTLLRCAKMEMLPEALGGMKELEEVVLYSMPKMVGRIKEDGGQDHHKIKHVPVIQTIW

SEQ ID NO: 181731 - protein, 134 aa, Triticum aestivum
  unsure (1)..(134): unsure at all Xaa locations
  Clone ID: PAT_TA_76149.pep
TRSCATSDKSPVAPGRVHPPRERAPPTEQRTLGTRMEVGPHPRRAATPSRRAPPWLEGRAPGGCXPRSPRHGRWTGAPAPRRALDSIHPQPPPQLAAASSSVRREPPPPPLRPLSLSLLPSLSLSCSSSSLCLQ

SEQ ID NO: 181732 - protein, 211 aa, Triticum aestivum
  Clone ID: PAT_TA_76150.pep
MNGQTTMGLAAAARPCRQRLLTSASAAAAKASVIRLFPRCPHPQHHHHGRRLPFLVSAASHTSQPDPSTTPTPTPVTSDPRSAVAGNLPFFDRVLFPGSFPPETPPVEDPAPPADERPASASPVREETETEREAWRLLRRAVVSYCGEPVGTVAAEDPECTEMLNYDQVFIRDFVPSALAFLMRGETEIVRNFLLHNLQLQSWEKTVDCYS

SEQ ID NO: 181733 - protein, 62 aa, Triticum aestivum
  Clone ID: PAT_TA_76151.pep
GHALRHRRRQRGRNAAAAELVGAQQRAVAVRQRRINGWLGEGRHGRSTEEMGSLDTCERASS

SEQ ID NO: 181734 - protein, 202 aa, Triticum aestivum
  Clone ID: PAT_TA_76152.pep
GTRRERERERERERERERERERERERESLTDRERESLPHANSTEDELLRVFAAKGLGAGDLVALSGAHTIGFAHCAHFLGRLYDFRGTRRADPFMDARLVKALRMTCPYTGGSARAVVPFDVSTPFQFDHAYYANLQARLGVLGSDQALFLDARTRPLVQELGADKARFFRAFVASMDRMGSIRVKKGKNGEVRKICSQHLY

SEQ ID NO: 181735 - protein, 210 aa, Triticum aestivum
  Clone ID: PAT_TA_76153.pep
MASPHHIAMELVGPKPGGSSSAVAVHHMFVVFVDGVETDIHEGTLHGSPGKVTVTSPGNLSADGLRSVVVRGGGGGAVVFTLCGDAAAEGVGSASFVQCGATRVDGAREVSVSRCRSLDAEQAGKVTVERCREARLRGGGLLRVTRCRRADVESFGEVRLARCKGVRADWCGSLEVQMCRAVDASRCGAVSGDRCRRVNVAGCGSVAVTH

SEQ ID NO: 181736 - protein, 232 aa, Triticum aestivum
  Clone ID: PAT_TA_76154.pep
SARGNSAAGGAVQLRACFVRYGNDSFLGKPDNTVLFKKCGGESGDAGVAALRDAALGALQAASSPAAGGSYRAGAAGYVQAMSQCVGDLGAKACTDCVSVAASQLKAGCGDASAGEVYLGKCYARFWSNAGTGTGGTTPGGGNVIGGGNAGPIGDGGNGIAGGGNGIAGGGTVGVPGAGSGYGYGFVPRPYGDVQDGSGKTLAIIIGIVAAAAIIIIFLSFVRRARAANGKS

SEQ ID NO: 181737 - protein, 90 aa, Triticum aestivum
  Clone ID: PAT_TA_76155.pep
RHQIGFAPMFAGHAAAAIPGLELGLSQEGHIGVLSQFYHQVGGAGASGQLQHPHPHQHHHHEQHHHQQQQQQEDGEDEREDGDSEEESGQ

SEQ ID NO: 181738 - protein, 125 aa, Triticum aestivum
  unsure (1)..(125): unsure at all Xaa locations
  Clone ID: PAT_TA_76156.pep
TWLGFQLLRSIHRRFISGGSSPSHSAALTPYPPPGWRSLARCARACWAGQRRPRPLLPRLRPGRVSMATSSAARRRWPACTATRASSTNHFSTXGCDCYAGYDAPHGPSNAASMEEALDPCGHIP

SEQ ID NO: 181739 - protein, 233 aa, Triticum aestivum
  Clone ID: PAT_TA_76157.pep
APVHVNLRQGTQILNYIQSRSRPRPTVHISPSRTVVGKTPAPAIAYFSSRGPSSISPNILKPDVTAPGVNILAAWPPKSSPTMLPLDKRSTEWNFDTGTSMSCPHVTGIVAILRSVHPTWSPAAVKSALMTTAYVHDDTSDAMLAGGTQKAADAFDTGAGHVDPLRALDPGLVYDADARDHVRFLCGLGYTEAQVRQMVLSSPALDTSCAGGAIGDADLNYPAIVLPELRAAA

SEQ ID NO: 181740 - protein, 253 aa, Triticum aestivum
  unsure (1)..(253): unsure at all Xaa locations
  Clone ID: PAT_TA_76158.pep
SARGLADPPLLQLESMEDSGGVLVGALGSKILALWQPTADGQLTTHAVAYGTDTDKLAVGPPHPDALLTMRFVVAAGERLYALHEGGLHCLELVSESDSDSDETLPSGADEAEEHRWAWTRVSSPLRLPGCGGDPEEDDEPIEITSYALHPDGRTIFVSAHATAPWRLRGHLLTRHGWSAAGTPSGRLAGEWLLPFQGQGHYDAGLDXXWVGLHSPGYMCACDVPAPVTNGHHSGDAPRQPAWELVSAASLLY

SEQ ID NO: 181741 - protein, 125 aa, Triticum aestivum
  Clone ID: PAT_TA_76159.pep
MRRSAGCTRPGGPRRRSGPRPRRRLGRSARGGGRDARRAAPRGRRCRRRRARRSPGRGVRTRGPTPARGRSPANQGRPRDPLRRGGGTTPGRRSRGARRGGARRPASGGGGRTGRPPASSSACTP

SEQ ID NO: 181742 - protein, 130 aa, Triticum aestivum
  Clone ID: PAT_TA_76160.pep
LPLPPSLLHSPHATTSQQAGAKRPQRSSAQQQQQQQHVSPTRTSPGSCWDHGSALRSRSGNSSSSRLSGRRRSKAASYEAAIAQCYSGPRPRRSDLPGPPPPPLGARDFPGRGQRLGAGPNWAGRVLGRG

SEQ ID NO: 181743 - protein, 215 aa, Triticum aestivum
  Clone ID: PAT_TA_76161.pep
SQNADMIADNAQMLPFFLALRELAGPFEAYVRALVPRPSCIISDWCNSWTAGVATYLGIPRLFFQGPSCFFSLCDLNAAAHGLHERIAAAEDREPHVVPSMSVSVKVGNGRPHGFFTSPGCKELRHDAVAAMRTSQGVVINTFLDLEEKSVACYEAALGKPVWTLGPFCLHTRDGDDMASRGGNKSGVSERAIVTWLDKQAPESAVYGSFGSVAR

SEQ ID NO: 181744 - protein, 131 aa, Triticum aestivum
  Clone ID: PAT_TA_76162.pep
GPGPGDEGSGEEEEEESMAEWEEDEDDGADAEIGDGGNGGGVALRDVKWGARALAAAEEVLGEHFGDDIAMFAFKVSPKGYVYVRLDKLTNRYGCPGIEEIENFNRLYKQKLDEIIERGEIPLDLALEISS

SEQ ID NO: 181745 - protein, 94 aa, Triticum aestivum
  Clone ID: PAT_TA_76163.pep
MAAAAAAAATRKDGADARPHPHRLRSPTRVAADFAMGGAAAVVAKTGAAPVERVKLLLQNQAEMLRRGALTRPYRGIADAFARVLREEGAAALW

SEQ ID NO: 181746 - protein, 99 aa, Triticum aestivum
  Clone ID: PAT_TA_76164.pep
AAASSPAAPTRCRCARYAASRTRTWDFWSVRRRRTHGGGCFTATSTSATKGCRRAGRRAPAPALAGGSPTPVAAAAGVNYLEGTTIPICFPGQEAAWRL

SEQ ID NO: 181747 - protein, 177 aa, Triticum aestivum
  Clone ID: PAT_TA_76165.pep
MGSSSVDGAGEMCLEAGAGRAGRRGGKKAAEMKAAKQPQRGLGVAQLEKIRMQNQMIAAYRSGLPPPPPPQQVPYAAVPTAGAASSFQPYLAGCFEAMDRRIADVQYSQYYAENLLPNSSSRPPSTSPLFVVHDSSSSGQRQQQTPHEYDYWMRHSHESSGRGGAGSTEELDLELRL

SEQ ID NO: 181748 - protein, 110 aa, Triticum aestivum
  Clone ID: PAT_TA_76166.pep
FAPKAGRDGRRFPGHGEVQLYLKDFCDAFGLMEAVRLNTRVLRVAMAVAPTRQWMVRSVHEGTEEEEEEVFDAVVVANGHYSQPRLPSIQGMEAWRGRQIHSHSYRVPEP

SEQ ID NO: 181749 - protein, 141 aa, Triticum aestivum
  Clone ID: PAT_TA_76167.pep
MAELEAGSISMAAGGGGRLRNALSGMLCAFALLLIGVLAFSIRLFSVIKYESVIHEFDPYFNYRVTQFLSKSGIYEFWNWFDDRTWYPLGRVIGGTVYPGLTLTAGTIWWLLNSLNIPLSVETVCVFTAPIFSANASWATY

SEQ ID NO: 181750 - protein, 86 aa, Triticum aestivum
  Clone ID: PAT_TA_76168.pep
SLHFRPEDVAELAHNKVLIAATVAGVIGQLAKPFTSGRDGGKIDIVRVAAQSGGMPSTHSAAVVAVTTSLALERESEERWASTQGF

SEQ ID NO: 181751 - protein, 42 aa, Triticum aestivum
  Clone ID: PAT_TA_76169.pep
LIPGNFSIFLFFNRESPTRKCIGLLDQWPTELERKEKLTILA

SEQ ID NO: 181752 - protein, 160 aa, Triticum aestivum
  Clone ID: PAT_TA_76170.pep
RARPPFSALNLLAGAGCCELRGTRGSVREADGDGAAAAAGGWWGGGPLSPERSNAGMAAPTGWERGAMAPSGASRGRRERAPRRFQIRCRRPQGRLRGGDQGSAAGALTQRSRGRESLNNSYLHMVGMTEEHSYLIVNWLYCSSEDDEFIFVAPILGSAW

SEQ ID NO: 181753 - protein, 216 aa, Triticum aestivum
  Clone ID: PAT_TA_76171.pep
MGITKVGPLDTEEDTFHRAGPTHMMSKAGAGSKIKIDWSKEGHRRCVMSCLVKATYVMENDILGRRLYNNDGLAPAWWESFGFRLVETFVDDSNPNDKMIFGATFELMALSRHRSAPRYVVAFRGTMLGHYKRAQELMQDCKVIFNELRGSKRFEIAHPKVHQLIGRDASGVWLTGHSLGASLALDIGRDLMEIEGHNIRTFLFNPPHVSAAAPID

SEQ ID NO: 181754 - protein, 202 aa, Triticum aestivum
  Clone ID: PAT_TA_76172.pep
MRTRSMASKPEPVPSTHGTAAPAPPPASVSAPTHGTAVPAPPPASVSAPTQGTAAPAPAPASVSASTHRTAAPAPPPASVSAPTRCATVQRCVALLDWWPVRGQGGKIRVAGYIDNVENNRAGRVFSSGSITMRHADGTLETADHKIVLTRGPLNIEQMHWNGFSREVTEQFRLGFPIQWEKYANSNIKQANEHTLSPAKST

SEQ ID NO: 181755 - protein, 184 aa, Triticum aestivum
  Clone ID: PAT_TA_76173.pep
SRELISKPRDSRSIMEVVSAIVKVVQEIAKAVETDRENSESCLDLADRARTVGDIIHHLDSSTASTRSSGSGRTVMIREPSLKRLKAALNDALKLVESQQPSGFLGGHVNRLINSGTTADRFQRVEARINACVNDVGLAEQFAARHRALRANRRTVSAPSLAPERHHQSSQSAPPPSQHQQRFL

SEQ ID NO: 181756 - protein, 70 aa, Triticum aestivum
  Clone ID: PAT_TA_76174.pep
MASRAPAAVLVLAALICAAHSSAAAEGLSRSFHAASCPDLENIAGSLVAETFRRDVGVAPALIRILFHDC

SEQ ID NO: 181757 - protein, 102 aa, Triticum aestivum
  Clone ID: PAT_TA_76175.pep
MAAAGKSKEADAARCRRHPSHRHAAGVCPFCLSDRLSRLSAAASAAASEPSSASSSGAASVASAQTAPPCREARRARLGMLMRQDVPEAAAGGHHGKKEVGT

SEQ ID NO: 181758 - protein, 117 aa, Triticum aestivum
  Clone ID: PAT_TA_76176.pep
MAGLLRLAGAARSFSRALAPAAPHHRRLAASAAALAEDDACWTEWEEEEEEARRQRARASAPAEESCPADGGPRGVQWVVMGRPGPQKDAHAARLAEVLAVPDISMGTLVRQELSPT

SEQ ID NO: 181759 - protein, 140 aa, Triticum aestivum
  Clone ID: PAT_TA_76177.pep
NKPKPPVIITRESANTLRAHILEVGSGCDVFECISTYACRRQRGVCVLSGSGIVTNVTLRQPSAPAGAVVTLHGRFEILSLSGSFLPPPAPPGATSLTIFLAGGQGQVVGGNVVGALYAAGPVIVIAASFANVAYERLPL

SEQ ID NO: 181760 - protein, 133 aa, Triticum aestivum
  Clone ID: PAT_TA_76178.pep
SRFPSNTPAPSPTLPHPPTRPWSGTQARARPEPASPPSPARHPRPAPRPEPVLPPKREWKVVLPPRRPGPRPKGPAQKWLHHRLCPGASKLGPVPGVSSSVCPGASDRSAPGRERAMAAPGAVQPMTRESPDD

SEQ ID NO: 181761 - protein, 75 aa, Triticum aestivum; identical to SEQ ID NO: 106874
  Clone ID: PAT_TA_76179.pep

SEQ ID NO: 181762 - protein, 131 aa, Triticum aestivum
  Clone ID: PAT_TA_76180.pep
TREEEETGATSSKAMATKLAADEPPTAHPRAAEEALATDTADESCAAGEAGGMNAVDVLCAADKAPSRGSARELCAADMICSILAGPPCTAAEAHQKPVSSTPLLPSLNPACFCSFTLLKSYSKLWPSNSN

SEQ ID NO: 181763 - protein, 65 aa, Triticum aestivum
  Clone ID: PAT_TA_76181.pep
CHCWICKVSLGKVFEVLKCLGTSLCFCIDVISKCIYRSIHVMWVMCSTESEMAAIQSVLALESYE

SEQ ID NO: 181764 - protein, 59 aa, Triticum aestivum
  Clone ID: PAT_TA_76182.pep
IRHEDYTSSQLAKELDTQQSINDKLHKLSTILKLITETRERIAKISDNTVSESGSDGLR

SEQ ID NO: 181765 - protein, 82 aa, Triticum aestivum
  Clone ID: PAT_TA_76183.pep
KVYPLQSAMSCPCKHANLGLCMAPCQHMKLSYIPRDPSRNTPNDLRPSSLPAAMCLGSPDDDSGTCSVRCQSSLSEQKLLKS

SEQ ID NO: 181766 - protein, 125 aa, Triticum aestivum
  Clone ID: PAT_TA_76184.pep
SPQPAISSPPITREYKRRGEVGRASRSVRWRPDPPGDDRNPSAFFSLRALDAMPWIELHAPQPSGRPKRRWRRGGSRSGGGRTSPHHRRSRGKQRRCLLRSPAAAAGSIPAPSMYHRSRTIQQPR

SEQ ID NO: 181767 - protein, 76 aa, Triticum aestivum
  Clone ID: PAT_TA_76185.pep
NNTLSADKPHHRCMKSGNHMYANILQTNGSALPLQHHLRRYVYTSRKHAGQLMDSSSLFSLSHTRSLIFSLIASCR

SEQ ID NO: 181768 - protein, 243 aa, Triticum aestivum
  unsure (1)..(243): unsure at all Xaa locations
  Clone ID: PAT_TA_76186.pep
GVRKPPPRNRDRHTKVEGRGRRIRMPAACAARIFQLTRELGHKSDGETVRWLLQQSEPAIVAATGTGTVPAIATTVDGVLRIPTQSSSSASSAVVDDEASAKRRRKLQPXXAAGPLATVPPAAAYYSVLADPLLQGXRXGGAAISVASGLAPIGGQQGLVPVFAVPSAAGAGGGNHMIPQATXAVWMVPQPAGAPNQPTQYWAFQSAPQLINLAGAQTMPGWSCVPQRRRRLPSTAAVCLYRG

SEQ ID NO: 181769 - protein, 101 aa, Triticum aestivum
  Clone ID: PAT_TA_76187.pep
IRAWRPPGRTSPSRAENDARRYVSACRGRGRAATAEISSPLPLHLSVSTMALPTLLQGKNQIGPMTGSICPRAPAEANNPQGVVQSIGCLQCAVIKEDMLF

SEQ ID NO: 181770 - protein, 116 aa, Triticum aestivum; identical to SEQ ID NO: 134375
  Clone ID: PAT_TA_76188.pep

SEQ ID NO: 181771 - protein, 267 aa, Triticum aestivum
  Clone ID: PAT_TA_76189.pep
IRHEGPTVVRVPVPQLQPQNPSQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSRCQAIHNVAHAIIMHQQQQQQQEQQQQLQQQQQQQLQQQRQQPSSQVSFQQPQQQYPSSQVSFQPSQLNPQAQGSVQPQQLPQFAE

SEQ ID NO: 181772 - protein, 253 aa, Triticum aestivum
  Clone ID: PAT_TA_76190.pep
EADDYAFVRCASGCDSWAPHHVRLDGDSYRLCSSCVLLSNPEAYCSACLLLLFPGAYAASSREARVDFSPGPTAACSNCGVFVAHLSCIPDPYSFICPPCAAAVDNVPFSYDLAGVGRSARVLLTAALLSHESALHDAAAAREKAERSLHEAAAARRLARDMLDAAFRAAEAEAYRDAKEQATPSAPAVVHLKKKTPNTNGHKRKTPKSNDANREKDKLLKFNDMQQPALAFAAAAAAAASSMPSPSPMQSSR

SEQ ID NO: 181773 - protein, 147 aa, Triticum aestivum
  unsure (1)..(147): unsure at all Xaa locations
  Clone ID: PAT_TA_76191.pep
MAGDHRRDRAQQQRPGVLMVAALAALGLLALSGTALAASVAGLAVAAPLLLLCSPVLVPAALLATLTAGGMATSGSAGXGATALLSRLASAVRRAAATPPDYVELGKRRVAEVAGEQTAHIDAGPAINPEQVARSRRPYGGSHALIS

SEQ ID NO: 181774 - protein, 251 aa, Triticum aestivum
  Clone ID: PAT_TA_76192.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQQLQCAAIHSVVHSIIMQQQQQQQQ

SEQ ID NO: 181775 - protein, 217 aa, Triticum aestivum
  Clone ID: PAT_TA_76193.pep
MEMEARGDLRSILPQLPVVLRGGALFWPAAAQEQLRALSLGPDVSRVTSGDVLADALSDLRQALALRALPARAAEGYALFFDDLLSRAHARDWFSDVLPRLARLLLRLPALLEAHYAGARAATGLRLLGPQDAGFVLLGQELAAALLACALFCLFPTAGRGEARLPAINFDALFSALTNNARQSQEHKVRCIAHYFERVTASMPAGFVSFERKVLPR

SEQ ID NO: 181776 - protein, 127 aa, Triticum aestivum
  Clone ID: PAT_TA_76194.pep
RSQVLQQSTYQLLQELCCQHLWQIPEQSQCQAIHNVVHAIILHQQQKPQQQPSSQVSFQQPLQQYPLGQGSFRPSQQNPQARGSVQPQQLPQFEEIRNLALQTLPAMCNVYIPPYCTIAPFGIFGTN

SEQ ID NO: 181777 - protein, 258 aa, Triticum aestivum
  Clone ID: PAT_TA_76195.pep
MKTLLILTILAMATTIATANMQVDPSGQVQWPQQQPFPQPQQPFCQQPQRTIPQPHQTFHHQPQQTFPQPQQTYPHQPQQQFPQTQQPQQPFPQPQQTFPQQPQLPFPQQPQQPFPQPQQPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVTILRPLFQLAQGLGIIQPQQ

SEQ ID NO: 181778 - protein, 154 aa, Triticum aestivum
  unsure (1)..(154): unsure at all Xaa locations
  Clone ID: PAT_TA_76196.pep
MTPTSGNTTDEARGIRHELQEEPTVAAPLWTWVRPRYAVEDDLGFTVHHCPGPLPRRQRGDHPGQAMXRGHHRMYPARSARSSTTSSARRRHQPAIPPPRSRSAAPPRGMRSAPPPPSRVGGDPPPTPPATQLSPTASYGGDKGRGRWTEEPGG

SEQ ID NO: 181779 - protein, 128 aa, Triticum aestivum
  Clone ID: PAT_TA_76197.pep
RPSSPTSRSPGRPSSIFSIPAPCPSPKIPPSHGRHHHHCTQPPSSWCSQFRSVASIVSSKKVVIRHKWERKLRCQDLQAGHEPPCHVFPRHIRIRRRRQQVLYQFRHPTYCMPTHLNHAGLTPAILLE

SEQ ID NO: 181780 - protein, 247 aa, Triticum aestivum
  Clone ID: PAT_TA_76198.pep
MKTLLILTILAMATTIATANMQVDPSGQVQWPQQQPFPQPQQPFCQQPQRTIPQPHQTFHHQPQQTFPQPQQTYPHQPQQQFPQTQQPQQPFPQPQQTFPQQPQLPFPQQPQQPFPQPQQPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVTILRPLFQL

SEQ ID NO: 181781 - protein, 203 aa, Triticum aestivum
  Clone ID: PAT_TA_76199.pep
GFAVVGLPARGEIYVIGGVEEGGDKAVSSVAVYSAATNGWGQVAGMRTPRGYMAAGEVGGRVVVAGEDGEAEVFDPESARWAPAAARGGAAVARYDAAAAGGKLYVTEGWAWPFERAPRGAVYDAAADAWSDMARGMREGWTGSCAVSGGRMYIVAEYGEWRLKRYDEPRDEWRMVAGGGVPQEVRRPHVVAGQLEEVGGGRR

SEQ ID NO: 181782 - protein, 144 aa, Triticum aestivum; identical to SEQ ID NO: 131261
  Clone ID: PAT_TA_76200.pep

SEQ ID NO: 181783 - protein, 193 aa, Triticum aestivum
  Clone ID: PAT_TA_76201.pep
MAASRRRTSAEFQGDGSLMPPSAHVVASPRGGGAPSREEHANGGRPALRGANPRGGSSVFSATKLTGRRRPARRMPLRRVAIFASLALNVAALALLRHRYVVSHPHHPGVVSLDQQHHVCAPQPGTSGAAASAPSTGKPGVTSDSVINLDHGDPTMFEAFWRETGDAAELVIPGWQTMNYFSDVSNVCWFMEP

SEQ ID NO: 181784 - protein, 213 aa, Triticum aestivum
  unsure (1)..(213): unsure at all Xaa locations
  Clone ID: PAT_TA_76202.pep
YPQPQLPYPQPQPXFRPQQPYPQSQPQYSQPQQPISQQQQQQQQQQQQKQQQQQQQQILQQILQQQLIPCRDVVLQQHSIAYGSSQVLQQSTYQLVQQLCCQQLWQIPEQSRCQAIHNVVHAIILHQQQQQQQQQQQPLSQVSFQQPQQQYPSGQGSFQPSQQNPQAQGSVQPQQLPQFEEIRNLALETLPAMCNVYIPPYCTIAPVGIFGTN

SEQ ID NO: 181785 - protein, 123 aa, Triticum aestivum
  Clone ID: PAT_TA_76203.pep
PAPHARPPPAATDDRRSIPPLPHAPFLYSIAPRRPAPTAQPNSVLPFSAAGSTPSCSLSGWPPLSSIPGLTSPSPPSSSRRPTQRQIWIGAACAWSRASLSVFGWAGAPKRLRRENGKHKRKS

SEQ ID NO: 181786 - protein, 271 aa, Triticum aestivum
  unsure (1)..(271): unsure at all Xaa locations
  Clone ID: PAT_TA_76204.pep
SARGSFKPSKQWSIQIHHALLAIVATTATTAVRVPVPQLQPQNPSQQQPQEQVLLVQQQPFLGQQQQQFPGQQXPFRPQQPYPQPQLFPPKLPYPQPQPFTPHQSYPQPQPQYPQPQQAISQQQGQQQQQQQILQQILQQQLIPCRDVVLQQPNIAHASSQVSQQSYHLLQQLCCQQLWQTPELSQCQVIHNVVHAIILHHQXQQKQQQQPSSQVFYQQPQQQYPSGHGSFQPSQQNPQTQGFVQPQQLLQFEEIRNVALQTLPAMCNVYI

SEQ ID NO: 181787 - protein, 254 aa, Triticum aestivum
  Clone ID: PAT_TA_76205.pep
FGRGSVLEYVFGVLALYLLGSAHAIQMYQLFTLDTKMELLTVLMTIMPSCIFCIVQAIVTFISHKNQRIMVISSSLNLVCYGLEILLLIQVHKKLKAPEAIKKLKSTVGRSFRRRQDEAHLEDRDQPNEGNDSDSNVIPPAPPSTRTDLQRVVVAISRMEARNDGCKIEIVEEGGDEQTNEMHALGIQSPNRIIPLGGDNAGQHNVTPPVPAVSLPHAPRKHRRKGGVAKNGVSRRGVEVTKESAGQWWQFGCK

SEQ ID NO: 181788 - protein, 116 aa, Triticum aestivum; identical to SEQ ID NO: 134375
  Clone ID: PAT_TA_76206.pep

SEQ ID NO: 181789 - protein, 225 aa, Triticum aestivum
  Clone ID: PAT_TA_76207.pep
MARWSSPKDPSLEAALRRNRRWIVNNQIKRLLLRFPSRSAPVRLLQSRFKTLDLLGRAANWLRKYPSCFELFTGEGPAGSGGELCFGFTKRMAELVDAEEAAVTASEPAMADRLARVLMLARGRRLPVSKLAALRGPLGLPDDYLLRILPAHTDLFRLANPYPHRRNAAELELLRWVPSRAVSAVEAAASASNTLPRFTCSLPSSWAKSHEKMEDFNSTPYISPY

SEQ ID NO: 181790 - protein, 59 aa, Triticum aestivum
  Clone ID: PAT_TA_76208.pep
RRPQRAGSRSSRCAAPARRRRSSPPPPPLLPPHPLDGRIACGQIRSAEDRCIGEAARPQ

SEQ ID NO: 181791 - protein, 231 aa, Triticum aestivum
  Clone ID: PAT_TA_76209.pep
RSDNGDGEAAAAAGRRRWWRCLWDAEEAAGQVAFAAPMVATSMAFYAIPLVSVMYAGRIGDLELAGATLGNSWATVTGIALMTGLSGSLETLCGQGYGAQVYRMLGVYLQASIITSALFSVLVSLLWLYTEPLLIFLHQDPEVSRMAAVFLRYTIPAQFAFGFIQCILRFLQTQSVVMPLVAFSLLPLVFHVGITHASVHYLGLGFAGPAMSTSLSLWLSFIMLASYVMLS

SEQ ID NO: 181792 - protein, 175 aa, Triticum aestivum
  Clone ID: PAT_TA_76210.pep
MARKGGERKKAVTRSTKAGLQFPVGRIGRFLKKGRYAQRVGSGAPVYLAAVLEYLAAEVLELAGNAAKDNKKTRIVPRHLLLAIRNDQELGKLLAGVTIAHGGVLPNINPVLLPKKALEKAEKESQSPKSPKRKAPAPAPAAKKTPKKKAADKKTAAADKKKAAADAEEEAAADE

SEQ ID NO: 181793 - protein, 203 aa, Triticum aestivum
  Clone ID: PAT_TA_76211.pep
APPPAFWCSTHGWVICPLHEYGSAAGVDAVGQSRTSVFGFGSTSAAVADANAMAPRLLPQTPAVVEIEGDALAHVSMPTGASMFTFGSGVRSMTSALAASPSSPRADANVLRLPSPTPDTPPPPPHAGAHRRLLAIGLPLASPPADSPTSSHDHRAGTWSLAAGLTNGASTASPRGPCSLVDPRQGRGRPEHYSLLVSSGAVV

SEQ ID NO: 181794 - protein, 220 aa, Triticum aestivum
  Clone ID: PAT_TA_76212.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDL

SEQ ID NO: 181795 - protein, 83 aa, Triticum aestivum
  Clone ID: PAT_TA_76213.pep
VLYFLCILYMTFFVKSLFLLLLHYISDFDFYKFAPYLRSLFVVLFVHFSMSLHWCIDFFSTSFFLNSPTKFLHKSGKHVFLHF

SEQ ID NO: 181796 - protein, 235 aa, Triticum aestivum
  Clone ID: PAT_TA_76214.pep
ARGLKEVLIFENLDVSKKGAYMFGRIDLCDFVLEHPTISRFHAVLQFRNDGQVFLYDLGSTHGSSINKTQVKKKMYTPIHVGDVIRFGQSSRLYIFQGPSELMPPEKDMQKLRDAKIRQNMLDREASLLRAKTQAVLADGISWGMSEDAPEEDGEDEADEITWQTYKGQLTDRQEKTRSKLIKRMEKVANMKKEIDAIRVKDISQGGLTQGQQTQIARNEQRISQIMEELENLEE

SEQ ID NO: 181797 - protein, 212 aa, Triticum aestivum
  Clone ID: PAT_TA_76215.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKV

SEQ ID NO: 181798 - protein, 189 aa, Triticum aestivum
  Clone ID: PAT_TA_76216.pep
MFPAAAAASSKKPGVSPSSVHDRAAAAACDSGLVLTTDPKPRLRWTVELHDRFVDAVAQLGGPDKATPKTIMRVMGVKGLTLYHLKSHLQKFRLGKQHKEFGDHSVKDAMEMQRNAASSSSGMMGRSMNDRSTHMNESLRMQMEVQRRLHEQLEVQKHLQMRVEAQGKYMQSILEKAYQTLASSDCATW

SEQ ID NO: 181799 - protein, 153 aa, Triticum aestivum
  Clone ID: PAT_TA_76217.pep
ASIKGTQLAFAKEKKLISTTHCSDRPCAPEESSVINLLLKLRFLVLPVELSALALITPSADPDADAPAVQPVSNADRALDSLLSIPSISSVNSDDCSCSMPLSLVAPSRASIRSFTALAAGTSLPALPEDAMQLQQCYTTSDTPLATVQRSPL

SEQ ID NO: 181800 - protein, 42 aa, Triticum aestivum
  Clone ID: PAT_TA_76218.pep
KAKLVEETGLQLKQINSWFINQRKRNWHNNSQTSTLKSKRKR

SEQ ID NO: 181801 - protein, 133 aa, Triticum aestivum
  Clone ID: PAT_TA_76219.pep
LPQLHLLPAQPHYQRRQPPWTLWSPRHRTLRPRCATSCGPPSAPASARRAAAGRGRTRGAAGAGGGDAWQPRGSSGTTRSATRSTSTTAPATTTRRTPPSGTETSTRACPPRRRPPPEPSQLPELNVGSDRPF

SEQ ID NO: 181802 - protein, 235 aa, Triticum aestivum
  Clone ID: PAT_TA_76220.pep
CLPPRKPVAGAGKQGRSRLLCKCEATSRGAGTGDDDDLVLRRLDRRDVLLGLTGVGATGAINLGGLALATDDAVLATCVTVPVTDKVIRCVSADGFQCPGVYRPEDVVDFSALPPPNGPLRVRRPAHLVAADAEYVRKYEAGVRMMRDLDASGDPRSFKSQAAIHEAYCNFHYKVTAAASRTPEIDFDVHFSSIFAPWHRMYIYFFERIIGELIGDSTFALPYWNWDAPDGMMLP

SEQ ID NO: 181803 - protein, 211 aa, Triticum aestivum
  Clone ID: PAT_TA_76221.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKV

SEQ ID NO: 181804 - protein, 156 aa, Triticum aestivum
  Clone ID: PAT_TA_76222.pep
MEESDSEQGSTSRGGGVIGTSPSATPPRVPRSKALRAAQLPRIPTVPAAQRPDFASHPSDQVLIKSYLTPRVASGQHPCQFTHDVDVYTASPGALTRKYSPTMASDGEKAWYFFTLLPAKSAHGQRRPRTVGTGEGCWHSEAGVKPVLDGDHPIGW

SEQ ID NO: 181805 - protein, 167 aa, Triticum aestivum
  Clone ID: PAT_TA_76223.pep
MSGMGSRPGESNLVEPRGLPSAGMAMQPWWTGTGFGAVSPAVVAPGSGAGISLSSNPFGGGAPQGKKKTVDDDPRAESSDDDSPRSGEPKDGSFDEEKQHATSRMPALASDYLQPYSQLELNQPMASAAYPYPDAYYTGMVGPYGAQAVAHFQLPGLTHPRMPLPLE

SEQ ID NO: 181806 - protein, 139 aa, Triticum aestivum
  Clone ID: PAT_TA_76224.pep
ECPRPELVFGLKPHCDGTVLTLLMVDDSVGGLQVLRDGVWWDVPIVPHTLLVIIGDQTEIMSNGFFKSPVHRVVTNAKKERLSVALDYSVDHEREIEPSAQLIDEKRPALYMKVKVKDYIAGLYEHFSQGTMVIDTLQI

SEQ ID NO: 181807 - protein, 209 aa, Triticum aestivum
  Clone ID: PAT_TA_76225.pep
IGEVGGGNRGELDVRYLPSMLWHLIVPQNLTLFGEIGRMEALRTLHQPFIIHVEILKGLGNLKNLRELKLYLFGFSDFEDALLPSLCRLDSLRSLATDGYTLGYDCLTYWNPPPRHLHRLHALNGPFSMVPDWIVQLENLKSLEMQLVSLPRVGVEVLASLTTLVHLILRVRGSVRDHAPEEDVVVVRGATFPNLKNLVFVYEVPCLTF

SEQ ID NO: 181808 - protein, 144 aa, Triticum aestivum
  Clone ID: PAT_TA_76226.pep
RKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKISTKSPKKKTAATKE

SEQ ID NO: 181809 - protein, 246 aa, Triticum aestivum
  Clone ID: PAT_TA_76227.pep
VPYPFDFHGELAPIMLGEWWDMNPIDVIRTATRTGAAPNVSDAITVNGQPGDLYNCSSQDTAVFPVKSGETNLLRFINAALNTELFVSLAGHTMTVVGADASYLKPYNATVIVLGPGQTTDVLVTFDQPPGRYYLAARAYASAQGVPFDNTTTTAIFDYGAGGTASPAMPTLPAYNDTATVTTFTTSLRNLHSVGLPSAVDEDLFFTVGVGLFNCSSGQNCGGPNNTRFAASINNASFVLPSTGSI

SEQ ID NO: 181810 - protein, 233 aa, Triticum aestivum
  Clone ID: PAT_TA_76228.pep
SFSSVKPIFERTRESDDHLGWVFPASAGEVPGADPDPFNGAKSVRDLYEIASTNYTGKPTVPVLWDKQLKTVVNNESSEIIRMLNSEFNGIAENPGLDLNPAHLQASIDEVNGLVYDAINNGVYKCGFAKKQGPYDEAVTTLYEALDKCEEILGKQRYMCGNQLTEADVRLFVTLIRFDEVYAVHFKCNKKLLREYPNLFNYTKDMYQIPGISSTVNMEHIRKHYYGSHPSIN

SEQ ID NO: 181811 - protein, 187 aa, Triticum aestivum
  Clone ID: PAT_TA_76229.pep
SLLLISIRGASSEHYLVLLGDPVVLLLCLFFSNIYHTMHFPAWLASCTLFARATPGCPWKERRRRCRSSHLGEPSSTCHLHVASYCRRVLGLRRSSRRWHAHKSSHSQRWPPGPCTAAPSRQPSCSRWRSWSPCPGEEAGGGARGSSSDGRGRETARIRQAGRRRWRRRGAARVRVWVDAAGRRGNR

SEQ ID NO: 181812 - protein, 80 aa, Triticum aestivum
  Clone ID: PAT_TA_76230.pep
SNANCTLFGVKRMQIVPRYYDMSKKMDGQMQTEKCLDIHIIGKSNESIDNRAIYISVPNSNHLLRYTPNSKACSKMPLRR

SEQ ID NO: 181813 - protein, 140 aa, Triticum aestivum
  Clone ID: PAT_TA_76231.pep
QFFMLKVCFFYALALPNLFWLQSAPLIQISWLRHCRWGVVHGSPDQSFCSQPVATEGVPDLAVQEEGEDDGECGHGGKFSVTDSPSSSSASQVHEATEDLINVPDIDNTDNPREPPSQSQRTPTPWPQRVQLGKIPDHIM

SEQ ID NO: 181814 - protein, 141 aa, Triticum aestivum
  Clone ID: PAT_TA_76232.pep
REVVERLFAGGDMPDVGLGDRESDHDFMAICKEAYMVPTDKRAPRAAADALLSRVVFHDGRLVRRPDPAHALFALAYLPVGFALAVLRVLISLPVPPHLVRHTYRLTGIRLAVRGTPPPVPRGGSPGSLLDCNHRTVLDPI

SEQ ID NO: 181815 - protein, 158 aa, Triticum aestivum
  Clone ID: PAT_TA_76233.pep
MSTDVAADVPAPEVEVTADPVVETTAEAAAGDAKPAKETKAKAAKAKKPSAPRKPRATPAHPTYAEMVSEAITALKERTGSSQYAIAEFVEDKHKAHLPGNFRKILSVQLKKLVASGKLTKVKASYKLSAAAAKPKPAAKKKPAAKKKAPAKKTATKT

SEQ ID NO: 181816 - protein, 171 aa, Triticum aestivum
  Clone ID: PAT_TA_76234.pep
MLRARSPLPSRPVPEVFKEAKSASKRFSTPPPRRKSSSPPRAPPVDAPLKAPAKVKHHRKEHWDNQRAKAAAEKVLQNWTVDRKQLLVGQKFAYGAHSRLFHGIYKEVPVAVKFIRQPDVEEDAELASQLEKQFNTEVVTLSRLQHRNVIKLVGGCTSPPVFCVITEFLSG

SEQ ID NO: 181817 - protein, 158 aa, Triticum aestivum
  Clone ID: PAT_TA_76235.pep
RYELDNFLMKYTSCGGQHPELLEDAQNCSSAPTATVTEVAPTQKIPEVAIIASKPKNVKSLRWLLVLLLAVVLIGLLFWGTLELKKRREAGRVGPQTQEVQLGRRVTVQARQTADDSIRNQHVDIPILEDLPFVGPMTRNRFNSLKERAAGTKESTSD

SEQ ID NO: 181818 - protein, 104 aa, Triticum aestivum
  Clone ID: PAT_TA_76236.pep
TSVASKLTRAQLHTAAIPILQRSQIHNLPNLLAPWLLSGQLGFSTALGISAPVCRPGFCSVILAPLVHGFHKQHANLQSTHLCSIPFPNIAGCLTFWCPCVTFG

SEQ ID NO: 181819 - protein, 205 aa, Triticum aestivum
  Clone ID: PAT_TA_76237.pep
MDLAPFKLDIDELLDDYAKENCMSFTDFKRVWMAKKFSYIYEGRPKTNSGVFMQSLFLHCIGHMTSQSSLLQRLPGLYCLYCLYECQPYKPHYKIYLSLEESKKLKDFVIEAKQNGLALVPALVKRMLDKGMFLFGFINLLGDNEAKEVDEMNASQNKRVKFACDKLFANTQIGSYTHTDLGVEFELDSIKKLSMDYAKAKESAF

SEQ ID NO: 181820 - protein, 86 aa, Triticum aestivum
  unsure (1)..(86): unsure at all Xaa locations
  Clone ID: PAT_TA_76238.pep
IASEGLKHRVFEVSLADLQNDEDQAYRKIRLRAEDVQGMNVLTNFWGMDFTPDKLRSLVRKWQTLIEAHVDVKTXDNYMLRMFTIG

SEQ ID NO: 181821 - protein, 99 aa, Triticum aestivum
  Clone ID: PAT_TA_76239.pep
ETKSYVLELIRNSVSTPSVYGSSVRPSPSYYTHASSPHITHAAAARKPCTHATQQPAAQARSTPHTANARQQGTWQESEEKTVVRSPSCSSSGGESTGS

SEQ ID NO: 181822 - protein, 82 aa, Triticum aestivum
  Clone ID: PAT_TA_76240.pep
FFFFFLKLDCFLNGHKLDLYNDGCGSLYSTPEPPCTKPTMQLVHARVHPPHRPSTSSTQILEATLRTRIYHLHVQLMHAPFY

SEQ ID NO: 181823 - protein, 77 aa, Triticum aestivum
  Clone ID: PAT_TA_76241.pep
GHLVMEMPPCFTNARLDPLPTQQVYACLFPCLMRKGRLASNPNLNEFSQGHAGDACLCGCRSTCDMLSESPCHAMSN

SEQ ID NO: 181824 - protein, 220 aa, Triticum aestivum
  Clone ID: PAT_TA_76242.pep
PCNASLDALCDGRGYNNYNVEVVQRLGADSFCPDSGVMISKTKNSDRVQPFQWTIDANPQDARQIDFYLPNGTARYWTIGDYRQLVDALFHAGTNSGSEYEHIDHENGLHLYILEKMTDDNGVLHYTVGAASTATNVTTSAQHGIELGSGKVVSNGNATSPADGLYCTFELKNTGKAASLATNPHPQDLSAYLGSDIYRLKAEVEGAGWKAAVPNALAYA

SEQ ID NO: 181825 - protein, 56 aa, Triticum aestivum
  Clone ID: PAT_TA_76243.pep
NPLPFQKLHADIIMHYPVTTTIIKIWVLVFPLSGLPRQKEVRNSGTACQVRRRPRA

SEQ ID NO: 181826 - protein, 239 aa, Triticum aestivum
  Clone ID: PAT_TA_76244.pep
MRHLFRTWSQVFPSSVLQGIEDELQFSPSENKRPATTTIPRQSESLSPRPSHGIHVNPKYLEAQHQLKNGTKVDQLATRGRQMLDVAEDHINGLTTNSLRGFPSTSSKLQRSMILYTENPDQQETFQSRIGLIRRDMSRSPPPDVLPRNASPKRPLEMPRLSHSALGHDPRRLPGRNGWFERQRAFEDSAQRPSMSTLDEEYRKQSARELIDAYGNSQGNGADDRLPKMQRLESNGMAS

SEQ ID NO: 181827 - protein, 248 aa, Triticum aestivum
  Clone ID: PAT_TA_76245.pep
IGLNTSSRSIKSDMYAFQMKWRDEMSNLGSNLKCLVDAADNYHKVLAENQKLFNEVQELRGNIRVYCRVRPFLPGQDKQSTTIDYIGESGELLISNPLKQGKDGQRMFKFNKVFSSFASQADVFSDTQPLIRSVLDGFNVCIFAYGQTGSGKTYTMSGPSTSKKDWGVNYRALNDLFDISLNRRNIFSYEVGVQMVEIYNEQVRDLLSNKIAQKRLGIWSTSQPNGLVLPDASLYPVKSTSDVLDLME

SEQ ID NO: 181828 - protein, 62 aa, Triticum aestivum
  Clone ID: PAT_TA_76246.pep
EAPWHLPSKEQKVTAPARAPLVHKIKPTHYPSPNVSQISAVRSKMFYDHRARANPATAGHLI

SEQ ID NO: 181829 - protein, 244 aa, Triticum aestivum
  Clone ID: PAT_TA_76247.pep
KIVSGGRKKDESRSALLSKETQERSKQNEPGRRGQGAEENNTQNKGRADVRPRDDNPNNNERNSRQDKINKTHDNNRVSSSSDARQANRDKPRESTRKGRGSVPNEQDLHRSSKRRREDHESHRSGKVEVKGGREQENGRDHATSSKTSKNPQRHDSFVKQGEEEAMSDDENTDDSRRGRSKLERWTSHKEIDYSTIDNETTHAFPSIKADVQPPTADASGKSDVPAIVVSSDMKNSGDNGQAS

SEQ ID NO: 181830 - protein, 69 aa, Triticum aestivum
  Clone ID: PAT_TA_76248.pep
KPPDLRQISNRTEPAEKATCLSGLLLSAKCLEHCGSITTHTCTVFEMDMRCRCMPVKQTCSIISHERHD

SEQ ID NO: 181831 - protein, 69 aa, Triticum aestivum
  Clone ID: PAT_TA_76249.pep
AGCRLPGILGKPCVQKKKTFLVTAAVQRSVVDVGVLSSGVTSCHHSRKQLKPWTPRRCTCASPPPWSNP

SEQ ID NO: 181832 - protein, 83 aa, Triticum aestivum
  Clone ID: PAT_TA_76250.pep
SLTKMFTSLLICAPSIEDNPVEARHYQLRLTTLLRWTTKQLRQRTTTNSTQNRKKAEYMLTVSSPLIRTPLSKVLNSQRDVYS

SEQ ID NO: 181833 - protein, 63 aa, Triticum aestivum
  Clone ID: PAT_TA_76251.pep
WCFSCASAATEFAPDITIISAGFDAARGDPLGCCDVTPAGYSQMTSMLTACSEGKLLVILEGG

SEQ ID NO: 181834 - protein, 84 aa, Triticum aestivum
  Clone ID: PAT_TA_76252.pep
IKHAREKKPCELTKPEVKSHQPIDSMTRPSLSAYFTTCCQFYPQLSCVKVVLFLRNIRSIYSNHVYTGCSFQVRITMISTLNFL

SEQ ID NO: 181835 - protein, 134 aa, Triticum aestivum
  Clone ID: PAT_TA_76253.pep
RSRLKHYKHSAASTRSLKCELTRGHQSARLGTRICRLQSHASKQTHRPRSRNRDPDSKSTARSWKLPHQPQSWDPTASTTNRTSTPSRKKEGKTDIGLDHTCPLTLRLMWAPPPSPAGFLSSSAVTPDISADSS

SEQ ID NO: 181836 - protein, 113 aa, Triticum aestivum
  Clone ID: PAT_TA_76254.pep
PIGTGGCAASTTSCHHRPYCDIVTHFCKTSDKELHRYYYLIHATPRIIRISGVAMRQQLIGTQNLDHELASIIFRRYSQSDQEANSECPCLNWRHNMEPDFANQLGGKDFPYE

SEQ ID NO: 181837 - protein, 84 aa, Triticum aestivum
  Clone ID: PAT_TA_76255.pep
DVILRICGHSLDISVLPLSIINLLQQKIHHFCLNHSDEHTCKEQGLYTEFMWRHSWVCKPKLVLYMGSDDGLSCWVLKHPTTRC

SEQ ID NO: 181838 - protein, 163 aa, Triticum aestivum
  Clone ID: PAT_TA_76256.pep
MFNSSINPAENVIEVDGKEFNFAWASERGELCDIYEEQQSGEGGNGLLVERGSAWRKVTVDRTLDESAKNLVKARSEEAERLAKSRKSIVLDPGNPSVRNQAKSMVAAGEGNMRRGKWNQKKDNFNKKQATVIPTKSISKVKLPNSIPKGSISTSPVPSPEQP

SEQ ID NO: 181839 - protein, 79 aa, Triticum aestivum
  Clone ID: PAT_TA_76257.pep
EDRIGSSSPTPATTAAASFSFMSTPLGPPPLHSLHQQHPGAPTNPTHLSILLRSRRRRKLNPTRRHRPPKSSPPVTPST

SEQ ID NO: 181840 - protein, 112 aa, Triticum aestivum
  Clone ID: PAT_TA_76258.pep
LCINKKNVEFPCGKPRCIEQRRISARGMPSTQHSKLQNLLCQNNFNQDQQSSCSYMIPQVTVRFQFHKGRCIITHVAGFFLHEHGGPVGKWLEKNDNTELGRRSVDDRMNFN

SEQ ID NO: 181841 - protein, 158 aa, Triticum aestivum
  Clone ID: PAT_TA_76259.pep
IKRVPAPAPAFTHAKLHRTKATASHLISACFGWIHHLSAPYRASPVSPWPIAGWWCRRYKGTQLATRTAPSPWIGLVSESASQGLGTARFTHGPRRRHCPESPLQEPLRLLLVGRRRTRRPQRKEPRRPQEEVGLSEAVPVPVRRRERRGCRGRGGRR

SEQ ID NO: 181842 - protein, 80 aa, Triticum aestivum
  Clone ID: PAT_TA_76260.pep
DGQLLFTAAQWRARERQHGGARDDDDGRSVASRSGGNRRRRCYECGEHGHFRYECPQLRKGPAAEQALLAGANVDDDGHL

SEQ ID NO: 181843 - protein, 125 aa, Triticum aestivum
  Clone ID: PAT_TA_76261.pep
MSKMADEKVISAPATGGGEDGLIAGDLSAAEARVRPLETLLRAAPLGLCVAAMAVMLRDTQTNEYGTVSYSDLGGFKYLVYANGLCAAYSLVSAFYTAVPRPATLSRSWIVFLLDQVIHWFLSSA

SEQ ID NO: 181844 - protein, 174 aa, Triticum aestivum
  Clone ID: PAT_TA_76262.pep
RSWLTAPLSPTTAVDRMESVFTEPLSTDSGLDRYHQVAQKLEALIANDGKDVEIQSVIAEVPDILHRCVKRDEAALLIAQKVFRSLYENASKSTYVTWLLATLAAIRDVCKLIVKEITGWVIYSEEENKFNLDIVTGLIRSEILNVGDYDVHLAKIIDSGRNSKLKHVFLYLNI

SEQ ID NO: 181845 - protein, 195 aa, Triticum aestivum
  Clone ID: PAT_TA_76263.pep
PPLLSWSSAEAAQATAAPRKRASSQATSGRTRTSCCGSCAAKTVVLGHLCDDLRVAAVTIGAGPKGDGRTPASPGGATGSSDGHRDGRPRRHCRRPSSESASYDTFDVHINCCHRRDTICSCSSSMLCCCCLLKCCSFSPSSSALCSPPQVASHPRSTAPPITTPPQPPRLVEEVQNRIMRDNREKDPALLSKTT

SEQ ID NO: 181846 - protein, 50 aa, Triticum aestivum
  Clone ID: PAT_TA_76264.pep
GLIYYDTIYMLMEGTQQHILEKNRGLLSRYIYLLLYLRPDIQKENFNINS

SEQ ID NO: 181847 - protein, 152 aa, Triticum aestivum
  Clone ID: PAT_TA_76265.pep
MRALGFSGVPLIAAELELDGALVYHSYLHHAAGGGGGRRSLASGTFCVALQNADPTALQAGLSWACGQGQADCSAIQPGGACYKQNNLAALASYAYNDYYQKGSSTGATCSFNGTATTTTTDPSSGSCVFAGSTMAGGSNSTVPSASPPTSL

SEQ ID NO: 181848 - protein, 157 aa, Triticum aestivum
  unsure (1)..(157): unsure at all Xaa locations
  Clone ID: PAT_TA_76266.pep
CSYGDFFGANLSLFAHHVLLKVLAMIPTMYCAKVAGSEGIYQXSLYVEILAFLAFLLMLFTXIFAAEILFGDSSWTNNLKGNTESPVIIHHTVLIIMSCASIAFTLFLAVTPIKSASSEAETQEWHVHSPKEALDTTHHRVDTYPEYIAHEEIQRIR

SEQ ID NO: 181849 - protein, 92 aa, Triticum aestivum
  Clone ID: PAT_TA_76267.pep
IFHVHETYRDVDYTNKRARALQRGTKSSYASSDSFVLLLPSCIFSFQSYQCLWFNMPQSFNFAPSLSFLHQNLHLPILPRSEVYATLLGRSC

SEQ ID NO: 181850 - protein, 214 aa, Triticum aestivum; identical to SEQ ID NO: 181661
  Clone ID: PAT_TA_76268.pep

SEQ ID NO: 181851 - protein, 210 aa, Triticum aestivum
  Clone ID: PAT_TA_76269.pep
FCKSFDEIFDFFEVEPVGSASIAQVHRARLKSSKTDVAVKVQHPGAEQLMMVDIRNMQAFALFLQKYDINFDLFSATKEMEKQICYEFDFVREARAMERIREFLRVSNKKSPVVVPRVIPGMISREVLVMEFIQGTPIMNLSSEMSKRGIDPAGKLAAMAKQKILTDLTLAYGQMILKDGFFHADPHPGNILICNNTEVALLDYGQVKEM

SEQ ID NO: 181852 - protein, 212 aa, Triticum aestivum
  Clone ID: PAT_TA_76270.pep
MDGIDAELARAQDERRKLEEALAAGAPMAVSSVTFDKDLYGGGGSGSDRFAGYDTSIPASEDDAPEDDSAEPSATNPAVRRLASYTGHAVAAADIPRSEDDDGMPAKRSQRIIDREDDYRRRRLDRIISPQRHDAFASGEATPDPSVRTYADAMRESKVQQEKEHVLREIAKKKKEEEEKAKEKKAAPQAQPAATKRRNRWDQSQDGDAAAG

SEQ ID NO: 181853 - protein, 246 aa, Triticum aestivum
  Clone ID: PAT_TA_76271.pep
ARGISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTASLRFDGA

SEQ ID NO: 181854 - protein, 238 aa, Triticum aestivum
  Clone ID: PAT_TA_76272.pep
VVESALVDLYAKCGSVDYAYRVFEASSVRNTITWNAMIGGFAQNGHAEHAINLFNRMVSEGAKPDYVSFIGVLFACNHTGMVEQGRNYFKSMSKDYGIAPGIEHYNCIVDLLSRVELLEEAEDLINKSPFRDDSSLWAPILGASSTHSNPDVAERVAKKMMELKPQYHLSYVLLENVYRTVGRWEDALEIRRLMRSRKVEKEPGMSWIDVNRSKQHMSNVNGAPSELVASEDIITYDN

SEQ ID NO: 181855 - protein, 140 aa, Triticum aestivum
  unsure (1)..(140): unsure at all Xaa locations
  Clone ID: PAT_TA_76273.pep
CSVALAVVYFRAETVGLCLPCDRHIHNGNTVSFRWRHPPXLCAACRVVDVSPHCGAPLRNWNCDLEEQQYSGLVXGADAVAPRPWNGVGLHWVPSVGELAAIIDVVGDKSVTRATSSVIGGPLAVEGRRLCDHGAAIVVG

SEQ ID NO: 181856 - protein, 144 aa, Triticum aestivum
  Clone ID: PAT_TA_76274.pep
LSWPSLAAAKSASLRVNGVTWQGSSDCLDEIGEITSSGTACSPVFSVISSSDAYSSDSLHPSASSALTRSSQMQTSFKSSPISDAFSEAPSVCISSVMPADECSSGAATVHPSSSSSSSSSSSSSSSSSSSSSFLGLGDVMSVR

SEQ ID NO: 181857 - protein, 185 aa, Triticum aestivum
  Clone ID: PAT_TA_76275.pep
LFSLIFRANKMPEEWRRSILVPIFKNKGDVQSCTNYHGIKLMSHTMKLWESVIEHRLRRMTRVTKNQFGFMPGRSTMEAIFFVRQLMERYREQKKDLHMVFIDLEKAYDTIPRNVMWWALEKHKVPAKYIALIKDMYDNVVTSVRTSDGDTDDFPIKIGLHQGSVCSLRMMWCYSTIVGWGSIGS

SEQ ID NO: 181858 - protein, 248 aa, Triticum aestivum
  Clone ID: PAT_TA_76276.pep
GALAMEHDPTARRNAFLMLCDCSQVLATSYLLANADRFAKWPAPLQMVALGFVRKVHRNLCYKPYNRCIRVLRKRYIEIIISLLSTGTTAVIYDCVWTLLRMSNEPTLIHAAAKTYCQLLTSQSDNKVKLIILDRLHELCTSHRYLMVNFTMDILRSLASHDLDVSRKVLDLVLGLLTTQNVDDVLYYLKKKVFQTPSVLLEMADDYCNMLVQAIHACAMEYPKVAVSVVPILLNFLGCDDVASAYDI

SEQ ID NO: 181859 - protein, 55 aa, Triticum aestivum
  Clone ID: PAT_TA_76277.pep
WTQAPESRHATVDVFLKAASYLDCANQQELPHIASELRRQLPVDLANGNLNSLSL

SEQ ID NO: 181860 - protein, 147 aa, Triticum aestivum
  Clone ID: PAT_TA_76278.pep
CAAACRVPSSPRAPSPSPSEASNEDRAVLEQRRPNKQLPLWEQQSPIEAAAAPFRAAYFRAATSNRSNQAAPLRAAVRNRSASLFKSQSANKAVLPGIQSETGPVSNSVSEFQLLAGTQPLYIWPGGYRGANSRQLVSLQLSNSNSR

SEQ ID NO: 181861 - protein, 78 aa, Triticum aestivum
  Clone ID: PAT_TA_76279.pep
TWRSFLQLSSKCTCKRTQQNKHCRQACSIVVFSQCCRVFIGLCRVHLALIKIGNSSSEHVLCLLIQHVQPAWMGASPQ

SEQ ID NO: 181862 - protein, 79 aa, Triticum aestivum
  unsure (1)..(79): unsure at all Xaa locations
  Clone ID: PAT_TA_76280.pep
KKEMRILMVGLDAAXGKTTILYKLKLGEIVTTIPTIGTDAVRRAAIFCFRFLPVALTLTRPNRMCGGTAGRARMNCFLR

SEQ ID NO: 181863 - protein, 93 aa, Triticum aestivum
  unsure (1)..(93): unsure at all Xaa locations
  Clone ID: PAT_TA_76281.pep
DSPPISPSPGSRRGSPPPPPGSRRRPAPTXLPDPGVAPPPPPPRLRRRPAPPPPPPXSGAAPPPPPPGSWRRFDAHPPPPSLPAPPCFHAPPS

SEQ ID NO: 181864 - protein, 206 aa, Triticum aestivum
  Clone ID: PAT_TA_76282.pep
MLLLLFILYDLMYRSISIYNVGLLGLLLEAHYPVWYYSLQMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTIT

SEQ ID NO: 181865 - protein, 91 aa, Triticum aestivum
  Clone ID: PAT_TA_76283.pep
MPWESNRHPGLSSSVPGFQTRENHFSSKHGDLSISDPRKSSSPVPCDGGSNSETAVSPSFTRSSEALETGWKPRGILVAHLREHRLSVNDI

SEQ ID NO: 181866 - protein, 79 aa, Triticum aestivum
  Clone ID: PAT_TA_76284.pep
YCCYSVLFVLTFLTLLKMLLFCFVLCRPEEPWSLYFQFPSKDAARKYALVKMYEIDITYGSLLNVMVRNGYGSDDNICY

SEQ ID NO: 181867 - protein, 177 aa, Triticum aestivum
  Clone ID: PAT_TA_76285.pep
INGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAIT

SEQ ID NO: 181868 - protein, 177 aa, Triticum aestivum
  Clone ID: PAT_TA_76286.pep
FRNGAPENLAELTTIFDKTHVTVATSAILGEHIEDPTDLFEVEDGNSYLELEDNNDVESNKAPGQKIKEVEKQRAAAIAASPKTKRKQQKNPTVQECRHLAYIMAGSTSVTSSTDVPRGHGIKDVIKLAVQSGAKECSDLFFTATKLFVNVDYRKMFSALETNEGRLDWLNRMHEEM

SEQ ID NO: 181869 - protein, 105 aa, Triticum aestivum
  Clone ID: PAT_TA_76287.pep
EGSDEYCMKHQQCETGTTGRTNNRVKKFKKGKMDTFVASGSVYFLGNIIITLQRTMCIRQEPQDIKHQDKLNMVSTLCYNIIIRIRTTYGYSVLDETIYNTTTRI

SEQ ID NO: 181870 - protein, 170 aa, Triticum aestivum
  Clone ID: PAT_TA_76288.pep
PVIAVVSDAEPAVLGIPVASPAGGVGEEKAPLGAEVAVAVKDEPPVKGDPAAPAADREADAPAAKGVAEKDDEGVRWLKHYSSMHSILVVGDGDFSFSLALATAFGSGEHIVATSYDSYDALKRKYGNAEANITELKRLESTVLHDVDAKLMKLYPSLKMRRFDRIVFNF

SEQ ID NO: 181871 - protein, 81 aa, Triticum aestivum
  Clone ID: PAT_TA_76289.pep
LGWPARMLRLTWLSEEGKKILGVWRQSPRYCFAVMEGFVIGAAQVSCTTPRLKQDKRDNVNLSGILIASPIHDVKYITTKC

SEQ ID NO: 181872 - protein, 86 aa, Triticum aestivum
  Clone ID: PAT_TA_76290.pep
RARCGLRNEGLTYCCPLKKDISKLVITKHGLLTRDMGNCIWQPCFPAGLAAASTGEIMVEKLQDYYYSCRVSGRLTRKNGGKVARL

SEQ ID NO: 181873 - protein, 202 aa, Triticum aestivum
  Clone ID: PAT_TA_76291.pep
MQIPIWGAKQARSSISIHYKWSDWTKFRVEPAEDDISNSSDQIPIWGAKRARNSTSIQTDWRDWANLGDGPAGLIAERLLANDVADYICFRAVCRPWRLCCTDPRTHCILERRFHPLHWIMLRETGGSPRCRFMNMSTGCSRYVHLPELCGHDVFGPTTEGLLVLLDRTTWVVRLLNPLTRQAVDLPPATALMSKSDLKEAS

SEQ ID NO: 181874 - protein, 239 aa, Triticum aestivum
  Clone ID: PAT_TA_76292.pep
RAGLFINNEFVKAVDGKTFEVINPSTEEVICNVAEATEKDVDIAVAAARKAFNGPWRKETPENRGKLLVKLADLFEKNADLLASVEALDNGKAFSMARNVDIPAAAGCLRYYGGWADKIEGKVVDTAPDSFNYIRKEPIGVCGQIIPWNFPILMWSWKIGPAIATGNTVVIKTAEQTPLSAYVACKLIQEAGFPPGVINVITGFGKVAGAAISAHMDVDKVAFTGSTVVGRQIMKAAAG

SEQ ID NO: 181875 - protein, 185 aa, Triticum aestivum
  Clone ID: PAT_TA_76293.pep
LFLCAGRRCHRPHLLALLHISGQGARFSGRPPHLLASTPSTSCPLLLQDCSMVLGGCGNGADGAQADQFNGGSSTGQRQQHGGRPLDWEGNGTANRNGSGNHDASASGSQCSWKDYATALTDAIAKILDPKSALSAIDEVSKFRECQGRFGTRLAQEAAARMEPRDVPALQKCAMRVCSQCVSSS

SEQ ID NO: 181876 - protein, 174 aa, Triticum aestivum
  Clone ID: PAT_TA_76294.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDPKERNNTEYKLETFSAVY

SEQ ID NO: 181877 - protein, 117 aa, Triticum aestivum
  Clone ID: PAT_TA_76295.pep
PAPRVPLGSTPAAVAVPGWGFLPVAADSGWVLPCFGSVRWWYLMGVARVVGRGATRRLMLDDGVRVAVATSDAGSRRRLLLYGRQQWLVRRWVLLVAPVIGAAIPLHQRQRTPRSCG

SEQ ID NO: 181878 - protein, 171 aa, Triticum aestivum
  Clone ID: PAT_TA_76296.pep
MAGDRMSWARLLKWSLSYMDGARPSRDISEEEQRWLAEAVERHMAEDVVGRLREIALLMRTPLSVLEAQGITPEDIEDLLAELQVHVESIDIANDLHSVGGLVPVIRYLRNTNARIRAKAADVVTTVVQNNPTSQQLVMEASGFEPLVSNFTSDPDLTARIKALGALSSLI

SEQ ID NO: 181879 - protein, 179 aa, Triticum aestivum
  Clone ID: PAT_TA_76297.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKMKEKAKVSYDRRKQL

SEQ ID NO: 181880 - protein, 136 aa, Triticum aestivum
  Clone ID: PAT_TA_76298.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRQYREAKKIDKHMYHDMYLKVKGNMFKNKR

SEQ ID NO: 181881 - protein, 217 aa, Triticum aestivum
  Clone ID: PAT_TA_76299.pep
TSPNPPINPPHHTSVIVPSALLALSAFSTLASALPLSSDHVFGQSKGGYKAPLHSLAVDQGIEPVKDGYIVVLKDDANVDLLTTHLALVESAHLATSLASSSSASIDDDMGGLKNVYTSDKLLGYAGTFSEELVDQIREDPMVAFVERDSIVTTMETELGAPWGLARLSHRKTLRLSTFTKYEYDDTAGEGVDVYVVDTGININHVEFEGRASWGKT

SEQ ID NO: 181882 - protein, 140 aa, Triticum aestivum
  unsure (1)..(140): unsure at all Xaa locations
  Clone ID: PAT_TA_76300.pep
AKFKFESFWPKFSHFLDTVDHAWSRPVHSSCAFKRLSIKMACTAKYLKIWSSSLFSDAKIQFHIATEIILRLDIAQESRSLSTPEFNLRXLLKQRLLGLAAIERARKRQASRLTWLKLGEAGTNFFHAKFRSRRRKNYIH

SEQ ID NO: 181883 - protein, 200 aa, Triticum aestivum
  Clone ID: PAT_TA_76301.pep
ARRHVNRLCLAAEVPLVESGTTGFLGQVTVHVKGKTECYECQPKPIPKSYPVCTITSTPSKFVHCIVWAKELLFAKLFGDKNQDNDLNVHSKDGSSSKLDVFERDIDEDLDQYAQRIYDHVFGYNIEVALQNEQTWKNRRRPNPVYIRDTLPEAVKQNGSSRDCSNDHEEPSAMASLGLTNPQEIWTLAENSRVLLEAFK

SEQ ID NO: 181884 - protein, 169 aa, Triticum aestivum
  Clone ID: PAT_TA_76302.pep
PRTGPAEDGQIHHHAFQARSPGRFSISGSGPSPACAPPILVVRQPTRCSCHVPHSCPVAFAWARHGFVLSGGRHFWYSSVSCSSTSPMPLANTASSLRPRSRRRLLFVAAARAPPWRPFMVATLHTLASLSNFPRRCKMAICSPSLEHYFLWRLLLTFRGVSHRPSPST

SEQ ID NO: 181885 - protein, 74 aa, Triticum aestivum
  Clone ID: PAT_TA_76303.pep
CCDILLALADHGIWAHQEEDGKENGELEIASSLLKRIRSLLVLYREHPAGVKRASLCPSPPIKFLLCLKVYVTV

SEQ ID NO: 181886 - protein, 182 aa, Triticum aestivum
  Clone ID: PAT_TA_76304.pep
MHASARLLRRLSSSSSARSLRRLPCHPSPSPPPHPSHLPPLRTVTRALLPHLAAPRFSTISCASTPSLRLGECGAPGTPAIPLAENSEGEEEAESVAARHDTDAFAAVELALDSVVKVFTVSSGPNYFLPWQNKAQRESMGSGFVISGKRIVTNAHVVADHTFVLVRKHGSPTKYKAEVQAI

SEQ ID NO: 181887 - protein, 199 aa, Triticum aestivum
  Clone ID: PAT_TA_76305.pep
QIYAQFEAPAYSLERLFTDKELALATNTAQNATYKYFYQPPQQQQQDSGSNTNATAEPSVDNEARDNALAADGEEFVAAGDAVNTPPAGAPEMERTSSHQVLTRGGARANPLAALSDLATAAAAASGTTAIIPTRDNPFAPVVPNYHAVTRSEKSGAPAPAAVTSLDAENDFELMRRAGSNFPTSTRADDGGDIEMGEA

SEQ ID NO: 181888 - protein, 194 aa, Triticum aestivum
  Clone ID: PAT_TA_76306.pep
DCNKIFNTVYSPLIAALNVVGSLNVSPLKCVKLLIKAGADVKGVGTVSPLITAVNNGLTDCYKCLLEAGADPDVRDDFGHLPIEIAAYNNRREDVEILLPVTSRTPYVRDWSVDGIIRWVKSMPSVENDPMNKMNPADLKLEGSKAYKRKDYATAVKLYSMAADRCPDDATLYSNRCLCWLKMGEGDQALMDAG

SEQ ID NO: 181889 - protein, 156 aa, Triticum aestivum
  Clone ID: PAT_TA_76307.pep
NPVTGRRIPLPPIAFFKKWHDVATVVLSADPGGATEWAAVAAGFPADRIAYYSSVTGAWTPLAFSAAGYAGVEHYRGRFYVAFKNQLCVICELECGAPPAVIPLEHVKGDGGGGGSDDDELVPGSGRSVALDAHLVECDGQLLLVSVRDETDYNSD

SEQ ID NO: 181890 - protein, 50 aa, Triticum aestivum
  Clone ID: PAT_TA_76308.pep
HFRQQFDICFPVPTRNKICLLIDFVCTSDWKETGQTRNTTNCNFCVLPGR

SEQ ID NO: 181891 - protein, 72 aa, Triticum aestivum
  Clone ID: PAT_TA_76309.pep
GSEDYCVGLDLSCLIRSRGQSKNTHGRQGTNGCVHSHRLPETNWHGLCNVRGTLHFKRKGFPCLSGCEDPSL

SEQ ID NO: 181892 - protein, 120 aa, Triticum aestivum
  Clone ID: PAT_TA_76310.pep
ICLQLPVVSGIIHGVHRQGRGVRGRGERVVIPAVAVVLAIVIIAHCWLVVHRASLRLIETSHLDHLTFIRLDGLDLWAPNIRLPSWQPDMPDIGTASSEFSVNYDVEAFSKVEELEVGAA

SEQ ID NO: 181893 - protein, 51 aa, Triticum aestivum
  Clone ID: PAT_TA_76311.pep
NWIVPVPNPCCVIYVAYYHFMEDILNCYALDTYGWLHIKRFCQYMLYIPMD

SEQ ID NO: 181894 - protein, 109 aa, Triticum aestivum
  Clone ID: PAT_TA_76312.pep
APRPRSLRLHLGAEMGLTFTKLFSRLFAKKEMRILMVGLDAAGKTTILYKLKLGEIVTTIPTIGFNVETVEYKNISFTVWDVGGQDKIRPLWRHYFQNTQRLIFVVDSN

SEQ ID NO: 181895 - protein, 48 aa, Triticum aestivum
  Clone ID: PAT_TA_76313.pep
SKCVAATTQCFTLSFVGNSGGNNEPHRTDSIDSGLKYRLLCIIGGVVQ

SEQ ID NO: 181896 - protein, 66 aa, Triticum aestivum
  Clone ID: PAT_TA_76314.pep
SQHMIARADRRAEKYFRRGLRLDWPEGAASRESMKAVWKLPRLQNQNKKTTTKKKKKKKKKKKKKK

SEQ ID NO: 181897 - protein, 66 aa, Triticum aestivum
  Clone ID: PAT_TA_76315.pep
HIYLVSLQTDIAPIQFFYLLRLDPQTRTGSSNNLASLTPSNLYTRVPHTKDTLSNGSFALLQGITS

SEQ ID NO: 181898 - protein, 61 aa, Triticum aestivum
  Clone ID: PAT_TA_76316.pep
APRISLHRRRILVAVGGHPHHRPIRSRASRQVCPTPSSTMPPRRSSSAGHSSAESSKASQS

SEQ ID NO: 181899 - protein, 59 aa, Triticum aestivum
  Clone ID: PAT_TA_76317.pep
EKDNIEQVFRSAIFCLSEEDRGLPAIELMLPLLKRGIAVHHSGLLPLIKELVELLFQEG

SEQ ID NO: 181900 - protein, 63 aa, Triticum aestivum
  Clone ID: PAT_TA_76318.pep
AFSNKWVRDPSAPPTKQAEAQPAPQAAHTSCADPESCRQRISDDFKNEAPLWKLTCYAHLISG

SEQ ID NO: 181901 - protein, 116 aa, Triticum aestivum
  unsure (1)..(116): unsure at all Xaa locations
  Clone ID: PAT_TA_76319.pep
QEHLHAGDTAKIVFAAKWCPSPRSSYDRATLLCEAIARRVFPRDSSPEYLAIPDKHYAYRVRNRLRREVQVPLRKVLELPEVYMSAGKWDELPXRARLASTAMRQYKRRPGCASFF

SEQ ID NO: 181902 - protein, 123 aa, Triticum aestivum
  Clone ID: PAT_TA_76320.pep
DMGKKGFRPTICMFEAKIIALCREQRVDDAIKVLEEELAKNGIVPTVRTYNLLMKGLCDAMQAMKALGYLKKMDTQLGCVARKDTFSILISGLCSEGKFVEAARVMERMVKNQHRPDKNEFSI

SEQ ID NO: 181903 - protein, 141 aa, Triticum aestivum
  Clone ID: PAT_TA_76321.pep
KVTICCTVYDFTDRGKDSPEKERKRQVLMSLVDSIGAAEEPLTEAMMSACVRMFAVNLFRVFPPKVRSGTTTSETEEDEPFFDPSWYHLQVVYELLLRFVTSPFVDPTVARKYVDRSFISKLLDLFDSDDPRERDCLNTVL

SEQ ID NO: 181904 - protein, 82 aa, Triticum aestivum
  Clone ID: PAT_TA_76322.pep
RSPQKSRPLIKLKLTFKSHKKKELRCHRRLHAPPSSLSSSMVRSTYGGGCKRWAGGPCGGCPSEEPAPLLPVARNALMSVVA

SEQ ID NO: 181905 - protein, 133 aa, Triticum aestivum
  Clone ID: PAT_TA_76323.pep
MIQYYTAKDSCYVNSWLLIAVTPGIEELTLQLSMGEYNFPCSLLSNGSGESIRYLHLCGCSFRPTAELPWLKSLTKVRLHAVRFTGDELGCLLCNSSALERLALMHCDEMVCLKIPCMLRRLTYLQVFGCEDL

SEQ ID NO: 181906 - protein, 162 aa, Triticum aestivum
  Clone ID: PAT_TA_76324.pep
PAPPYSSGSEAVLFISVRNILAILLLGVHLCIYDVHVDTGTFLFWICPCRRLIRVVLVGRAIVRLNKVLVYVLHIGIHCFKEEEATKLARAFHRTVDEYGECLSGGWYLYGGRRRGMKLRRRRSGLEPRCSAGGNEVVEFRQGCRGAVVVVEQRQSRERKQM

SEQ ID NO: 181907 - protein, 115 aa, Triticum aestivum
  Clone ID: PAT_TA_76325.pep
SITPNDPKLWCSLGDATNNDDHYKKALEVSNNKSARALRSLARSAYNKNDFYTSKILWESALALNALYPDGWFAYGITAWKDKDLEKALDAFSRAVQIDPENGEAWNDIACLHMI

SEQ ID NO: 181908 - protein, 34 aa, Triticum aestivum
  Clone ID: PAT_TA_76326.pep
LVIGGCYALIRALGALIRANGIDFGRDTRPDLVI

SEQ ID NO: 181909 - protein, 103 aa, Triticum aestivum
  Clone ID: PAT_TA_76327.pep
PYKRQSSDLKSNSMKELSPHINSVMNILESHASYLMTGKELSKLVAFVKGTQFDLVEYLQRERQGSARLENFASALELIGEKLQMDTLHSRLYAEFLLAHMCS

SEQ ID NO: 181910 - protein, 42 aa, Triticum aestivum
  Clone ID: PAT_TA_76328.pep
SLRKQIKKMEVSQHSKYFCEFCGKVNLSMVLSIIVLALIIEC

SEQ ID NO: 181911 - protein, 81 aa, Triticum aestivum
  Clone ID: PAT_TA_76329.pep
LIKGVLAATINKLCALYCPREITAEQVHGWPQRSSPMVNLEQSCSSAVLRPEHARGSRGATATTRLHSPRLPPCPPSTTSR

SEQ ID NO: 181912 - protein, 55 aa, Triticum aestivum
  Clone ID: PAT_TA_76330.pep
FSYAQGQESEVAAAATEEAKKSNNVQRKLEKRQQGRTLDSHIEEQFSGGRLLACI

SEQ ID NO: 181913 - protein, 118 aa, Triticum aestivum
  Clone ID: PAT_TA_76331.pep
MKLDPYDTSNKRIEEATPKQDVCITEKITEKSTPEPEETEMSINAKFRDIQPSSSILQYVEDNLLGRRRLIDIKNAGYNTKLSAPLDNVPFSTRIERDRIEHSVSRNKLDFFAAAKIP

SEQ ID NO: 181914 - protein, 59 aa, Triticum aestivum
  Clone ID: PAT_TA_76332.pep
MLQLVLVASNGISPTTAPPVLSCLVQRPKRARRPPYRLRCDASGHSPFLVAGADRRCGR

SEQ ID NO: 181915 - protein, 168 aa, Triticum aestivum
  unsure (1)..(168): unsure at all Xaa locations
  Clone ID: PAT_TA_76333.pep
PGVTDQTIIFGADVTHPPMRGGGMDVPPSIVAVVATTNGQNNAYRAEVRLQEGRNEIIQDMQGICTSLLRQYRASNNNKPPQSIIFYRDGVSEGQYQEVVSKEVAAIKAACTGIDKNYKPKLTWVICGKRHHIRFFGAPNDIDRTRNLPAGLVVDRGVTHPFXFDFYL

SEQ ID NO: 181916 - protein, 76 aa, Triticum aestivum
  Clone ID: PAT_TA_76334.pep
SPASPSSRPASPRTPSPMRSCGPTSLPHPASASSSSPPSPRVSAPRCSTPAPSPCSFPATPMPQWSTPSPTPAPPA

SEQ ID NO: 181917 - protein, 161 aa, Triticum aestivum
  unsure (1)..(161): unsure at all Xaa locations
  Clone ID: PAT_TA_76335.pep
LCLPGPXNXIXXXPAXVKSXKKXXNXTLWXNYXIPKENPFXKESDLXPEIWALGFRNXWRWSFDSERXFYFYCGDVGXDAYEEVDLISKGXNXXWXXIGGXXXYXXEWXPXGNKXFSSINAXXPAXGXNHFIVKKNLGFXXIXGGYVYRGFRDPCLYGRYL

SEQ ID NO: 181918 - protein, 67 aa, Triticum aestivum
  unsure (1)..(67): unsure at all Xaa locations
  Clone ID: PAT_TA_76336.pep
TTARRASSSPWSSGSNRERCASAERPCSSSSSTTAPTTTMRRDMAICGLICIIIVIIFSAPIVXWXG

SEQ ID NO: 181919 - protein, 60 aa, Triticum aestivum
  unsure (1)..(60): unsure at all Xaa locations
  Clone ID: PAT_TA_76337.pep
HKFTNNFKQPPXQIHIYHPPTTKQKTTLNXEXDPQLFKKLLHKKPIVIXHFHKKPXPVPE

SEQ ID NO: 181920 - protein, 57 aa, Triticum aestivum
  unsure (1)..(57): unsure at all Xaa locations
  Clone ID: PAT_TA_76338.pep
NLKIARAFFEKHFRXHLEPLQXTLXXXALTYLKQXFLYSXIXXXGRLSFXLLGQKVN

SEQ ID NO: 181921 - protein, 59 aa, Triticum aestivum
  unsure (1)..(59): unsure at all Xaa locations
  Clone ID: PAT_TA_76339.pep
XFQTTTQTNTYIKYIXQTXKYXXXXNHTYFKSKQILLHFSLLNXNYXQTKYNTSFNTXL

SEQ ID NO: 181922 - protein, 77 aa, Triticum aestivum
  unsure (1)..(77): unsure at all Xaa locations
  Clone ID: PAT_TA_76340.pep
DMHACVHGRRRVPVRTKTSMSRSKQRRLARSFTCXGXGLMQRRTCRWLCSGLXITXXCHCFGCSSSSSLXXVGXXFC

SEQ ID NO: 181923 - protein, 55 aa, Triticum aestivum
  unsure (1)..(55): unsure at all Xaa locations
  Clone ID: PAT_TA_76341.pep
TRWMDGSIIXMMHXXXXCXIDXQXSSSXTRXHPXSRXTQXKXXKVKPGCNLMMLL

SEQ ID NO: 181924 - protein, 93 aa, Triticum aestivum
  unsure (1)..(93): unsure at all Xaa locations
  Clone ID: PAT_TA_76342.pep
TLVSGRXLTSQXITHXFXPGXANSQXSFXPYTXSXXXXAQQSFGKSSGPHRXQHQSGAKXXQPRNXICHYYXQEVXXXEXXAXKVNFXXYXPF

SEQ ID NO: 181925 - protein, 177 aa, Triticum aestivum
  unsure (1)..(177): unsure at all Xaa locations
  Clone ID: PAT_TA_76343.pep
PXFFGGFALGGCXSGARFGXFSXLLVAFFFAXXPPXGVAVGAGVASFYXAXXPGXLVVGGLLXSVSSGXLXXXALVGLXAAXFLGRGVGCXPGLXVCXXVALFVGAXAXSXLAVWAWCRWFLGLGGCLAFAARPVAWLPVGWGGGLFLSLSVLLFGLLVVLGRVSSFGHGGGGPSLG

SEQ ID NO: 181926 - protein, 68 aa, Triticum aestivum
  unsure (1)..(68): unsure at all Xaa locations
  Clone ID: PAT_TA_76344.pep
NTXGXXXKTLFXXAXGIYVXWSRXTDXNTVPSCYXETPPIMVDXRWAFXGNXSKSDSPDRHSXXSXQH

SEQ ID NO: 181927 - protein, 56 aa, Triticum aestivum
  unsure (1)..(56): unsure at all Xaa locations
  Clone ID: PAT_TA_76345.pep
TSTPKRNXXETRKTQVPXXXKRXAXPEEKPGPRKPNKDTXKRDAQTGHSPEGRXXR

SEQ ID NO: 181928 - protein, 54 aa, Triticum aestivum
  unsure (1)..(54): unsure at all Xaa locations
  Clone ID: PAT_TA_76346.pep
VLYMCSGVQPNKSGWSINRNIYISLFIFKEIFXXYTIYKXWGNYRVVHGPLATP

SEQ ID NO: 181929 - protein, 66 aa, Triticum aestivum
  unsure (1)..(66): unsure at all Xaa locations
  Clone ID: PAT_TA_76347.pep
KVNGRLYIQISQNLEHIRLHKRKLLHRQLMHAWASNGNTXXVXXPTICMYVHKKIFTISTHAGAYF

SEQ ID NO: 181930 - protein, 63 aa, Triticum aestivum
  Clone ID: PAT_TA_76348.pep
AEESAELSCPAYVGVGQYSNLEDEYFFPAMPVVEKRIAQGGVRLAAILNRIFSGENNSRLQSL

SEQ ID NO: 181931 - protein, 94 aa, Triticum aestivum
  unsure (1)..(94): unsure at all Xaa locations
  Clone ID: PAT_TA_76349.pep
LTTEASESNVSALGDDAENHQLSALGNDEEKQLPKHKRQMKSADQANEEQTAMMELQEAFLSLTLVICXELISADDFDDVARKVAPAEGGFVAX

SEQ ID NO: 181932 - protein, 67 aa, Triticum aestivum
  unsure (1)..(67): unsure at all Xaa locations
  Clone ID: PAT_TA_76350.pep
PXKTTFYXCXSTIXPISSSXFFFXXNKQXXQPLKXVXQKTTXEISYXILLSXSHLLEQLKTIPXPLL

SEQ ID NO: 181933 - protein, 78 aa, Triticum aestivum
  unsure (1)..(78): unsure at all Xaa locations
  Clone ID: PAT_TA_76351.pep
HPTRWELSHMXEXRGGXNSLLISRRRPRRYIHSLPVALXXPCEPLXXAALXRXSLELICXSCLAGWLNSIGAVLTNIR

SEQ ID NO: 181934 - protein, 48 aa, Triticum aestivum
  unsure (1)..(48): unsure at all Xaa locations
  Clone ID: PAT_TA_76352.pep
TWNVXVLLLIFHIVSATTNCGXPNIXLSFNLAYKXLQWTMMIAWFXXR

SEQ ID NO: 181935 - protein, 104 aa, Triticum aestivum
  unsure (1)..(104): unsure at all Xaa locations
  Clone ID: PAT_TA_76353.pep
RXXXGSXEFDXXPPVXXRYITQIPPPXPXPPXAPXPXXHPPXPRQPXPXPTPFSTXNXDXIXVVWMXPPXXHXXXCXXEPXXLNXXEXSXSXKXGGHPRVGPPV

SEQ ID NO: 181936 - protein, 46 aa, Triticum aestivum
  unsure (1)..(46): unsure at all Xaa locations
  Clone ID: PAT_TA_76354.pep
XXXXXRSLIXQTXIKXXDFGGNMLKELQXNHXGXGXREASKRRCTP

SEQ ID NO: 181937 - protein, 89 aa, Triticum aestivum
  unsure (1)..(89): unsure at all Xaa locations
  Clone ID: PAT_TA_76355.pep
QVPETAFXPNTTXEXXRXXQDLAGXEEPQGHQHQEXSXXXRARDXXXDHYYXKKIXLPXXXXXQLXGXGFPXVNLCLXSXGXXXXLQGS

SEQ ID NO: 181938 - protein, 82 aa, Triticum aestivum
  unsure (1)..(82): unsure at all Xaa locations
  Clone ID: PAT_TA_76356.pep
CLEDVVHEIPTVXPXFRETAXFXXPFKLKCPERRLQMKKNPFKDGGDFGHPWDKIXELXXXXXGQVPSQWPRYSLGFVPPRR

SEQ ID NO: 181939 - protein, 100 aa, Triticum aestivum
  unsure (1)..(100): unsure at all Xaa locations
  Clone ID: PAT_TA_76357.pep
NTEGQCLCLKGQTILNXRIXSVXQIMKEFYVYVGFFLNSPXEFVRECSXPXPRKLKFXNXQGKFWDVNYVYYSECXGGGLSGGWGKFFLXNNSEKFHVCV

SEQ ID NO: 181940 - protein, 56 aa, Triticum aestivum
  unsure (1)..(56): unsure at all Xaa locations
  Clone ID: PAT_TA_76358.pep
RXTTTNYTTHSIXQMKQXXXNYRGRGGSXAPPPASKVMLDPITTXVMLTXLLFXXD

SEQ ID NO: 181941 - protein, 57 aa, Triticum aestivum
  Clone ID: PAT_TA_76359.pep
TLTLEELKEGLRINGHAVPETEIQMLLEAGDIDGNGTLDTDEFVTVLLHIKKMSNEE

SEQ ID NO: 181942 - protein, 50 aa, Triticum aestivum
  unsure (1)..(50): unsure at all Xaa locations
  Clone ID: PAT_TA_76360.pep
ALSRFPXVLRWXPLIXSRDPXFXXARYSSRYSXXKRSAAKRLSALFKSRD

SEQ ID NO: 181943 - protein, 80 aa, Triticum aestivum
  unsure (1)..(80): unsure at all Xaa locations
  Clone ID: PAT_TA_76361.pep
SWAHLLXYLYXXSCGPPLYNXTNXXVSSSQLVXWNSWXXACLLPXKXXNIQNXSSXXPXPRGXXIXFXXAXLXGEXFSVX

SEQ ID NO: 181944 - protein, 51 aa, Triticum aestivum
  Clone ID: PAT_TA_76362.pep
TYWRPYYTRRTRERQHARLQLAYGRDAEIKSAVAKHACLQHDMLYRSYWCP

SEQ ID NO: 181945 - protein, 35 aa, Triticum aestivum
  Clone ID: PAT_TA_76363.pep
PNAYVRIIGFDNMRQVQCVSFIAFKPPGCEESGKA

SEQ ID NO: 181946 - protein, 89 aa, Triticum aestivum
  unsure (1)..(89): unsure at all Xaa locations
  Clone ID: PAT_TA_76364.pep
HLKNVLLSSMHVXNRVAIYTSLDYETGRTNCNGPLXNPQYKHTQITVTRDLKNKSTFLSVNASRRQRTACPVPQHCTCAPMGWQSKSKK

SEQ ID NO: 181947 - protein, 54 aa, Triticum aestivum
  Clone ID: PAT_TA_76365.pep
HDEEWGVPVHEDELLFEMPTLSGVQVGADWASILRRRHIYREAFSGFDVDAVAK

SEQ ID NO: 181948 - protein, 81 aa, Triticum aestivum
  unsure (1)..(81): unsure at all Xaa locations
  Clone ID: PAT_TA_76366.pep
RPHHRIRQHAPARTCVSFXXFXPPRLXXXRXGLNXSLTXGHIIKCHCGXCPTLTIALGXPXPFIFLVXSXXYVXVHVHXPA

SEQ ID NO: 181949 - protein, 48 aa, Triticum aestivum
  Clone ID: PAT_TA_76367.pep
SRLSWDYQFIKKDYKYFVIITGTCTNGRSRLHETKASRKSLAAKATHV

SEQ ID NO: 181950 - protein, 143 aa, Triticum aestivum
  unsure (1)..(143): unsure at all Xaa locations
  Clone ID: PAT_TA_76368.pep
NXXPXCLAQSPQLYKQMSIXGGFGPLFXVGPXFXAEKSNTHRHXCXFXGXDAXXXIKXXXFXVXDIXXXXFVAIFKXXXENXQKXXXTXXRQXPFEPLKKFFFFFFFFFLSEYIDRLYKYIMCMCIYIATDCIHIRACFLECW

SEQ ID NO: 181951 - protein, 71 aa, Triticum aestivum
  unsure (1)..(71): unsure at all Xaa locations
  Clone ID: PAT_TA_76369.pep
RHCXPSIRMTIGRKAYRLSLAIKPXACYSEHYDGYTLATNQRVPIARNTPPPVPPSHXFXPRXXKXLLSKF

SEQ ID NO: 181952 - protein, 64 aa, Triticum aestivum
  unsure (1)..(64): unsure at all Xaa locations
  Clone ID: PAT_TA_76370.pep
TNSSMSVLQFPIDTGYXXIEYISTYVKYINIREGLVNVKYSLYEEERLSVRVFQDPGLYVATGA

SEQ ID NO: 181953 - protein, 56 aa, Triticum aestivum
  unsure (1)..(56): unsure at all Xaa locations
  Clone ID: PAT_TA_76371.pep
SYYSFFSHFHSGFDLIKEHVQPRGVGAGLNCHLPCEPNLEVPSYPPAALSWRPIXT

SEQ ID NO: 181954 - protein, 134 aa, Triticum aestivum
  unsure (1)..(134): unsure at all Xaa locations
  Clone ID: PAT_TA_76372.pep
REAIRYASRIPKQIQARRERARACRQNLTPAEREKINAQRREKRQQMALDERNXSQQARRQSLTLDERQEINARRRARKQSLRLEERQALLAQCNTSYASKRDALCRDSVALQCPTGSLMGHPSSSSYVFSHPS

SEQ ID NO: 181955 - protein, 43 aa, Triticum aestivum
  Clone ID: PAT_TA_76373.pep
FPIWFISFDLFIMFKFCYCILKGPLIMYVSCPLLHARASMAKL

SEQ ID NO: 181956 - protein, 77 aa, Triticum aestivum
  unsure (1)..(77): unsure at all Xaa locations
  Clone ID: PAT_TA_76374.pep
XAAXXXRXLVXPXXGXFFWRGVFLPXSXSXXXXXCXSXGVWXVXSASAACGSFPGFXXXRVPRXLPXCRXGXGVXXV

SEQ ID NO: 181957 - protein, 49 aa, Triticum aestivum
  unsure (1)..(49): unsure at all Xaa locations
  Clone ID: PAT_TA_76375.pep
SMEAYSVKVXLTXXXIMLQEIDCLRHNTTAKTDVEQYVWSISTIAKRPP

SEQ ID NO: 181958 - protein, 93 aa, Triticum aestivum
  unsure (1)..(93): unsure at all Xaa locations
  Clone ID: PAT_TA_76376.pep
HKTPVPPQSPRMSRLGSFSFTXFSRARAXSIAGPWRHHVMREAPIPXPGWPASHGVRRAAAARPPSHLIAPSLSXWPSILPFISPLISLFXHK

SEQ ID NO: 181959 - protein, 79 aa, Triticum aestivum
  unsure (1)..(79): unsure at all Xaa locations
  Clone ID: PAT_TA_76377.pep
PSHGCEDLPWXKDWXQLXAQXEGXTQWXXXLXFGGSGSSLVPAGVGGGAVGFLVSLCWVCVCXXXCWGCVXWFVWGGCV

SEQ ID NO: 181960 - protein, 65 aa, Triticum aestivum
  unsure (1)..(65): unsure at all Xaa locations
  Clone ID: PAT_TA_76378.pep
ASXSAAXISXNCXLNCLWALDAIEVSSXXWXWYMVLLLLCXGHYCSXGGRGXMPAXGFXGQXTPC

SEQ ID NO: 181961 - protein, 66 aa, Triticum aestivum
  unsure (1)..(66): unsure at all Xaa locations
  Clone ID: PAT_TA_76379.pep
XRXETNXXXLLKDSTXQXHLSXQXLQXVDXSXTITXXXXXTXGIXHHXHXXPAPXXRXFRTASLFC

SEQ ID NO: 181962 - protein, 84 aa, Triticum aestivum
  unsure (1)..(84): unsure at all Xaa locations
  Clone ID: PAT_TA_76380.pep
SXAPXSXVVFXAARXRXXXARXVLGXRGXAPXSPXXWPXARGSGGRRSPVXACRGVXCGSCXCRRRCLLGGGAARAXVLLSFGA

SEQ ID NO: 181963 - protein, 77 aa, Triticum aestivum
  unsure (1)..(77): unsure at all Xaa locations
  Clone ID: PAT_TA_76381.pep
TFVXKAXIXXACMXXXXLQXQRSIXXGAPAWXXXYLYFXDLFLXVNLXXDMXNSCYSXVDXCXAXFXCAIHXFAWLL

SEQ ID NO: 181964 - protein, 59 aa, Triticum aestivum
  unsure (1)..(59): unsure at all Xaa locations
  Clone ID: PAT_TA_76382.pep
CLNYDKYWFAPICCLSVXXXXIYVYKXFXAXXFXXWPGWXPTAWPMAXQLLAXLAXSGS

SEQ ID NO: 181965 - protein, 118 aa, Triticum aestivum
  unsure (1)..(118): unsure at all Xaa locations
  Clone ID: PAT_TA_76383.pep
PAPSLFPXLXRXLWXXGVLLCAAAPRXGRSLXVSARXXRGGVGPXXVVXLXFSVRGXXSSXFVGWVPXXVRXXVCGFPXRGLSLASXFXGXSXSIXXVFRRVGGXFPAXFGGXAFLPW

SEQ ID NO: 181966 - protein, 73 aa, Triticum aestivum
  unsure (1)..(73): unsure at all Xaa locations
  Clone ID: PAT_TA_76384.pep
LLLPSGKKSLQEXXSYEKHPVSSNCXMQNGLAKPQLLLQLLENGLYVRHAVIGAVCSFLVTPSLSATPSKLRV

SEQ ID NO: 181967 - protein, 61 aa, Triticum aestivum
  unsure (1)..(61): unsure at all Xaa locations
  Clone ID: PAT_TA_76385.pep
HHPRRTLIPQHLHEQGRNRSRIRYLCKHLGQLQDQNLIHERMAICGVKXLRYDGLNGSTAV

SEQ ID NO: 181968 - protein, 76 aa, Triticum aestivum
  Clone ID: PAT_TA_76386.pep
TRRTSSPTSPKTTRTNLRGKASLMQRTSRHILPTSRRILIMGRDTNLNFGSTAQNLYGCIYLLSANLMVLQVFLHS

SEQ ID NO: 181969 - protein, 71 aa, Triticum aestivum
  unsure (1)..(71): unsure at all Xaa locations
  Clone ID: PAT_TA_76387.pep
XPLXGLXVSVXVXPPGXXPLXFPRPPACRVALFFPXPCXXLXXPPRVFXXGFXXRVRWFXSXVXPXFVFCG

SEQ ID NO: 181970 - protein, 81 aa, Triticum aestivum
  unsure (1)..(81): unsure at all Xaa locations
  Clone ID: PAT_TA_76388.pep
YGIPRYGHILGETGTHHHSXKXVXSPIVIXGNXXEXXXLESPXRXXGRXDLQLPXNSRWDIXRKXLYXVPXSSSNLKRIXN

SEQ ID NO: 181971 - protein, 117 aa, Triticum aestivum
  unsure (1)..(117): unsure at all Xaa locations
  Clone ID: PAT_TA_76389.pep
SWRPGQVLFSXIEFXHGRKGIQYDRLXXXYFLISWNSGGYRLAGXXEWXGXIXRXTDWHMXXXXFGRTSGGAXVIGFPAAGIGGGXMAXPGQFPPIGXXITIHWXAVYNXWXGRNLG

SEQ ID NO: 181972 - protein, 75 aa, Triticum aestivum
  unsure (1)..(75): unsure at all Xaa locations
  Clone ID: PAT_TA_76390.pep
LKALYFGGVYDTWALREEMAMCKISDVSELYRPGGQVCMVLKRGGNFXGEDTGAGGSDSEVAARXXXXGGVXTPA

SEQ ID NO: 181973 - protein, 84 aa, Triticum aestivum
  unsure (1)..(84): unsure at all Xaa locations
  Clone ID: PAT_TA_76391.pep
IPXYLSSLHLNLSKSYPPYHPYHXPSHPIHRXTXLSSTXXLHFLLLYRFFFHIHYITLISIYIYHLIFIYLYQHFXIXIIYINI

SEQ ID NO: 181974 - protein, 81 aa, Triticum aestivum
  unsure (1)..(81): unsure at all Xaa locations
  Clone ID: PAT_TA_76392.pep
RYGWKGLGGXXYGGRGGXGQLXSRLXWXGXGXQKGAXFNVKKXGYXXXENDEKIKKKNGXRKTKASXXNKLXVARXEVVVG

SEQ ID NO: 181975 - protein, 77 aa, Triticum aestivum
  unsure (1)..(77): unsure at all Xaa locations
  Clone ID: PAT_TA_76393.pep
RHXIXXXLVKYTVXYQXXSHAGLSXSLLHDRVXGXVIXISXGXVLHHILXGXVXGQXYALARLVIXXGRPXXGAVLP

SEQ ID NO: 181976 - protein, 87 aa, Triticum aestivum
  unsure (1)..(87): unsure at all Xaa locations
  Clone ID: PAT_TA_76394.pep
LTRAGRGXXXSEXELDGPXRXXXYKLXXHLKXLCXFXXXLSGSVRXTTQRAXXGMASQMPPYSEQHPIYSLNXTKXFPDXXRXPLKX

SEQ ID NO: 181977 - protein, 89 aa, Triticum aestivum
  unsure (1)..(89): unsure at all Xaa locations
  Clone ID: PAT_TA_76395.pep
STSMTLPLYSDCVHPXIPHLPVIXYXESLRXXXTAXLMAKWIXHVMDGGXRLPSVREMERDVLEWEKFMXTTLETISRRSXIGIVHICT

SEQ ID NO: 181978 - protein, 78 aa, Triticum aestivum
  unsure (1)..(78): unsure at all Xaa locations
  Clone ID: PAT_TA_76396.pep
VNHERNCSTHDVPWPICARQNNQAAAAPLWTRFLPLDLIVVCKSSKSCRPHSIAQSRAARGLXRACETHMIXSSFDHR

SEQ ID NO: 181979 - protein, 35 aa, Triticum aestivum
  unsure (1)..(35): unsure at all Xaa locations
  Clone ID: PAT_TA_76397.pep
LCSGYSRNLNKRCFGSVANGSXTLYKYIYTLNKME

SEQ ID NO: 181980 - protein, 70 aa, Triticum aestivum
  Clone ID: PAT_TA_76398.pep
HHLNPTICYKHISSSPSLPNHLQCYSGPGVKTVKHDQTLEIYSSDAPSVNMDFSVSYVIKMRPTLGTTLQ

SEQ ID NO: 181981 - protein, 64 aa, Triticum aestivum
  unsure (1)..(64): unsure at all Xaa locations
  Clone ID: PAT_TA_76399.pep
EVARIEDRDQDRGGRRXRGADKTSRRGGSIDRTGPMSCCGRRDCGMRDPAARVRXTAAEGXXDV

SEQ ID NO: 181982 - protein, 97 aa, Triticum aestivum
  unsure (1)..(97): unsure at all Xaa locations
  Clone ID: PAT_TA_76400.pep
LDGNTLNXFGNSIPINLIXAVVAEVVLVGGAEYTMENILIQMATDNRLVQPPEGFYRTCRRVPPRGSRVSQHLVTVFGVLHVLVCLVSLLLGSPCRA

SEQ ID NO: 181983 - protein, 81 aa, Triticum aestivum
  unsure (1)..(81): unsure at all Xaa locations
  Clone ID: PAT_TA_76401.pep
LTDESRMSSSIFTVNRTHPQAQCPPLLFLTTTVSENATTLAAQVSLLCVLRYRLAELEEXSASDALDELAXERXAASQADV

SEQ ID NO: 181984 - protein, 70 aa, Triticum aestivum
  unsure (1)..(70): unsure at all Xaa locations
  Clone ID: PAT_TA_76402.pep
KXVLHDXNXHLXTNXDSXXPKXKXPSQXIXSSMKXLCDIXGPNXRNEXFRSSTTPXSAQERTEIQXRXXK

SEQ ID NO: 181985 - protein, 58 aa, Triticum aestivum
  unsure (1)..(58): unsure at all Xaa locations
  Clone ID: PAT_TA_76403.pep
TGWTRXRPRXXTACSGWSCPRXXXRXARXSSXSTSXRQGHAQXSRHXIAESSRVSXVX

SEQ ID NO: 181986 - protein, 68 aa, Triticum aestivum
  Clone ID: PAT_TA_76404.pep
NIILGLGSALRYLHGEWEQCILHGDIKPSNIMLDSSLSTKLGDFGLARLIDHGARSVHTTKAVLGTVG

SEQ ID NO: 181987 - protein, 101 aa, Triticum aestivum
  unsure (1)..(101): unsure at all Xaa locations
  Clone ID: PAT_TA_76405.pep
SYGVVLLETLMGSRMTGQRTVDGKGRLQMSQVGQAXRQVVASGDVMXLVDGRLDGRXNPRQAMEMXKISXSCIMEERGSRPAMDDIFKALXACXXXDEHPA

SEQ ID NO: 181988 - protein, 89 aa, Triticum aestivum
  unsure (1)..(89): unsure at all Xaa locations
  Clone ID: PAT_TA_76406.pep
LRXLXVQXMASPACPXRRPALLLVVVIXARSSIVLFGXXXXPSVYXYTAVSQCSXFHQXVLPRXGVLSXFRLXLTFXXEXISXRSXPGN

SEQ ID NO: 181989 - protein, 63 aa, Triticum aestivum
  Clone ID: PAT_TA_76407.pep
EETHKSPSLSLSHKQTNKPLLSPIPISPRRSNYKLEEEEEESEEEEDGVCGASDDPGDGRRGV

SEQ ID NO: 181990 - protein, 76 aa, Triticum aestivum
  unsure (1)..(76): unsure at all Xaa locations
  Clone ID: PAT_TA_76408.pep
TFSVLLXMXRVCXIXECSTPLMLKAILRSSXMLPRGEHYGSTAQASXXGGACXKKENAXGXQPPRWPXXIPKSGPC

SEQ ID NO: 181991 - protein, 77 aa, Triticum aestivum
  unsure (1)..(77): unsure at all Xaa locations
  Clone ID: PAT_TA_76409.pep
HQFLPRHPSLHXSKXVVGVKVXXAETQEENLGMQSXVAGRXGKXDILSTTTTSXXTXSDXSXGXFQNYKPLRNVRDS

SEQ ID NO: 181992 - protein, 75 aa, Triticum aestivum
  unsure (1)..(75): unsure at all Xaa locations
  Clone ID: PAT_TA_76410.pep
CRTARDWRPVSFLRSLFLLRHRKAVEQLRPGRTKPIXGGGSTGPSHPHVQLSSSASSPSCAFHRCLVPRAYTYRG

SEQ ID NO: 181993 - protein, 123 aa, Triticum aestivum
  unsure (1)..(123): unsure at all Xaa locations
  Clone ID: PAT_TA_76411.pep
XPHPPPLIPPYXPPPFPISPPATFXKPXPSPPLPYYPTXQKXXXPPXXLIXVTPXXPNHXFLKPPPFNFNTTHYXXNXPXXPFFPPHXPPPNSITXLPPHXQYYXXPTQKKIHKNNTTKNDKL

SEQ ID NO: 181994 - protein, 81 aa, Triticum aestivum
  unsure (1)..(81): unsure at all Xaa locations
  Clone ID: PAT_TA_76412.pep
LELGIVVHSVIIGISLGASQDPDTIKPLVVALSFHQMFEGMGLGGCIVQAXFKARSIVTMILFFCLTTPVGIAVGFGISRV

SEQ ID NO: 181995 - protein, 63 aa, Triticum aestivum
  unsure (1)..(63): unsure at all Xaa locations
  Clone ID: PAT_TA_76413.pep
HYNHINKTKPFQTIXLFKYSIKSTXXLXFFXPXNTIXIPKIYLXRHHTNXIPXTSIXXIYIXX

SEQ ID NO: 181996 - protein, 44 aa, Triticum aestivum
  unsure (1)..(44): unsure at all Xaa locations
  Clone ID: PAT_TA_76414.pep
TPSILSTSXPTNINLTSISSFKKKFFLKIFNXYNXKLXHXYFLF

SEQ ID NO: 181997 - protein, 57 aa, Triticum aestivum
  unsure (1)..(57): unsure at all Xaa locations
  Clone ID: PAT_TA_76415.pep
PGXLIKFYXXKXNPINNXCXYFLISSIPVFIXCXXQXXXXIXXXLNELPYXFVSXWP

SEQ ID NO: 181998 - protein, 80 aa, Triticum aestivum
  unsure (1)..(80): unsure at all Xaa locations
  Clone ID: PAT_TA_76416.pep
LFAXAXSSLXXAGLLGNXDXLSWLSPXAXVLLSXLQLCYLXLLIYYTYLSYWGKKKIXSSLLADLFSLSVVAXLLFWISC

SEQ ID NO: 181999 - protein, 82 aa, Triticum aestivum
  unsure (1)..(82): unsure at all Xaa locations
  Clone ID: PAT_TA_76417.pep
LRNSILDLTTFLLIIPSFVNQIQLTKFLCFLITRISTLFLCLFLHIIRTKHALKXXRINTIINIFLMRNIRSMIXKTHFPTM

SEQ ID NO: 182000 - protein, 83 aa, Triticum aestivum
  Clone ID: PAT_TA_76418.pep
RMKEEERKEKREAWWHGSSFWSPPGRKTRVLHSTDCEAQEVSMKGGGSVRAYHQNHKVHRIYKCNISITVGSTSFSCWCVIKA

SEQ ID NO: 182001 - protein, 69 aa, Triticum aestivum
  Clone ID: PAT_TA_76419.pep
KIIADALESQGLVDSHPQDYLNFYCLGRRELAATPEASLCNDNSALGMAQKHRRFMIYVHSKGMVVDDE

SEQ ID NO: 182002 - protein, 67 aa, Triticum aestivum
  unsure (1)..(67): unsure at all Xaa locations
  Clone ID: PAT_TA_76420.pep
YSVVDLXSARFGIVDQSIIYSVPFLIEVRSRCFSFLYKXGFCKYVYAHGWCNYIDRPAIRTGCGPGA

SEQ ID NO: 182003 - protein, 55 aa, Triticum aestivum
  Clone ID: PAT_TA_76421.pep
TICRFDDPACHGDYQFIKKDYKYFVIITGTCTNGRSRLHETKASRKSLAAKATHV

SEQ ID NO: 182004 - protein, 59 aa, Triticum aestivum
  unsure (1)..(59): unsure at all Xaa locations
  Clone ID: PAT_TA_76422.pep
QXKXXXXAACRAXXQKXEKXKKXXPVPAIAERERGRASLYQQASLAFEGXGRLKLARLE

SEQ ID NO: 182005 - protein, 103 aa, Triticum aestivum
  unsure (1)..(103): unsure at all Xaa locations
  Clone ID: PAT_TA_76423.pep
PGPLLRADAVVLKLYEDKSIQDNIEAIVKAIPKLHQKMKVMKRKKVEAMVGQNVWNVDCLRDQKRLAPGSSPSTEXIQEVNAAVNRLAAGVTCVVNLVKLSSR

SEQ ID NO: 182006 - protein, 34 aa, Triticum aestivum
  unsure (1)..(34): unsure at all Xaa locations
  Clone ID: PAT_TA_76424.pep
LATKXLRARMXVCINSSGFHTFHRWXCLXSYAVV

SEQ ID NO: 182007 - protein, 159 aa, Triticum aestivum
  unsure (1)..(159): unsure at all Xaa locations
  Clone ID: PAT_TA_76425.pep
NKMIREXPITNPVYLMLGTSFGSSAKGTGLKALEFALSICDSVDMYGFTVDPGYKEWTRYFSESRKGHTPLHGXRAYYQMMECLGLVKIHSPMRGDPGRVVKWLPTKDIIEAARVASXKLLKRPXAGSVDPLRTCTMIKKRKNGKAPNRFGRDAAMNLR

SEQ ID NO: 182008 - protein, 152 aa, Triticum aestivum
  unsure (1)..(152): unsure at all Xaa locations
  Clone ID: PAT_TA_76426.pep
MPYLELSLKRSRSTTEGADAIQEEQRNVVRESDLSAFTRYNTCSFSNQGGAGFVGSCSPNGNSSKAAKTDAAQMKQGSNGSSNNNDMGSTTKSVMTKPGGNNKVSPINGNTHTSAFHRVQPWTPAXTTGKDKVDDVSKKNAAQSRSSERQWW

SEQ ID NO: 182009 - protein, 55 aa, Triticum aestivum
  unsure (1)..(55): unsure at all Xaa locations
  Clone ID: PAT_TA_76427.pep
TICRFDDPACHGDYQFIKKDYKYFVIITGTCTNGRSRLHETKASRKSLAAKAXHV

SEQ ID NO: 182010 - protein, 50 aa, Triticum aestivum
  unsure (1)..(50): unsure at all Xaa locations
  Clone ID: PAT_TA_76428.pep
PXAXXFAXPXAAXGNSITVVRPRCPXKDXSXPXPLSPEVXKLSXGXEEVS

SEQ ID NO: 182011 - protein, 59 aa, Triticum aestivum
  unsure (1)..(59): unsure at all Xaa locations
  Clone ID: PAT_TA_76429.pep
TXXSPPXXGAAXVMHTQIIIHLXARNTIIXSXLINKPXXXLXXSLFYXLXXTXXIXFLX

SEQ ID NO: 182012 - protein, 44 aa, Triticum aestivum
  Clone ID: PAT_TA_76430.pep
MARLNSKAVVSAVVLAAVVLMMAGREVTALSCGQVDSKLAPCVA

SEQ ID NO: 182013 - protein, 63 aa, Triticum aestivum
  unsure (1)..(63): unsure at all Xaa locations
  Clone ID: PAT_TA_76431.pep
TTCFLHSDLHNGXPSTTQFKEKLPWFLDALPSSDCSKGGKGXYSTSLDLSGYEXXNIQASAXR

SEQ ID NO: 182014 - protein, 61 aa, Triticum aestivum
  unsure (1)..(61): unsure at all Xaa locations
  Clone ID: PAT_TA_76432.pep
PSMKGXPPXTCSKNAVPFFXWSDGQISRYXXXXIXRVMIXXKEFRRQPMIILSRNXEEISV

SEQ ID NO: 182015 - protein, 100 aa, Triticum aestivum
  Clone ID: PAT_TA_76433.pep
AEMQPAIMWTTIHVQNMVQITDARGTKSMQGQGFHPKFTHHFISLVSIKDQGIGSRFFRLDRRSSLVFETTMVWRPALHGEPQQHFCPRKHKKRCIPMHG

SEQ ID NO: 182016 - protein, 60 aa, Triticum aestivum
  unsure (1)..(60): unsure at all Xaa locations
  Clone ID: PAT_TA_76434.pep
XQKRKNKXNQIKLTKEXKNPDXGGXXFXLNQTHAXSXTXFXDVXQLSFKPPFSFFFPFXP

SEQ ID NO: 182017 - protein, 56 aa, Triticum aestivum
  unsure (1)..(56): unsure at all Xaa locations
  Clone ID: PAT_TA_76435.pep
LKKXLXITSKXKKTKHYFTNXSYNSTINYQQXYXPXXTTXXYLNHNHTNQIPTTTI

SEQ ID NO: 182018 - protein, 66 aa, Triticum aestivum
  unsure (1)..(66): unsure at all Xaa locations
  Clone ID: PAT_TA_76436.pep
CVCXVCXXXCWVLLSPGSRVFRVWGGXSXFLXFGLWLRPXGVWRVLRRWVXGLPPGLRXVXRPRPR

SEQ ID NO: 182019 - protein, 93 aa, Triticum aestivum
  unsure (1)..(93): unsure at all Xaa locations
  Clone ID: PAT_TA_76437.pep
QYHCHLGEKXLSXSWQCAPRQASAXAGXPXLSTWXHHACXXSCXLPPRXALGVLPXVXRSVXLPXVSRVWGFTSPVALGXGPPPPXXGPRXVS

SEQ ID NO: 182020 - protein, 55 aa, Triticum aestivum
  unsure (1)..(55): unsure at all Xaa locations
  Clone ID: PAT_TA_76438.pep
IVNCNKLFSTXVKXTXWVXXESXCXXXXKSXLMKNVFQVLXXXDXHFFXMLVWLK

SEQ ID NO: 182021 - protein, 95 aa, Triticum aestivum
  unsure (1)..(95): unsure at all Xaa locations
  Clone ID: PAT_TA_76439.pep
TFKLTLQFXEXXPXXPPTVRFVSXXFHPXXXAXXXICLXIXRXRWGPXXXVAXXLXSIXSLLCXPXPXSPAXSXAAXVXSRLLPLLSLGWWRWRS

SEQ ID NO: 182022 - protein, 74 aa, Triticum aestivum
  unsure (1)..(74): unsure at all Xaa locations
  Clone ID: PAT_TA_76440.pep
RAVITNNDLAKLDYTQMVIKETLRFHPPXPLIPRASIEDCTIMGYDXPKGTNVYVNVFXISRDPAYWNNPGEFM

SEQ ID NO: 182023 - protein, 57 aa, Triticum aestivum
  unsure (1)..(57): unsure at all Xaa locations
  Clone ID: PAT_TA_76441.pep
CXWLXXXSSXSXCXLCXXXXSFXCAVFXKIVWLXPLXXSLXRXVGNIYXXCALXGLK

SEQ ID NO: 182024 - protein, 61 aa, Triticum aestivum
  unsure (1)..(61): unsure at all Xaa locations
  Clone ID: PAT_TA_76442.pep
RPHXRAXPDXEEXTPHRYXRENXHRXXXXPMIRVPTAXGXRKPXDXVHQXXHNCSYQVGSX

SEQ ID NO: 182025 - protein, 139 aa, Triticum aestivum
  unsure (1)..(139): unsure at all Xaa locations
  Clone ID: PAT_TA_76443.pep
MFFCITTLNSLETVLTVXGXYYWFXAIEFSKEXFXFLKXQXASYXSFYXRKVVLFIAALVCAIRPTXAITWLYVGFLDFIYIKSKCXFLFFEXIXLGAXXFXATTXFDRWMYGSGXIVQFNFLKXNXFFXGGDYYGKQV

SEQ ID NO: 182026 - protein, 72 aa, Triticum aestivum
  unsure (1)..(72): unsure at all Xaa locations
  Clone ID: PAT_TA_76444.pep
WRDQREMLLSXXPVXXCSXEXXWERTERAVVALXXWSLXLXGSVXFGWYPXARRSTSNHLVNXRTXPAXRPI

SEQ ID NO: 182027 - protein, 78 aa, Triticum aestivum
  unsure (1)..(78): unsure at all Xaa locations
  Clone ID: PAT_TA_76445.pep
FDRLCIXVXVNXNKLFSIAVKLIVWVYLXSFCKXGXKXELMXNVFQVXFTNDPHFFVMLVWLKXKXCSXKKYXXFXYP

SEQ ID NO: 182028 - protein, 125 aa, Triticum aestivum
  unsure (1)..(125): unsure at all Xaa locations
  Clone ID: PAT_TA_76446.pep
XLXFXTVGXXEXSGVXKKEXXLXCQXXRXAPSGVVXEXEPXESSXKXLLGFKERTFTEGXGGSXTANXXTLTLEXEXFXFSLRKLPPKAEXDXXSSKLPPRKGXARIRSXXKCGXCXCXNTSSYR

SEQ ID NO: 182029 - protein, 46 aa, Triticum aestivum
  unsure (1)..(46): unsure at all Xaa locations
  Clone ID: PAT_TA_76447.pep
HXFRLAXPLYPRGCDDDVXFXLCFNYXNVXPXSLARVGQALHARRV

SEQ ID NO: 182030 - protein, 53 aa, Triticum aestivum
  unsure (1)..(53): unsure at all Xaa locations
  Clone ID: PAT_TA_76448.pep
XNKILLTTKQPLLYANYGYQQINTHSTKDKLYTSLEKHHIQXFTQQISKICRL

SEQ ID NO: 182031 - protein, 94 aa, Triticum aestivum
  unsure (1)..(94): unsure at all Xaa locations
  Clone ID: PAT_TA_76449.pep
VNVKPGEEXPXXLENXKXNXPXPXXEXXXXXXXKGGTXXLPXKWFGVEGEYNVMVIDFXXPXLEAXXNYXSRKFXLKTVLMXXDKMINGVEYFG

SEQ ID NO: 182032 - protein, 71 aa, Triticum aestivum
  unsure (1)..(71): unsure at all Xaa locations
  Clone ID: PAT_TA_76450.pep
TAFXXWGGQXXGVCRRXSPRVXRXXXGSXWAGXXXRXHSAXPXAVPRRRRRRRSVXPXFVGLVRRRLRGVX

SEQ ID NO: 182033 - protein, 73 aa, Triticum aestivum
  unsure (1)..(73): unsure at all Xaa locations
  Clone ID: PAT_TA_76451.pep
KLEKTIQXISLFNILLNSRSRXFFXFXXXILXXFXXSRLXPXXIXLXXXXXXTFLKHXLXFLXFLLISTXFFF

SEQ ID NO: 182034 - protein, 98 aa, Triticum aestivum
  unsure (1)..(98): unsure at all Xaa locations
  Clone ID: PAT_TA_76452.pep
RISNKHCRPGRRSAFSSXLRPFTXHPXALARTXTXXARTXAPSHTHASHXLTPPRXLXTHSHTSRXHLARGLSXFLXLSQHSRALSRXLSPLSLPTLS

SEQ ID NO: 182035 - protein, 109 aa, Triticum aestivum
  Clone ID: PAT_TA_76453.pep
PPSLRAISSSESEEISLLRRRVRGLLNRLSESNVESITQEVAAIFRSVPRGVGCQLIGDEVLASCSRGPRGNEQYAAVFAAFIAGMTCLVGMDFSAKILSSLAKSFEDE

SEQ ID NO: 182036 - protein, 51 aa, Triticum aestivum
  unsure (1)..(51): unsure at all Xaa locations
  Clone ID: PAT_TA_76454.pep
YDLVTHVSLALVYFLFVFLIYXXXQQKSWKPHGQQLTNQPHAIQISIEENR

SEQ ID NO: 182037 - protein, 94 aa, Triticum aestivum
  unsure (1)..(94): unsure at all Xaa locations
  Clone ID: PAT_TA_76455.pep
HVRQVSCNSVCKLPXPMQIRENLVRINPHKSDAPRSIDRGFGCRVFPNARIYQVLASSGFGWHLGDLVLFVLDGLALAGLGALGDGAGDEDDEL

SEQ ID NO: 182038 - protein, 90 aa, Triticum aestivum
  unsure (1)..(90): unsure at all Xaa locations
  Clone ID: PAT_TA_76456.pep
NKAXKEKPRXANKQRHGQKNTHENNQXASPMTESKNXPKHPQNLTRQKRKKDEKXXXXEXPAXPXPKKPRPRXXKXXXQRXGTARQAHET

SEQ ID NO: 182039 - protein, 77 aa, Triticum aestivum
  unsure (1)..(77): unsure at all Xaa locations
  Clone ID: PAT_TA_76457.pep
SLQHLIXLILWXSQXALKLSSFNYKXQHMHKXPHLGCRHDYYWSSSHPRNSCWQLVYLYYSTRTRYSGQAHEACMAR

SEQ ID NO: 182040 - protein, 66 aa, Triticum aestivum
  Clone ID: PAT_TA_76458.pep
WRRTKCVLWRGVLFAKFPLAFSSCVLVTAALDKYGPQTPPQHDQVSVFFSEPLPFCLHTLNLLHLR

SEQ ID NO: 182041 - protein, 70 aa, Triticum aestivum
  unsure (1)..(70): unsure at all Xaa locations
  Clone ID: PAT_TA_76459.pep
AGDIMSTSLAINTHAFRTSQTSGPKQVSFRHATGLXXXSLGDYIXSNSTTQQSTPFSTRLMSTAAMFPPC

SEQ ID NO: 182042 - protein, 45 aa, Triticum aestivum
  unsure (1)..(45): unsure at all Xaa locations
  Clone ID: PAT_TA_76460.pep
MARLNSKAVVSAVVLAAVVLXMAGREVTALSCGQVDSXKLAPCVA

SEQ ID NO: 182043 - protein, 63 aa, Triticum aestivum; identical to SEQ ID NO: 181989
  Clone ID: PAT_TA_76461.pep

SEQ ID NO: 182044 - protein, 41 aa, Triticum aestivum
  unsure (1)..(41): unsure at all Xaa locations
  Clone ID: PAT_TA_76462.pep
TRRXFHYVISSXAARGQVQTQVGLLAQXEKTRARLNSEIXT

SEQ ID NO: 182045 - protein, 74 aa, Triticum aestivum
  unsure (1)..(74): unsure at all Xaa locations
  Clone ID: PAT_TA_76463.pep
TXPCXVAXEWPDFGVXLLXSRIRWAXAYDLXRKXFDRXXXXPFIKLARXPXECXLXSTWXSXSNFSIVLCXFQX

SEQ ID NO: 182046 - protein, 143 aa, Triticum aestivum
  unsure (1)..(143): unsure at all Xaa locations
  Clone ID: PAT_TA_76464.pep
EXKKAPPLFPQXKKXXPTQDTASTSHIRTKXEQETTGRXRPTHQEDTHRDRTXPGGGAXGGRAWXPPETAGXASPPGRTRRTEXXTPRDXXXGSSXXRAXXADXPASCPKKAWXKEXXIGQGXGGXAXXRGAXXFSTWKXQXX

SEQ ID NO: 182047 - protein, 55 aa, Triticum aestivum
  unsure (1)..(55): unsure at all Xaa locations
  Clone ID: PAT_TA_76465.pep
LNXNSVYTEVSKELLKNRGANYVYTEKRVWCLFAKLAAAKNSFPIEKMNXLRAMI

SEQ ID NO: 182048 - protein, 56 aa, Triticum aestivum
  unsure (1)..(56): unsure at all Xaa locations
  Clone ID: PAT_TA_76466.pep
GNXIXVXRARRXMXMXXXIXLGXXKKDKWRKETQXECESXETXNAXLYVPGGERXV

SEQ ID NO: 182049 - protein, 110 aa, Triticum aestivum
  unsure (1)..(110): unsure at all Xaa locations
  Clone ID: PAT_TA_76467.pep
IPEVNFLMGLASIVVTXVAFRTTTSIGHAYGICXVTTFXITTHLMTVVMLLIWKKHVIFIMLFYVVFGSIELIYLSSILSKFIEGGYLPICFALVVMSLMAAWHYVQVKR

SEQ ID NO: 182050 - protein, 65 aa, Triticum aestivum
  Clone ID: PAT_TA_76468.pep
HILQMVAVTAIQQMSLLPAKRKQLDRPTTSREKAPYEGLSKRTRFCGICRQQGHKRTTCPERGDV

SEQ ID NO: 182051 - protein, 134 aa, Triticum aestivum
  unsure (1)..(134): unsure at all Xaa locations
  Clone ID: PAT_TA_76469.pep
AYFSCPKGMVSLVSTDGLHQLHIFVFFLAVFHVTFSAITMSLGRAKTRIWKEWEKDTSSITYEFSADPSKFRLTHQTSFVRQHASCWSKSTIMLYVVSFFRQFFRSVRRTDYLTLRHGFIAAHLSPGTRFNXQK

SEQ ID NO: 182052 - protein, 64 aa, Triticum aestivum
  unsure (1)..(64): unsure at all Xaa locations
  Clone ID: PAT_TA_76470.pep
HNFLCLAKCIRIVSRFIRNQLLANREALLFXEIIYAGSLPLWSHKIFGKFTASHESNWFLASSI

SEQ ID NO: 182053 - protein, 76 aa, Triticum aestivum
  unsure (1)..(76): unsure at all Xaa locations
  Clone ID: PAT_TA_76471.pep
LLYLLLVPAASAMILKLRFRXTFGLAHCAMPFXXVVLGSWPLVVHCFSLAWFSRLKPECLVGVSCLQDGSPSLIHK

SEQ ID NO: 182054 - protein, 58 aa, Triticum aestivum
  unsure (1)..(58): unsure at all Xaa locations
  Clone ID: PAT_TA_76472.pep
SVKLSSPSESKMVLNYEDDVVPFEXVATLLQYLCSQIVINMIICSLVDIGVKEPRDFL

SEQ ID NO: 182055 - protein, 59 aa, Triticum aestivum
  unsure (1)..(59): unsure at all Xaa locations
  Clone ID: PAT_TA_76473.pep
XMXGMXXXIGCIREGSXFYFTLQIKAVDIGLNTLVXXXXKXXEVSRXVCWHRWLDRLKT

SEQ ID NO: 182056 - protein, 69 aa, Triticum aestivum
  unsure (1)..(69): unsure at all Xaa locations
  Clone ID: PAT_TA_76474.pep
HSVLTQAPPXLDLVQCNNNLVHSSGYFSGNKKKKNISCHFQITAPKISCALKRIDIAWPRESSTTAPFL

SEQ ID NO: 182057 - protein, 97 aa, Triticum aestivum
  unsure (1)..(97): unsure at all Xaa locations
  Clone ID: PAT_TA_76475.pep
QRRHPXTLESTPTSTSTHSPNPVQAPTRRTLHHTCXLPDEXIHIXPGTDEAKAXHTVSNTDEADTTRPGTDEAKADHLSELTRPDIFIIGHRQAGGM

SEQ ID NO: 182058 - protein, 70 aa, Triticum aestivum
  unsure (1)..(70): unsure at all Xaa locations
  Clone ID: PAT_TA_76476.pep
GFCLVASLLLSVLSGATVAGSGPFSPPGXWSDSGDPXAGXXPGLLXWAVPLAGLLGGGVLLVYNPXALAG

SEQ ID NO: 182059 - protein, 68 aa, Triticum aestivum
  unsure (1)..(68): unsure at all Xaa locations
  Clone ID: PAT_TA_76477.pep
TPXDECAVLEKGXWIFRLKLTXAVMEELGXLAXXRTGGGRPASSMTCCSTTTRCMHDLQLNSLYARYS

SEQ ID NO: 182060 - protein, 143 aa, Triticum aestivum
  unsure (1)..(143): unsure at all Xaa locations
  Clone ID: PAT_TA_76478.pep
CLLLAALXGRGAGGPPPLAXVSGXXAVRXRGLXRPGRAPPFPGGXLCXPLARMXXPPPSXVCFASLLWAGAAVRLVCGXPCWXAXRRXAPGPXPCAWVGXPHRCSPAPSAKWWWXPXXPRXPRPWPXSPGXWPRRCGSWVLVL

SEQ ID NO: 182061 - protein, 57 aa, Triticum aestivum
  Clone ID: PAT_TA_76479.pep
IHHYITTPDVYICPGMMFSCRSILTDRLQQYIYEQNPETPLVNPSRCSKLVRSVGAY

SEQ ID NO: 182062 - protein, 44 aa, Triticum aestivum
  Clone ID: PAT_TA_76480.pep
AGKKAVIVRVFEEGTRDRPYGHCLVAGLAKYCSSLQNCRDTFSS

SEQ ID NO: 182063 - protein, 99 aa, Triticum aestivum
  unsure (1)..(99): unsure at all Xaa locations
  Clone ID: PAT_TA_76481.pep
FESSHHRYHGXXTSSTGGHTSMFPWRXPAGSQGTPEPTHTTPTSRGRALEQHESGSWFMFLTLAKIMSLIWLVILLEKCLVILLFLFELACYIKHNVAQ

SEQ ID NO: 182064 - protein, 79 aa, Triticum aestivum
  unsure (1)..(79): unsure at all Xaa locations
  Clone ID: PAT_TA_76482.pep
GXFAKMKIQLPNSITQXXKXXTTRXXHPFSQHTQXXPQDHQXTPTQISNLQPNTPHTTRTSXLTTQNKKNXYXKTIPKP

SEQ ID NO: 182065 - protein, 80 aa, Triticum aestivum
  unsure (1)..(80): unsure at all Xaa locations
  Clone ID: PAT_TA_76483.pep
MGXGRVELKRXXNXXXRQVTFAKRRNGLLKKAYELSXLCDAEVALTRLSPTARKLYEXLQXXDXWXKILDKYXKCSYAGX

SEQ ID NO: 182066 - protein, 69 aa, Triticum aestivum
  Clone ID: PAT_TA_76484.pep
TRRLSTRTRATSSTPRKAPMRASSADRRTFFAARPALPADCSIGTHQPTCTGDRRRALYIWPCELNIAP

SEQ ID NO: 182067 - protein, 77 aa, Triticum aestivum
  unsure (1)..(77): unsure at all Xaa locations
  Clone ID: PAT_TA_76485.pep
KXPILWKTEHTVHIIXHVEIISPINHNLEIIATSIXYPHLKQMHTMPNLEDKSTTEDXSNQLSASSEXREGEERAPT

SEQ ID NO: 182068 - protein, 41 aa, Triticum aestivum
  unsure (1)..(41): unsure at all Xaa locations
  Clone ID: PAT_TA_76486.pep
MSVVEQVLLAPAAACIMAGEERLVQWXHGIVADPACSATSV

SEQ ID NO: 182069 - protein, 115 aa, Triticum aestivum
  unsure (1)..(115): unsure at all Xaa locations
  Clone ID: PAT_TA_76487.pep
SSPVSSLSHRRTPIQPXRRRSPRXPAPPPKPSIPLLRESQGKGXXXQGKGEGAPRSTAASARRRRPDACPSSREVGTEVRPGXXVAMDGQRRPKLYPQGRRLNLQGRAPTTADLR

SEQ ID NO: 182070 - protein, 57 aa, Triticum aestivum
  unsure (1)..(57): unsure at all Xaa locations
  Clone ID: PAT_TA_76488.pep
VWALLFLVLGXSITXLNYLRASLTLHWXHXTHLHLQSYKFTQASHLSHLSLERGEQG

SEQ ID NO: 182071 - protein, 167 aa, Triticum aestivum
  unsure (1)..(167): unsure at all Xaa locations
  Clone ID: PAT_TA_76489.pep
TRGSRIERWRHFRRRSPSWGHXFWSSGWMEGDKWWSGFSFTTSKTAXLGGVVQWGFGVRCKEMDSRRRRTLSGVMVALMAERPSKVGALVFALKMDWWKMAATAHESASDRCIPQTQYVAWLGPPTLDVRHLCXXCLVLGSDYRHTFIKWIEIVTYVARMVASDYLM

SEQ ID NO: 182072 - protein, 99 aa, Triticum aestivum
  unsure (1)..(99): unsure at all Xaa locations
  Clone ID: PAT_TA_76490.pep
GCVLVTLSVFPRCFCVGGLGPRGPGGPDWGGPCPGSWGPWFGGFFGSCFXLLCCCCLLXXCCGPFFGPPGPGALPPPLLVAARIPPGLCPCWLSSGCWG

SEQ ID NO: 182073 - protein, 271 aa, Triticum aestivum
  unsure (1)..(271): unsure at all Xaa locations
  Clone ID: PAT_TA_76491.pep
PPRFPRPPALLMFGXGXCCGDXATAVVXGDGXXLXXVFASXSDLLVXWGGVAPGMAXEAHALAFXRVVXXALDDAXVXGGXLSAVAVXIXPXLXLCLGVGVLGARXXAGXFPLPIVGVXXVGXXXLVXGGHXLLVLARXLGGXVXLGTXXXDAXGGAXDXSAXWLGLDXRXGGGPALGGLALXGXPXSXXFGVPMRRHXXCXFSCAGLGXRVXLAIGSGDLCXXDXPISSAXGGDGXLGXXIAASFRRMAVLLLGDGCRXAVVWALGMGPS

SEQ ID NO: 182074 - protein, 69 aa, Triticum aestivum
  unsure (1)..(69): unsure at all Xaa locations
  Clone ID: PAT_TA_76492.pep
PRRPRRXLLRXPPRARPYGFFCEPHAGAGMVGXVPVXXLSXLHIAVLASLGSLLLGXPXRVMHXXCLXV

SEQ ID NO: 182075 - protein, 105 aa, Triticum aestivum
  Clone ID: PAT_TA_76493.pep
MVVWLTSSGKDNKGRCSIHDITTVNLSDDDDRNGPSESPPSVLTTASDQFGVLSIDAKPSRSLSGQRHAFMYCRRRCRSPSSHPRGRLHLGRGKSSQVCVHGETH

SEQ ID NO: 182076 - protein, 120 aa, Triticum aestivum
  unsure (1)..(120): unsure at all Xaa locations
  Clone ID: PAT_TA_76494.pep
FDMAKQVALDKEIPPKCLSEVRSALVGALASNGKVSDGLELFDEIKQSGGYLEPKAAIALIEHTQTEDQLDRLYQLLEEVSEPGMWXDGCGRVLQYCVQHNHPDAAVDLLKQLKETNEMS

SEQ ID NO: 182077 - protein, 145 aa, Triticum aestivum
  unsure (1)..(145): unsure at all Xaa locations
  Clone ID: PAT_TA_76495.pep
RXARTXPRTSKQRARPAKTRKERERQARDXYANXXRXRXPXXAAQGGNTXDKKAANRPKRXRXPRXGXEXRXRRAXGAQXNAXXXRXXGTNPRARGRQTGTPREXRGSGRXAGTXQRGQRGTPRKGXXDRAAXPEGPDGAPPXQK

SEQ ID NO: 182078 - protein, 77 aa, Triticum aestivum
  unsure (1)..(77): unsure at all Xaa locations
  Clone ID: PAT_TA_76496.pep
VTGRASSISKECCSGVQGLNGMAXRSSSDRKIACRCLKSLATSIKSINMGKVSGVPGKCGVSVPFPISMSTNCDTVN

SEQ ID NO: 182079 - protein, 72 aa, Triticum aestivum
  unsure (1)..(72): unsure at all Xaa locations
  Clone ID: PAT_TA_76497.pep
CAPPWRXXKFNFKRXPXHVXXPXXHPSIGCITEXSPFYLXANTSIXYXXNTFIHXTQPSKXQXTPILPXILK

SEQ ID NO: 182080 - protein, 55 aa, Triticum aestivum
  unsure (1)..(55): unsure at all Xaa locations
  Clone ID: PAT_TA_76498.pep
LLLXRCLSWXQVTDNLNVRFFTRKMNRTRTHPEKRNXSATAAGISYKPVLGISLV

SEQ ID NO: 182081 - protein, 79 aa, Triticum aestivum
  unsure (1)..(79): unsure at all Xaa locations
  Clone ID: PAT_TA_76499.pep
VVEPLQRLRIDRRFQRAPSTSNNPPRRRASPAPPHRXAPPRPPDLTHFLALCFLSSPAPPNRPKKKAKSGQRSSTKTKF

SEQ ID NO: 182082 - protein, 58 aa, Triticum aestivum
  unsure (1)..(58): unsure at all Xaa locations
  Clone ID: PAT_TA_76500.pep
QPHRVLGRPPRGHQEESAGWGARXRAPERDHQATKDMEHIQRPRLISAMIRSGYIYAC

SEQ ID NO: 182083 - protein, 73 aa, Triticum aestivum
  unsure (1)..(73): unsure at all Xaa locations
  Clone ID: PAT_TA_76501.pep
XERPXXXXGXGRVWLXXAQXGLLVLLLLHAQAAGRPERRKIVELRQQQPSGADVLLRNPSMLVNSVSGSLSID

SEQ ID NO: 182084 - protein, 108 aa, Triticum aestivum
  unsure (1)..(108): unsure at all Xaa locations
  Clone ID: PAT_TA_76502.pep
IGXSRFFXMGPARRCPCDRCLLHVGXTXNXLXKGLALTHXTXRKQPLGXPGGGRPSXDXXPGRRDPQVVXNNLGERKIGVXRVRGLPHXPASGLXDQDRRELGALHAC

SEQ ID NO: 182085 - protein, 76 aa, Triticum aestivum
  Clone ID: PAT_TA_76503.pep
CSPLGSLQGRVGWPAAEVGCGAALSPSMTRFGGFLLLLPTWLVLAGTKADRWRRAHSSWGTRSTGGRRRLNAYGRS

SEQ ID NO: 182086 - protein, 67 aa, Triticum aestivum
  Clone ID: PAT_TA_76504.pep
ADARRGPPTLFFILSFIPCIPVGIEVTVRDREICRRGRARRELSPGSASAGLRAAAPPHRTNGSGRR

SEQ ID NO: 182087 - protein, 53 aa, Triticum aestivum
  unsure (1)..(53): unsure at all Xaa locations
  Clone ID: PAT_TA_76505.pep
KVPSCIYFKMLFELMQXRDVFANPCVVGIXCXXQEVSLLFYGNIMIFLCNSRC

SEQ ID NO: 182088 - protein, 207 aa, Triticum aestivum
  unsure (1)..(207): unsure at all Xaa locations
  Clone ID: PAT_TA_76506.pep
KIVHRDLKASXILLDVDYXPKISDFGLAKIFGGDQXEDVTRRIAGTYGYMAPEYAMRGQYSSKSDVFSFGVLVLEIVTGRRNSGSYNTEQDVDLLNLVWEHWTRGNVVELMDPSLSNHPPVDQVLKCIHVGLLCVQRKPASRPTMSSVNIMFSSHTVRLPSLSRPAFCIQEVSVSGTSTAYSEAYPLTENSTVMSSNQVSITELSPR

SEQ ID NO: 182089 - protein, 142 aa, Triticum aestivum
  unsure (1)..(142): unsure at all Xaa locations
  Clone ID: PAT_TA_76507.pep
AHHVVHCFASRSSFARCGHALPAAISQTQHAASPLLSGFGSAARAFSSRPLWKGAFVDAFLQRIKNSGGSLNGRKIWSRRSSILPEFVGSSALIYNGKTHVRCRVTEGXVGHKFGEFAFTRKRRPHRAITAKKAGGQGKGRK

SEQ ID NO: 182090 - protein, 81 aa, Triticum aestivum
  unsure (1)..(81): unsure at all Xaa locations
  Clone ID: PAT_TA_76508.pep
QKSTELLIRKLPFQRLVREIAQDFKTDLRFQSSAXSALQEAAEAYLVGLFEDTNLCAIHAKRVTIMPKDIQLARRIRGERA

SEQ ID NO: 182091 - protein, 113 aa, Triticum aestivum
  unsure (1)..(113): unsure at all Xaa locations
  Clone ID: PAT_TA_76509.pep
RTDAVFXRXPMVXFXCXXKSXRNDLKLXGTXXWKIRKILEEKSTSGGPHPVHEGGGRACXPWAXPLPRGPPGSXPXSXPTPYIHFRGEKNQGEGFIAFYDTEXXPXPKTSREG

SEQ ID NO: 182092 - protein, 155 aa, Triticum aestivum
  unsure (1)..(155): unsure at all Xaa locations
  Clone ID: PAT_TA_76510.pep
DWGKLYASSSFYDPVKRRRIMMGYVGEVDSXQADVAKGWASIQSVPRTVALDEKTRTNLLLWPVEEIETLRLNATELSDITIETGSVFHVPLRQADQLDIEASFRLDASAITALNXADIGYNCSSSGGAASRGGLGPFGLIVLASXDRCGEQTGG

SEQ ID NO: 182093 - protein, 65 aa, Triticum aestivum
  unsure (1)..(65): unsure at all Xaa locations
  Clone ID: PAT_TA_76511.pep
RTAGIHPSVGCISEGSPFYLAANTSSRYRSNTCIHRSQPYGSQQTRMLAMMVXWIKPQVCRRRWH

SEQ ID NO: 182094 - protein, 89 aa, Triticum aestivum
  unsure (1)..(89): unsure at all Xaa locations
  Clone ID: PAT_TA_76512.pep
MSGRRSRGSVSEEEINELISXPQTLLPTTRRRXSSSSQASTTKMLKETCSYIKSLHREVXNDLSDRLSDLMSTMDNNSPXAEIIRSLLR

SEQ ID NO: 182095 - protein, 82 aa, Triticum aestivum
  unsure (1)..(82): unsure at all Xaa locations
  Clone ID: PAT_TA_76513.pep
VKRISGLIYEEXRGVLKIFLENVIRDAVTYXKHARRKTXVTAMDVXYALKRQGRTLYGFGRLRRELAGLTLLFPAWLRLCSR

SEQ ID NO: 182096 - protein, 104 aa, Triticum aestivum
  unsure (1)..(104): unsure at all Xaa locations
  Clone ID: PAT_TA_76514.pep
IKWXIPXLACILWMDGSLPVRTCPGRPLRNXKFXSAAIGGXXALRXSXPNXAPISGXXIYNFTXPSVYTTVVHWGKTXGVYXNLNRXCKHIPPIRQLGVNSERG

SEQ ID NO: 182097 - protein, 170 aa, Triticum aestivum
  unsure (1)..(170): unsure at all Xaa locations
  Clone ID: PAT_TA_76515.pep
QFSDINLVANEFLLKIMNKDSEGYVPLSVISSWKKIKSLGAXNXMLVKALRTSTKLXVSDDGKKVXXAGXPFTEKHKEELQSRMIIAENLPEDXSRXSLEKVXSVVGSVKNIKICHPQEPSSARXSKSDTLXSNXXHALVEYETSQQXEKXXEXLNDERNWRKGXXSCAQ

SEQ ID NO: 182098 - protein, 61 aa, Triticum aestivum
  unsure (1)..(61): unsure at all Xaa locations
  Clone ID: PAT_TA_76516.pep
AGXQXAYXAGRXHARWRRPAGAVRXXVXRPXVVFVSQAGEXVSVLKFSMLGFLPFWXXYMX

SEQ ID NO: 182099 - protein, 65 aa, Triticum aestivum
  Clone ID: PAT_TA_76517.pep
LLSKRGRDELGSRREDADDCEAVNETPAASGRRQSEGLVLPQVHNQSERKRRDRINEKMKALQEL

SEQ ID NO: 182100 - protein, 78 aa, Triticum aestivum
  unsure (1)..(78): unsure at all Xaa locations
  Clone ID: PAT_TA_76518.pep
TLRYDAXAWXPXVNQIIVKEKGIFTNVSVRRRPRRLAXWCSGAPGVLDXXRPAGHSSDGKQSVLDKVISXLXERTQVA

SEQ ID NO: 182101 - protein, 134 aa, Triticum aestivum
  Clone ID: PAT_TA_76519.pep
CYAAPGTPSTRPRTAVPEEAPLPASCPDAIYTTVLCLLCFSALDRRRRAVGVRRNVMASVTADRTGAYTMNMGRVTSSLLARNQCKVVVVTPLAACNASLANITGTLAAPVQLVSIGADLPINNDAENLIGGIV

SEQ ID NO: 182102 - protein, 185 aa, Triticum aestivum
  unsure (1)..(185): unsure at all Xaa locations
  Clone ID: PAT_TA_76520.pep
QNPPNGAEGLGRFNDNSSTSGLLTTNKPGGCHVADLNEPITGMHMGGTNGSVSRGLPYTLENSWRQSAVRSSTANFGFNKEYSKEKHTDEGTSSNFLDTSAKLRQEEKPLIDKGKQVSDQSFFTPRYSNADLQKSFKVADGRSATNEIIYHGQNSSVGWFSKGPMGAXPINNFARLDHPHHSSIG

SEQ ID NO: 182103 - protein, 141 aa, Triticum aestivum
  unsure (1)..(141): unsure at all Xaa locations
  Clone ID: PAT_TA_76521.pep
NKALHNVVEVSGPDFKACKNTKGGPAWRSGADQVHLGXAGRRWFICTVGNHCQMGLKLNVTILAADALSPARLHQLRGRRCHRRLLLTSPGGPLFPSGDDLPLPGMQRPVSTILVRVCFFASHIVHGVINIAHCWIHVMFP

SEQ ID NO: 182104 - protein, 82 aa, Triticum aestivum
  unsure (1)..(82): unsure at all Xaa locations
  Clone ID: PAT_TA_76522.pep
VDKXKLLCDHCKRKGHTKDECFELXGYPPWWDKGRSXLGXARGSNKRQANYNASARELHVVDMQALEDFKSKXKFSEGXYLS

SEQ ID NO: 182105 - protein, 77 aa, Triticum aestivum
  Clone ID: PAT_TA_76523.pep
SDHLEDVWLEVLGADPLRVCPSTLRLHQDEEAREKERQRSSPSPSAGGPKPSARTRLGHGEAMPSRINSENAGPHKL

SEQ ID NO: 182106 - protein, 208 aa, Triticum aestivum
  unsure (1)..(208): unsure at all Xaa locations
  Clone ID: PAT_TA_76524.pep
RFPRLSDAESFLNSVIVKELSSNTTDIMPSGSDYMCELEDSSSSEYIPSNGLQYRPDEAVSFEEPTSDHRTDAPAVGYHMEPDQPVLQSPIATNINSIYSGFPEGYSGFPEGYSGFPEGYSGSVKIERDGGPFPATITDHAPEKAYILDTRIDAAGGNSVADKGKGAGKEIDVSDVTRDILAGIETYGGDDSFHDMXSKLDKXIDELG

SEQ ID NO: 182107 - protein, 62 aa, Triticum aestivum
  unsure (1)..(62): unsure at all Xaa locations
  Clone ID: PAT_TA_76525.pep
GCRIGGSPIEVHSSVGGPWYCHYSVERRMISVSRVGLVFEIHLSEFRRSRLQVDPMGEFLXS

SEQ ID NO: 182108 - protein, 97 aa, Triticum aestivum
  Clone ID: PAT_TA_76526.pep
DGTGLQIKQQRAPSMPRRKKEMSSDVVEEADSGGDTCVDLAIETQLHLGLEEKTSTENDLDMIPVCSLSSLPSRPTSCMPSRPLIMSFFMFPATRVL

SEQ ID NO: 182109 - protein, 62 aa, Triticum aestivum
  unsure (1)..(62): unsure at all Xaa locations
  Clone ID: PAT_TA_76527.pep
SQXKXQQXHTTLIHSQXNLAAYSLQFSRHGGSEGRGTGAGDGARGDAGGAAGTVHAISCSTV

SEQ ID NO: 182110 - protein, 105 aa, Triticum aestivum
  unsure (1)..(105): unsure at all Xaa locations
  Clone ID: PAT_TA_76528.pep
VERSLEGANCTILEIQRRLRANFEHKKDTCWSRWCRWVESIGQLRISNRDLATSKGRPYEGEHEVKLGSACKSDGIGXSDWFQVCVMELCXNKLCYXTCVRPSSL

SEQ ID NO: 182111 - protein, 220 aa, Triticum aestivum
  unsure (1)..(220): unsure at all Xaa locations
  Clone ID: PAT_TA_76529.pep
GRAAGGQVLSPTXPAAXSSSSLDPLQPSRRHRRPPPIPAATPPXVTPPWPQIHSRXAHPAVRSDRPPSLPTSSPETLAARPWRPIAALQDPLLPXGGMVGGDGDQRRHESPAHGDPRKDLDRRVLWVTDCRDXTAAKGTGTDTRCPKGKLCAEGEPAXLSPSYLLSLRSXDXPPSKAHLLHWEDSRVFGQVHRLSRXKILPGXSDGGAHSWARIGESVAP

SEQ ID NO: 182112 - protein, 207 aa, Triticum aestivum
  unsure (1)..(207): unsure at all Xaa locations
  Clone ID: PAT_TA_76530.pep
VGKCLLNXKITADDAPGETXHMVFPTDGEXPYKEGQSIGVVADGQDKNGKPHKXRLYSIASSALGDFGDAKTVSLCVKRLVYTNDAGEVVKGVCSNFLCDLKPGADVNITGPVGKEMXMPKDPNATIIMLATGTGIAPXRSFLWKMFFEKYEDYKFNGXAWLFLGXPTSSXXPXPEEFGKMKAKAPDNFRVDYAISREETNAAGEKM

SEQ ID NO: 182113 - protein, 51 aa, Triticum aestivum
  unsure (1)..(51): unsure at all Xaa locations
  Clone ID: PAT_TA_76531.pep
AWLAGRXYLWXTGAPXXXRIRXSEALSDDKFKTRVTNLPLAWVPIEQVSQG

SEQ ID NO: 182114 - protein, 38 aa, Triticum aestivum
  unsure (1)..(38): unsure at all Xaa locations
  Clone ID: PAT_TA_76532.pep
PTITSREIQTSVRLVLPGELAKHAVSXGTKAVTKFTSS

SEQ ID NO: 182115 - protein, 155 aa, Triticum aestivum
  unsure (1)..(155): unsure at all Xaa locations
  Clone ID: PAT_TA_76533.pep
LVHREGNAVIRRHLESLPLESFDSILILADESVEDSAIQADSRSLATLLLIRDIQAKRLPYKEAIGSDGFRRSLSEGSWMGEMQQASDKSVIISEILXPRTKNLLYMSKISDYVLSNELVSMALAMVAEDRQINYVLEELFAEQGNELQIRQSDL

SEQ ID NO: 182116 - protein, 55 aa, Triticum aestivum
  unsure (1)..(55): unsure at all Xaa locations
  Clone ID: PAT_TA_76534.pep
HPVRPGPGRDXIMRFDLISFPIHVYSQTTAGRIALITANLLLHPKLCQYSHPGHN

SEQ ID NO: 182117 - protein, 101 aa, Triticum aestivum
  Clone ID: PAT_TA_76535.pep
QQRTEAAKMPIELQKATQETQLAKAKARLACDEVTRASEEADRAKADVNIVQLKQEAVSREILAVKASEEIAMASANALQEYKEEGEIDPQANRGSDKSMM

SEQ ID NO: 182118 - protein, 141 aa, Triticum aestivum
  Clone ID: PAT_TA_76536.pep
LQPAVEFFRIVDGHGRPTKAVFRAALAEALVHYYPLAGRLREAPGGRLVVECTGEGVVFVEAEADVSLDELGEPPLPACTFVEQLLCDVGDARVVIGVPLFFMQVTRLRCGGFVIGLHICHNIADGYGSTQFLKCVADLAC

SEQ ID NO: 182119 - protein, 157 aa, Triticum aestivum
  Clone ID: PAT_TA_76537.pep
SRRDSHTNWPWSNSLGLRTSTTRRRKIGRVRRVYWSPHIFHTSQPHLLVFISIQTHATATIYLETTIKLPSTLLVVGYVGEVSPAKKKDMLAKFVPELPATWSLGGGRNGGASSLTASNHKASSPSMAVLRKKRRLASTSASEWMELRMASCSTTSF

SEQ ID NO: 182120 - protein, 199 aa, Triticum aestivum
  unsure (1)..(199): unsure at all Xaa locations
  Clone ID: PAT_TA_76538.pep
RLKLIQSPTTAPHPVDXPILCERHTTSKLSAYEDLQTIKSMGFRGEALASMSYVGHVTVTTITEGQLHGYRVSYRDGVMENDPKPCAAVKGTQVMVENLFYNMVARRKTLENSNDDYPKIVDFISRFAVHHINVNFSYRKHGANRADVHSGSTSSRLDAIRNVYGASVVRDLMEIXVXDXNAXDEIFXXXGFISXXXXV

SEQ ID NO: 182121 - protein, 62 aa, Triticum aestivum
  unsure (1)..(62): unsure at all Xaa locations
  Clone ID: PAT_TA_76539.pep
NKKXXNQETEDKLXQGXRXXRKTKLMKXLTNLKGQKKKTVKXLNTQIISLNNKIIKKILPSX

SEQ ID NO: 182122 - protein, 53 aa, Triticum aestivum
  unsure (1)..(53): unsure at all Xaa locations
  Clone ID: PAT_TA_76540.pep
SYCWTSLYNECHWLHTDHRLFTYWCWVYSAEANAIQGLSPFLSLPSCGTGXNA

SEQ ID NO: 182123 - protein, 94 aa, Triticum aestivum
  unsure (1)..(94): unsure at all Xaa locations
  Clone ID: PAT_TA_76541.pep
SFSLETEMRNCACCRRGFSRCSHHHRSNLGLLPVSGVRSLLLQRTTRWTGMEAAQFLLHLLLLGRGVRRAGSDSGVVTVSANLGNFSLFGKSXL

SEQ ID NO: 182124 - protein, 146 aa, Triticum aestivum
  unsure (1)..(146): unsure at all Xaa locations
  Clone ID: PAT_TA_76542.pep
TSIMHSYYVCGQVKNCKAVFDMMVAEGVKXPNIVSYNALLGAYASHGXHTEALGIFKLLKQNCLRXPDVVSLYXXLLNAXYGRSAXPEKAREVFNEMRKNSCKPNKVSYNALIDAYGSAGMFKEAISLLHEMEKDGIPPXVVSIST

SEQ ID NO: 182125 - protein, 105 aa, Triticum aestivum
  unsure (1)..(105): unsure at all Xaa locations
  Clone ID: PAT_TA_76543.pep
TSKQRQRAEKLXGARGAAXXXRAYLGETNXAAALSXNXXGAPQPSPGSTGXEVKKTAXXAAGTAAGEKRGAQRHAAVVREEEEMGGGHCNCNRRAPCAVPVSDTR

SEQ ID NO: 182126 - protein, 126 aa, Triticum aestivum
  unsure (1)..(126): unsure at all Xaa locations
  Clone ID: PAT_TA_76544.pep
TVSLCASSSGCERNWSAFEHIHTKKRNRLQHRLLNDNVFVSYNRKNLDRFQKRREKMXGNSYDPLVIEDFDWGNEWVDPTIPPPQGARGCPDDISWELVDEAVGASSSLQGRNSLELAPMARGLKC

SEQ ID NO: 182127 - protein, 55 aa, Triticum aestivum
  unsure (1)..(55): unsure at all Xaa locations
  Clone ID: PAT_TA_76545.pep
PLTMXLATFXIXXXXSSPSGXRGXRXSGLXSGTGILSLRACLRERXSXQSTLGPR

SEQ ID NO: 182128 - protein, 184 aa, Triticum aestivum
  unsure (1)..(184): unsure at all Xaa locations
  Clone ID: PAT_TA_76546.pep
EXXSPMPPMSTPLSARLETSPASDGHLTALAAPDMLNEVATSSNTSTPIFVSLQPPLLTAPSSTPPQPPVARRKTLAGVVDFALGRRTTPQSKETHHAHCADGGXLLCQRLGIVGEGEMITEDAISKYVALFNGQLPDLAVAALRALFQMXCDLDGAVEDALIQHGGDTGPGMRTQASDDATVA

SEQ ID NO: 182129 - protein, 95 aa, Triticum aestivum
  unsure (1)..(95): unsure at all Xaa locations
  Clone ID: PAT_TA_76547.pep
KNTSXTXXDXGGQDKXRPXWRHXXQNXQGPXXVVDSNDRDRVVEARDELHRMLNEDELRDAVLLVFANKQDLPNAMNAAEITDKLGLHSLRQRHW

SEQ ID NO: 182130 - protein, 121 aa, Triticum aestivum
  unsure (1)..(121): unsure at all Xaa locations
  Clone ID: PAT_TA_76548.pep
QATETTGRRHQADXPHQEPXKPRPNXKQXSHGTQEKAPXPRPPPTQRRAPHTXAPATAPAPAPPPRRGGPTAPRPPGTREAGRPPTTPPTSPHPRAPPGPXKRPRPXHXPXXXMXWPVCLA

SEQ ID NO: 182131 - protein, 62 aa, Triticum aestivum
  unsure (1)..(62): unsure at all Xaa locations
  Clone ID: PAT_TA_76549.pep
LWRGFSRESGDLAVGAAGWXNCWVAXVGXWXVGSLGVAAKLLLCGLLLPVCAWWVGLLCXGG

SEQ ID NO: 182132 - protein, 56 aa, Triticum aestivum
  unsure (1)..(56): unsure at all Xaa locations
  Clone ID: PAT_TA_76550.pep
DSDLSVHYRLLSGKLFGIAVLIVVIRADISIKFSRLQWIFWVGPFIGAALXAVYHQ

SEQ ID NO: 182133 - protein, 117 aa, Triticum aestivum
  Clone ID: PAT_TA_76551.pep
PPPLLQLGAPPARDPHLRPRQGSLAPAPSGKGVARYLSCRDQDHFLMPLIASPRPSPPRRPGCCYKTTTGPSWSPRSEDDHDHASLLVPLWRLRTSRSRLPEPCRFAGSSKTLVVAK

SEQ ID NO: 182134 - protein, 76 aa, Triticum aestivum
  Clone ID: PAT_TA_76552.pep
VTGRASSISKECCSGVQGLNGMARSSSDRKIACRCLKSLATSIKSINMGKVSGVPGKCGVSVPFPISMSTNCDTVN

SEQ ID NO: 182135 - protein, 54 aa, Triticum aestivum
  Clone ID: PAT_TA_76553.pep
VSRFRLQTVTSETRWRLLLLRAGGAATQSTVTPQGWERRGSTRGLPEQPRAGAS

SEQ ID NO: 182136 - protein, 75 aa, Triticum aestivum
  unsure (1)..(75): unsure at all Xaa locations
  Clone ID: PAT_TA_76554.pep
SASRPSSAIMLAGXLPLQGAXEHEDSASAAXGRXXPASXAXRXAVAKALVAYXQXYVXEAAKKXGZGHASPATTV

SEQ ID NO: 182137 - protein, 89 aa, Triticum aestivum
  unsure (1)..(89): unsure at all Xaa locations
  Clone ID: PAT_TA_76555.pep
DMSYVGFTADGAQWLVDNTDIKLVGLDYLSVASFDHARSAHVAFLKNADIILVEHLKLEYVETGLYXLHCLPLRLVGSDGXPIRCILIK

SEQ ID NO: 182138 - protein, 114 aa, Triticum aestivum
  unsure (1)..(114): unsure at all Xaa locations
  Clone ID: PAT_TA_76556.pep
YPTITPAPDAHDYINSGLNRFNSNVVKNYRXXCAPTKMIHVSALAQDVSEDALLAHLSEHGSIVGTKLFEVNGKRQALVLFESEEEATEALVSKHASPLEGSTIRISFSQMQSL

SEQ ID NO: 182139 - protein, 109 aa, Triticum aestivum
  unsure (1)..(109): unsure at all Xaa locations
  Clone ID: PAT_TA_76557.pep
GXXGTXRCTXVCXVTYHAXILXXPXXEKRRNPEPPQXSRPRDDGXRPGKGGXPXCXWTXCXPXXXXXXXXVPXPPVXSLGMXPCIXSQPXXYXSXDIELFYLXFCAXRL

SEQ ID NO: 182140 - protein, 92 aa, Triticum aestivum
  Clone ID: PAT_TA_76558.pep
PWRQSTDANVAGLSSLTRRRSSLAASTTQKREEENGCQAHHWSLCNPFMLGVCVKHAHACLWKLKRKQMFQYHYQHIFSKCQPRENAMARLV

SEQ ID NO: 182141 - protein, 133 aa, Triticum aestivum
  unsure (1)..(133): unsure at all Xaa locations
  Clone ID: PAT_TA_76559.pep
AIDWWRSCHKTRHSLQRAPPCCPISSCTRLCLMASNSVSWSASTAGDDEDTTNCSASSSFFWRRTTMKARAAGPPRRSLRQWCHAPKAGRRRWRPHDLTRGRSGSREGPFLRWRXGILDGRXRRRWMKYXHHV

SEQ ID NO: 182142 - protein, 107 aa, Triticum aestivum
  unsure (1)..(107): unsure at all Xaa locations
  Clone ID: PAT_TA_76560.pep
KKQATTTVXXDGXTDGRXXXGAXAAATPATXQPKAASXXGGXXRGRGXAXRRAPXXRPXRXPXXXAXAKXXGPGHHRAGXGGXVXGHXHRHPEXLXEAXQLAVHHXV

SEQ ID NO: 182143 - protein, 32 aa, Triticum aestivum
  Clone ID: PAT_TA_76561.pep
SFNSSPLLSSNFFNLLLSLLNCLTYGKSHATV

SEQ ID NO: 182144 - protein, 99 aa, Triticum aestivum
  unsure (1)..(99): unsure at all Xaa locations
  Clone ID: PAT_TA_76562.pep
YRKXXAALQXWDESAXFFXPXFLKNFFIKLLFCFKXFXXXLRXXGXXSXDHLKKXXQQXSIFFFQEVDCLNKIHKPGFEXKXYLVAXSLGAYCPGGRRI

SEQ ID NO: 182145 - protein, 69 aa, Triticum aestivum
  unsure (1)..(69): unsure at all Xaa locations
  Clone ID: PAT_TA_76563.pep
RTAGXHPXIGCISEGSPFYLAANTSSRYRSNTCIHRSQPSGSQQTRMXAMMVRWIKPQVCRXXXXXXXX

SEQ ID NO: 182146 - protein, 81 aa, Triticum aestivum
  unsure (1)..(81): unsure at all Xaa locations
  Clone ID: PAT_TA_76564.pep
AGDERMSXEXTXLXXGXSXQXAGXESCWACSASSXXSTPVYSSHPRXRRXVRXXLPXKSRXHHHXXLLSXPACSXTLEXFA

SEQ ID NO: 182147 - protein, 49 aa, Triticum aestivum
  Clone ID: PAT_TA_76565.pep
EAAKLARYNKKPTITSREIQTSVRLVLPGELAKHAVSEGTKAVTKFTSS

SEQ ID NO: 182148 - protein, 67 aa, Triticum aestivum
  unsure (1)..(67): unsure at all Xaa locations
  Clone ID: PAT_TA_76566.pep
NQMGDEPPAVNGPMHVVPNVITAEFRTFIEVVFENPEKSMESMHIXXYAFFAVGMGPGKWTAAERKT

SEQ ID NO: 182149 - protein, 203 aa, Triticum aestivum
  unsure (1)..(203): unsure at all Xaa locations
  Clone ID: PAT_TA_76567.pep
MQRAELSTPDRLIWRWTVSGTYSAQSXYTATFHGSTGCHSWKLIWKCWAPPRVKFFHWLANQDRCWTAERQARHGLQHHPRCLLCDQQPETMRHLLLECPLARQAWHETLAWLCIXAPIPTQELSLTDWWNHAKEDTPPILRKALKSVSLLVPRMVWKHRNSRXFDNATPSLNTLLDSIHDEARSWAAAGAPGLRLVLPQTWD

SEQ ID NO: 182150 - protein, 98 aa, Triticum aestivum
  unsure (1)..(98): unsure at all Xaa locations
  Clone ID: PAT_TA_76568.pep
FFLGFSSNSSTLICWIYTLPDTRRLPRNNLDESYARSHQVQQAKLAKLVDVELGIMYCDVYTKAAXLRTRSGIILRCTSQVSAFLALVFFFTVGNKQR

SEQ ID NO: 182151 - protein, 65 aa, Triticum aestivum
  unsure (1)..(65): unsure at all Xaa locations
  Clone ID: PAT_TA_76569.pep
FQLPGRLHPXLXGPLLXQTQCHRRLQTWGXDPSNHHGQHTCLLTSVWLASVDTCVXPISXAXICS

SEQ ID NO: 182152 - protein, 81 aa, Triticum aestivum
  unsure (1)..(81): unsure at all Xaa locations
  Clone ID: PAT_TA_76570.pep
TDYILXXTDLFPXQGGMGXLXXSALTASAVASLSFYLLRXHLXWLXLRCLLGLCLXXXCFXCSXXXAXGAXLLRXRAFXMV

SEQ ID NO: 182153 - protein, 86 aa, Triticum aestivum
  Clone ID: PAT_TA_76571.pep
SAIAVLSTLTLLWVFLLHLSFLFVPKNMCMSMFMYLHRLSWPQRSLNCAIDFSKQGEKCIICSWPLSFVTFQPRSSGWRVRSAFTA

SEQ ID NO: 182154 - protein, 106 aa, Triticum aestivum
  unsure (1)..(106): unsure at all Xaa locations
  Clone ID: PAT_TA_76572.pep
QVXTFFLPTSGGIIXXWXTSHSSPQGLAXLTXGGNWXTXLGLLXFLSPPXLLTRSFSPLXQXVFSSFXLYPLPQXRXTWXIPPPGGFGGGPYWGWGDGLQSGGSSK

SEQ ID NO: 182155 - protein, 81 aa, Triticum aestivum
  unsure (1)..(81): unsure at all Xaa locations
  Clone ID: PAT_TA_76573.pep
GEQERLWXVXNDNPXXRXXTNXEXAGELLVVXDGELECXXARCGSSCCXLXVPRQLQNLSGRDTPAXRRGRRXAGGRPSRV

SEQ ID NO: 182156 - protein, 46 aa, Triticum aestivum
  unsure (1)..(46): unsure at all Xaa locations
  Clone ID: PAT_TA_76574.pep
FKQXRQXXTHLXKXKNKINNKTIYKNINXXNXYFFYRLSYLHLLIK

SEQ ID NO: 182157 - protein, 100 aa, Triticum aestivum
  unsure (1)..(100): unsure at all Xaa locations
  Clone ID: PAT_TA_76575.pep
DGGTLILLSLRNRLFFTFNCSAPNSGWXKVTHTSKDKCYVPILGRGVYAQESNAVYMVRKDVIYAYKLKLGHEETSLKLDPPVEICFPSVTRNTAHSFLT

SEQ ID NO: 182158 - protein, 130 aa, Triticum aestivum
  unsure (1)..(130): unsure at all Xaa locations
  Clone ID: PAT_TA_76576.pep
RNPSPNTDSSSYYFLSFKGVTVGETRLPVPESAFAIKADGSGGTIIDSGTDLTTFPDAVFRQLKSAFIAQVTLPVNKTADEDDVCFSWDGKKTAPMPKLIFHLEGADWDLPRENYVTXDHESGXVCVVVS

SEQ ID NO: 182159 - protein, 90 aa, Triticum aestivum
  unsure (1)..(90): unsure at all Xaa locations
  Clone ID: PAT_TA_76577.pep
ITLVFTNAARASTHYQKRQPQQRTGWRSSHIPTIHILLAILLEQILCRSHQAADVVAGIHALQGLXPYXPMRDAXHVTLCSIMTTMVSWF

SEQ ID NO: 182160 - protein, 206 aa, Triticum aestivum
  unsure (1)..(206): unsure at all Xaa locations
  Clone ID: PAT_TA_76578.pep
WCLNFEVEAKTKPRTHICLLQSPLSHXCHAIPSVHXTPXEPFMEITATTARGEIDSTRPFQSVREXVEVFGGVRRVAGCGDGSSCGSSASSSKFSXPRAASPPSSTLLGCLKKLEVDLAESRSEWRNSSRGSRRWRWPSPASACSSQTAWGPSPTPWSSRKGRSSPSSTSAGPRWSAQRRNTAMAGFAAIYGSTRRGPRSGWPASS

SEQ ID NO: 182161 - protein, 176 aa, Triticum aestivum
  unsure (1)..(176): unsure at all Xaa locations
  Clone ID: PAT_TA_76579.pep
MLTTKDTPALRAXNVEXYXFXXXPTWKQLRVVNILSGNYCQXXCAXXWVEXKFXDERQGKVQVVASPLIRLTNRPNATIEDIGSPEKLIASLGPFVTGNTLEPEEIIETSVEKIGDLTYYSYVLETPLALTXSHKXAKATAKGEHGRXLRXRAQAKQCSRRKXLKAMVDSFXYDCS

SEQ ID NO: 182162 - protein, 69 aa, Triticum aestivum
  Clone ID: PAT_TA_76580.pep
NILVIRVQVIRLPRENILVIRVQFNRLPREKILLIRVQVNRFHRIKVELACCLLNESVAEFSGRVDATG

SEQ ID NO: 182163 - protein, 176 aa, Triticum aestivum
  unsure (1)..(176): unsure at all Xaa locations
  Clone ID: PAT_TA_76581.pep
KFQRNXXXPGENSKRKNSHPKQQQKXLWNSIPQITLHNXPPXFSPXCIITTPXLXPTIIXQXLFLISILTXPIXTILLLIIIISXLSNIXIIIPIIIIKIIIILIMLSKPHHNTHHNISDHXAINQHDDXGGXGGREXQVMRLLPSPPSSSXXXXHXISXVSVHARXFLSWTKRPD

SEQ ID NO: 182164 - protein, 107 aa, Triticum aestivum
  unsure (1)..(107): unsure at all Xaa locations
  Clone ID: PAT_TA_76582.pep
TTNSLIINIITTKIFNTNFKLITFNTKKQIYPKLQLSNKIIPLILXSILYHFXXTXPXKKNTTPINITKQFXXVXSIAXXLHIXPTQTAXQNQIPTAXXARGEHXTS

SEQ ID NO: 182165 - protein, 69 aa, Triticum aestivum
  unsure (1)..(69): unsure at all Xaa locations
  Clone ID: PAT_TA_76583.pep
HAPAHSPSHHHHHQAPSPSSIHHHHHHSPAPSPXHHXHHHAPAPSSVHHHRHHAPASSPVHLDAKELDT

SEQ ID NO: 182166 - protein, 66 aa, Triticum aestivum
  unsure (1)..(66): unsure at all Xaa locations
  Clone ID: PAT_TA_76584.pep
PQTXDPAGFXLXXTLXCGSFGHILGVGXXXXLKNTGVLXQIXGXNLPFXSXAVLHPXRRXPXSGXI

SEQ ID NO: 182167 - protein, 68 aa, Triticum aestivum
  unsure (1)..(68): unsure at all Xaa locations
  Clone ID: PAT_TA_76585.pep
TKFHWKDLKHVINFVDNLTEIAQRMNAGFWXXLIXPXVHTMNKTNCVHKTLVKSXXLMLMLINYIYXQ

SEQ ID NO: 182168 - protein, 69 aa, Triticum aestivum
  unsure (1)..(69): unsure at all Xaa locations
  Clone ID: PAT_TA_76586.pep
TKGPMKXDXRKNYYWLDRILXELSIXDLFRRCWIXPSXVLRXGTCKSXRSFDTXGRCKWPLGSVISFHM

SEQ ID NO: 182169 - protein, 55 aa, Triticum aestivum
  Clone ID: PAT_TA_76587.pep
TMDFIALPCDTCSSCHNLPFYNERYITINILNIRGEMLNQHQGLNKALSSMHSKF

SEQ ID NO: 182170 - protein, 54 aa, Triticum aestivum
  Clone ID: PAT_TA_76588.pep
LLDEREPASYDCHSTNLFDVCILRGDQVGFHFVMHVSHVFAESVDTEFDRAPKN

SEQ ID NO: 182171 - protein, 59 aa, Triticum aestivum
  unsure (1)..(59): unsure at all Xaa locations
  Clone ID: PAT_TA_76589.pep
CVMLDGNRFLSSWLCGGWGXSPXPSVASHXXAXFXVPFCXQVXGXXXLXCXKXPXHVXP

SEQ ID NO: 182172 - protein, 67 aa, Triticum aestivum
  unsure (1)..(67): unsure at all Xaa locations
  Clone ID: PAT_TA_76590.pep
LEVRFYGGGFSXSTPASTGQRXRXSPGRSSVLTLTAERSQSXFSXFDXPMVXQICXXVRXSSFNLXV

SEQ ID NO: 182173 - protein, 107 aa, Triticum aestivum
  unsure (1)..(107): unsure at all Xaa locations
  Clone ID: PAT_TA_76591.pep
TTASLVVPPLDIVSFALXTSLVPXRSLNSYKIKRAGMSRKINGTLLVQFDTFXAXCXGYSPLVTTFRXLKSCVLLQITLLENFCLFSTLGHGXPVSSTTGXDQVRGL

SEQ ID NO: 182174 - protein, 29 aa, Triticum aestivum
  unsure (1)..(29): unsure at all Xaa locations
  Clone ID: PAT_TA_76592.pep
FVIRSQPRIKYYLYIXNXYXXYMYIMXDV

SEQ ID NO: 182175 - protein, 62 aa, Triticum aestivum
  Clone ID: PAT_TA_76593.pep
NMVIYDAPNNYLPHSFSDTSLHQVCSFTSTCRPRDSKIMEPKSSSCLPKHSWNSAQKPNTLV

SEQ ID NO: 182176 - protein, 77 aa, Triticum aestivum
  unsure (1)..(77): unsure at all Xaa locations
  Clone ID: PAT_TA_76594.pep
REHQARDRHRGXRSSSRHRHRXXDRRSSHDRNXHXQSRQGHDKEXGRXRSXXPRSRRRXRPPRDXPRDXDRXGRXDX

SEQ ID NO: 182177 - protein, 125 aa, Triticum aestivum
  Clone ID: PAT_TA_76595.pep
ISIFIRDIKDLYRQDQYNLVVCNPATKKWAELPPNPIQLQDEDEEEVEEYLCFDPAVPSRFMVFTHTWDFTEVTIYSSDTGRWTTVESGWIDKTPIGLPVFLNGRLASLSVVNWPSHTFILSHVC

SEQ ID NO: 182178 - protein, 45 aa, Triticum aestivum
  unsure (1)..(45): unsure at all Xaa locations
  Clone ID: PAT_TA_76596.pep
MMETSPRHFEPLMSSXMAMLYMLYMCSALCIQTKLRGKVKVKMQF

SEQ ID NO: 182179 - protein, 56 aa, Triticum aestivum
  unsure (1)..(56): unsure at all Xaa locations
  Clone ID: PAT_TA_76597.pep
APTAKXDYCPXSRVXVSCMEXXKXPNCYGAXFTDIXXKXKXXXXRERNKKWCIXLR

SEQ ID NO: 182180 - protein, 76 aa, Triticum aestivum
  unsure (1)..(76): unsure at all Xaa locations
  Clone ID: PAT_TA_76598.pep
KAPXGXXSSIWCEIRVKAVRNLERVIWASPIGDXYPGXNXDDXLVRPXSXHXILXLILXPQXEKLCRESCDIICLG

SEQ ID NO: 182181 - protein, 181 aa, Triticum aestivum
  unsure (1)..(181): unsure at all Xaa locations
  Clone ID: PAT_TA_76599.pep
SFXHEVFRICMKXEGLXSGAKNVTDNQGSKLRHWFRSQMKDGDLNNEDQTEGQPNVRLYACRYMDEIFVAVVGSRDIAETVKSEVVDYLSKSLYLKVDDGLXLVPVKKDSWGLQFAGTVVKAATKESXALKTVHKLKEKVRLFACQKQEIWDAMNLRLGKKWLAYGLRRVKESEIKSLGLS

SEQ ID NO: 182182 - protein, 114 aa, Triticum aestivum
  unsure (1)..(114): unsure at all Xaa locations
  Clone ID: PAT_TA_76600.pep
ASSTPRSSXXSPTTATXTSTSPRRDPIHHPIPIXDFXSSIEIPXEAVDQAIPXAALLIEAVLSXSVLLFYCIIMQACGXSLQLXLVKFICCHDXLLVPDSWTAVAIXLSSIYQG

SEQ ID NO: 182183 - protein, 37 aa, Triticum aestivum
  unsure (1)..(37): unsure at all Xaa locations
  Clone ID: PAT_TA_76601.pep
PFLLXLXLYFPLXPYIXHYKXXSLSYFLSLLXNLFPL

SEQ ID NO: 182184 - protein, 69 aa, Triticum aestivum
  unsure (1)..(69): unsure at all Xaa locations
  Clone ID: PAT_TA_76602.pep
DRRAPRPSRXARQACRSPRAPRPXPSLPPLRXXAAHRVXCQFGFXXXCVNNXQGVXPPYTNIVXXSPXF

SEQ ID NO: 182185 - protein, 53 aa, Triticum aestivum
  unsure (1)..(53): unsure at all Xaa locations
  Clone ID: PAT_TA_76603.pep
WQSRERXXRFGHXRQERDHQERHRSRRRTXLNKGWDXVNRALPSKAXTHATHA

SEQ ID NO: 182186 - protein, 30 aa, Triticum aestivum
  unsure (1)..(30): unsure at all Xaa locations
  Clone ID: PAT_TA_76604.pep
IRFLTGLKAYSRIFXRIXFGXXRXKYVXED

SEQ ID NO: 182187 - protein, 60 aa, Triticum aestivum
  unsure (1)..(60): unsure at all Xaa locations
  Clone ID: PAT_TA_76605.pep
ALHHRTAXCRGSERPGLXXXKQGVXRGYVGLILPCQNQFCSCSPRTPTQLLCATVPLRIS

SEQ ID NO: 182188 - protein, 54 aa, Triticum aestivum
  unsure (1)..(54): unsure at all Xaa locations
  Clone ID: PAT_TA_76606.pep
TSGDVQRAIQLMXXXXRNXSXXXXXPVLCIVHLLSSRSMNNQXNIXXGNHXLST

SEQ ID NO: 182189 - protein, 128 aa, Triticum aestivum
  unsure (1)..(128): unsure at all Xaa locations
  Clone ID: PAT_TA_76607.pep
ESVPPKQLFGKDIFELLQKLDHLQGFKYGKHPGNKKRKASSKDIPRKNFTKMSILFELPYWKDLKLPHNLDVMHIEKNICESLFGTLLNIDGKXKDTLKARKDLEDMNIREDLHLNDTGSSVEKHHAW

SEQ ID NO: 182190 - protein, 54 aa, Triticum aestivum
  unsure (1)..(54): unsure at all Xaa locations
  Clone ID: PAT_TA_76608.pep
GSXDSAKQSNGCPHAGVAIKVKTKVFFHRKLYHXXHXILNQVVNADPLEKKGCV

SEQ ID NO: 182191 - protein, 105 aa, Triticum aestivum
  unsure (1)..(105): unsure at all Xaa locations
  Clone ID: PAT_TA_76609.pep
SGRNXGXQKGVXRTRRNPLVXVXLASSXXAAQGPRSEXXVXPXKFMIQYCCSRXXIPSPTXHXKIECFSGXGKYSEGXAXAXXPFVVXTDTVXVSXXLFFXLVRK

SEQ ID NO: 182192 - protein, 170 aa, Triticum aestivum
  unsure (1)..(170): unsure at all Xaa locations
  Clone ID: PAT_TA_76610.pep
TMFXLKFTNFXHKRYKEAKXILFIXXXXTAARHHMQQSQLXDXAFSXSMFXVGIGTRGAPHIVAFVYTNFRIGQRRWQVTXGVRVAGVQAGAKGVGDVVEXXAATGAHQLAEPRRXAVVAPRXALPVALALDFGQLLMGWLWQHEXEEHXQXGXXGRSLLRLHLLGLXIV

SEQ ID NO: 182193 - protein, 64 aa, Triticum aestivum
  unsure (1)..(64): unsure at all Xaa locations
  Clone ID: PAT_TA_76611.pep
TYXFVARFXXFSMAHWYXQIIYLATTNIINFSLFXXSLMHCKLDAYTVILGRDLVIHWVFCSFR

SEQ ID NO: 182194 - protein, 54 aa, Triticum aestivum
  Clone ID: PAT_TA_76612.pep
QECWEQLHHPTQFQAIYRKEERAPLEVATSEELSCARRTDYSKAEPSTRSWHLS

SEQ ID NO: 182195 - protein, 74 aa, Triticum aestivum
  unsure (1)..(74): unsure at all Xaa locations
  Clone ID: PAT_TA_76613.pep
SVVRHPARGGPPRTXEISRXPATGGXGSHAYARGPQIRPXXDEIGIYKIHLGRSVFTHGRXTWGKTPGRFTPNL

SEQ ID NO: 182196 - protein, 79 aa, Triticum aestivum
  Clone ID: PAT_TA_76614.pep
LLSIRGLGLKSVECVRLLTLHHMAFPVDTNVGRICVRLGWVPLQPLPESLQLHLLELYPMLENIQKYLWPRLCKLDQRT

SEQ ID NO: 182197 - protein, 52 aa, Triticum aestivum
  unsure (1)..(52): unsure at all Xaa locations
  Clone ID: PAT_TA_76615.pep
KIXVMMGGHGXQAGNFNXAIXXKNRCNYGFXXNXAVVVVIPSSLXVVWIFXL

SEQ ID NO: 182198 - protein, 75 aa, Triticum aestivum
  Clone ID: PAT_TA_76616.pep
MDVIFLRLTHGAVFGDVFGIHTSPHACWNCSLKKPPSKRLNSRSNAIVFPNLAKKCFYKSKHLPSLRSSFLRKNL

SEQ ID NO: 182199 - protein, 92 aa, Triticum aestivum
  Clone ID: PAT_TA_76617.pep
ASFMTNCVEQKANHNPLDSSKRNTTLTNDGRGDDDRSKGKMAESLLEEKLDSHDDDDNEVENYRLKKRRKLIGYEGEDDDGGGQNLAGVESG

SEQ ID NO: 182200 - protein, 114 aa, Triticum aestivum
  unsure (1)..(114): unsure at all Xaa locations
  Clone ID: PAT_TA_76618.pep
WVARDSSVLMGNGSHASVRGIGTVDLKFTLRKIVQLRNVQHVPTMNKNLVSGSLLCRDGFKVVLESNKVIVSRFGQFIGKGYXCXGLFRFSLSDFCNKSINQICAXVNXDASIW

SEQ ID NO: 182201 - protein, 151 aa, Triticum aestivum
  Clone ID: PAT_TA_76619.pep
MEAFTKTKEVDKNSDHEDSPEAGNREMAAPLIDLNMALPEPTELDQRYDSYSEVLNLEHTHEETLSSNVQLHDGRENLKIFSVDSHRLESEQSTADLERITNSSLVGTLLHGEAIKVSDVDAAGSPLSLTELAETRRGCSNVSVKDTMTMS

SEQ ID NO: 182202 - protein, 105 aa, Triticum aestivum
  Clone ID: PAT_TA_76620.pep
LNYSLVQSFPDYIGELIHLRLLDLDYTGISCLPESIGSLKNLQVLSLRHCKALHSLPLAMTQLCNLRCFFLIGADINHVPKGIGKLKFLNALQGFPVGNGSDNAD

SEQ ID NO: 182203 - protein, 68 aa, Triticum aestivum
  unsure (1)..(68): unsure at all Xaa locations
  Clone ID: PAT_TA_76621.pep
TEVLRAFNPIYIYYYFERNLTQAWISPGGCLLCETRYEAMFADXCYSVRSVQLVYQXRATCSFCEELD

SEQ ID NO: 182204 - protein, 61 aa, Triticum aestivum
  unsure (1)..(61): unsure at all Xaa locations
  Clone ID: PAT_TA_76622.pep
MAPTKKXKKSGENINNKLQLVMKXXKYXXGXKTVLXRLRSSKGKLIIXANNXPXLSKSEIE

SEQ ID NO: 182205 - protein, 48 aa, Triticum aestivum
  unsure (1)..(48): unsure at all Xaa locations
  Clone ID: PAT_TA_76623.pep
AEVQTEHTNXQRGXPXQHXPIKSXYCXNNKYTHITLHNLTXFFPTNIQ

SEQ ID NO: 182206 - protein, 149 aa, Triticum aestivum
  unsure (1)..(149): unsure at all Xaa locations
  Clone ID: PAT_TA_76624.pep
YELTIRANLGPDXRNASXAANGRXXGIQISXGRRPEVXGTFRDVFLGSELRKKRIFVRYIRAXSTKXYPVVHFAIXLLXPRXTYXKXXXVEEXGXKVYWNKSQLVDCTAAGACTSCCAXAIRYGLXSRMQNKVXSGKSXXAASXSRRKV

SEQ ID NO: 182207 - protein, 73 aa, Triticum aestivum
  unsure (1)..(73): unsure at all Xaa locations
  Clone ID: PAT_TA_76625.pep
SVPFFQLLEPXHRSLTGHYQAEVDLGRRFSHQTISLDAYFTXSCNLSRSXLKGNXVHVAPVAQGPPQGPTTXV

SEQ ID NO: 182208 - protein, 88 aa, Triticum aestivum
  unsure (1)..(88): unsure at all Xaa locations
  Clone ID: PAT_TA_76626.pep
VADDHSPDPLLSQFICTVAPPVIDPEPSKAEEVDHAAPSSDDQRLNQVVMDDASKQDLEERLRRVEFVKQMLMTTXAWDWFSRAGYST

SEQ ID NO: 182209 - protein, 70 aa, Triticum aestivum
  unsure (1)..(70): unsure at all Xaa locations
  Clone ID: PAT_TA_76627.pep
MHPTKRNKTFSSGXXMKRAXISPXPKDEGVXCVXDXQHXDQAEKMGLDYMDVESLKKMNKNTKLVKXYQE

SEQ ID NO: 182210 - protein, 51 aa, Triticum aestivum
  Clone ID: PAT_TA_76628.pep
LQMRYVRDSIWRGSPAPSQEEEAGLPCRHSPATTTTDHVMILFYSISVGNH

SEQ ID NO: 182211 - protein, 93 aa, Triticum aestivum
  Clone ID: PAT_TA_76629.pep
SPRVVVRSCCPPVGRLTTPASSDARSLPQAGWHCSTTSTSSLAPMMAGYTNNYGRSLPGRLPWSPTAYLIAHLDYLHEERDNPIISTNMFPPI

SEQ ID NO: 182212 - protein, 52 aa, Triticum aestivum
  Clone ID: PAT_TA_76630.pep
VLGATSGIQFSFVHNSACVVLFNSANAQRVITFKQTLEHFAINICSILHVYK

SEQ ID NO: 182213 - protein, 53 aa, Triticum aestivum
  unsure (1)..(53): unsure at all Xaa locations
  Clone ID: PAT_TA_76631.pep
VQXFFFFFFFLVIYLFFPYLTKRKTFVECSSPNCPLXLFHSKRTTPAHKNKVT

SEQ ID NO: 182214 - protein, 44 aa, Triticum aestivum
  unsure (1)..(44): unsure at all Xaa locations
  Clone ID: PAT_TA_76632.pep
CSKXRQTKYXQETHCXXXSXNRTLQHLSTSLSSLKAHHPATXSF

SEQ ID NO: 182215 - protein, 179 aa, Triticum aestivum
  unsure (1)..(179): unsure at all Xaa locations
  Clone ID: PAT_TA_76633.pep
RAGEASRVFGGGSRVVSRXXSSRSLGXXRSRSSQGEVGXIXSGQVTLLDXXSXQVEVGLGEGXSRSGSSGREGGKKSVXVGGGSIVRSFRQSINQSLRESXGRHRXSRRXQSXGXREEXSVXATRAVSCFLLHGTLAFIYLGXXEXPVSSSFVWFSLDLGLNVLFCFGRGVIGRCIYSK

SEQ ID NO: 182216 - protein, 83 aa, Triticum aestivum
  unsure (1)..(83): unsure at all Xaa locations
  Clone ID: PAT_TA_76634.pep
GNAFHGGWWSPVESFGEKLCASMIIGVCMFRQFNSKTRMCHKLFFFFFFFLIKYIFILYLLSIVVXYIICYKLCQTYIMFDLN

SEQ ID NO: 182217 - protein, 47 aa, Triticum aestivum
  unsure (1)..(47): unsure at all Xaa locations
  Clone ID: PAT_TA_76635.pep
XXAXSAIWLSLVHWLDLSFPCKFFAFMFYIGIPSVLANTLFLTDRXK

SEQ ID NO: 182218 - protein, 82 aa, Triticum aestivum
  unsure (1)..(82): unsure at all Xaa locations
  Clone ID: PAT_TA_76636.pep
LETTKRLVEELKHKLERAEVELEQSKQDSELAQLRAQEVERGIDNGASVXAQTELAVAKERHQKAIEELKMVKEGLGSTQEQ

SEQ ID NO: 182219 - protein, 44 aa, Triticum aestivum
  Clone ID: PAT_TA_76637.pep
TWNSGSVLALKKCRWNIAQQIKMNIAHKSDLTAPLFFFSHLLRY

SEQ ID NO: 182220 - protein, 65 aa, Triticum aestivum
  Clone ID: PAT_TA_76638.pep
FFGNNRILLIMKIERNIASNYITEFSKCRHPLYTILLCELELWNQGHAFCPCTVGKLCPPTTLNP

SEQ ID NO: 182221 - protein, 59 aa, Triticum aestivum
  unsure (1)..(59): unsure at all Xaa locations
  Clone ID: PAT_TA_76639.pep
SRSXELXSFGSXMXVXXGLLXGCFXAXVXNVKXAMXFGFVHAXXSQXVXLXFXNSXXHG

SEQ ID NO: 182222 - protein, 85 aa, Triticum aestivum
  unsure (1)..(85): unsure at all Xaa locations
  Clone ID: PAT_TA_76640.pep
GLSLQELYPSXFXERLLYXAFSRIKTHNVVAIHQLLHIFSNHHRLLLSTTRAHXXYSSTXPGGRSGRXFLLLCWSISRILRSVXV

SEQ ID NO: 182223 - protein, 80 aa, Triticum aestivum
  unsure (1)..(80): unsure at all Xaa locations
  Clone ID: PAT_TA_76641.pep
TKIWINFLYISQSHRKNKIFYSXIVSFCVSSLLXQXMFTGRTKSSTSLTKITSAPKTNPQTNXFLSLRFSRTPLRFFWAT

SEQ ID NO: 182224 - protein, 54 aa, Triticum aestivum
  unsure (1)..(54): unsure at all Xaa locations
  Clone ID: PAT_TA_76642.pep
TLLFPLQHKPASRWLALPPSQFVSSGLPVSIYSFGVLXFMVLCLASALVVVYCY

SEQ ID NO: 182225 - protein, 106 aa, Triticum aestivum
  unsure (1)..(106): unsure at all Xaa locations
  Clone ID: PAT_TA_76643.pep
RPGSSRXPPPXXKXRXTQPPVXXPXXPAPXRGAXSPQEQGRCANQQKRAEGXXKNXKVAAQKDEXRKPXAGXXXRMXXXXSRXXTEXFRTTXLSVWLXLQPAGSVV

SEQ ID NO: 182226 - protein, 64 aa, Triticum aestivum
  unsure (1)..(64): unsure at all Xaa locations
  Clone ID: PAT_TA_76644.pep
TTPVDMWIFRITNPKTIERTTETITARXSPAPITQAAAXXQMPAPRMPPTMGRRSXHPLRVTNY

SEQ ID NO: 182227 - protein, 57 aa, Triticum aestivum
  unsure (1)..(57): unsure at all Xaa locations
  Clone ID: PAT_TA_76645.pep
FFRSRPTSSVYPNMDVCFNEIIQVRSRRXXXENCPELLXHRPXXGFEQRKGYKKVIF

SEQ ID NO: 182228 - protein, 39 aa, Triticum aestivum
  unsure (1)..(39): unsure at all Xaa locations
  Clone ID: PAT_TA_76646.pep
AXMPLXVKXPXELLXSNLLFEKXAPXXIXTCYMHXVTPN

SEQ ID NO: 182229 - protein, 68 aa, Triticum aestivum
  unsure (1)..(68): unsure at all Xaa locations
  Clone ID: PAT_TA_76647.pep
DXCXXXGQRTVXXTHPRRDMGXRTXPSPPRPTXXXRNXIVPXPPXPXXYXFLPKPPTGYDEFSTSQIK

SEQ ID NO: 182230 - protein, 64 aa, Triticum aestivum
  unsure (1)..(64): unsure at all Xaa locations
  Clone ID: PAT_TA_76648.pep
CXAPNYVMIIMTADLWCLLLILVERQIQTILSLFCTGVNSHLFWMKAPFRLLRIFPSACWWNST

SEQ ID NO: 182231 - protein, 75 aa, Triticum aestivum
  Clone ID: PAT_TA_76649.pep
QPIASYSILSAIQKGGLKFDLGHREEVVRCDIMRIGKQTPLQLSLSRDCACWHQAMDLLQKDIMVCLVLIQGPRR

SEQ ID NO: 182232 - protein, 67 aa, Triticum aestivum
  unsure (1)..(67): unsure at all Xaa locations
  Clone ID: PAT_TA_76650.pep
HDRRNHVXXPKALEWTLNWCIFQSMFDSKFCVRKDFLASPAALKKRLVFVGIAMLILSPCLVICPLV

SEQ ID NO: 182233 - protein, 47 aa, Triticum aestivum
  unsure (1)..(47): unsure at all Xaa locations
  Clone ID: PAT_TA_76651.pep
WDXEGXASRVXXGSVNRXAGRLPXVSXVTNWTELVXRGSVSSGSAWX

SEQ ID NO: 182234 - protein, 71 aa, Triticum aestivum
  unsure (1)..(71): unsure at all Xaa locations
  Clone ID: PAT_TA_76652.pep
XXPXXXQAXWSXLADFDGXKLXREGTGXLSDRVXXXMXXSAMTAPSNSXTYVXCXVXGXXXCXXNDXXXDX

SEQ ID NO: 182235 - protein, 80 aa, Triticum aestivum
  unsure (1)..(80): unsure at all Xaa locations
  Clone ID: PAT_TA_76653.pep
FKXGDXXNKXMMQLKYRFXVTRIIXCRCKXKASXXHKLXQPPSPVXKKESKXKXHSLRAQGGXPCRXRSRXCXXRXRXGA

SEQ ID NO: 182236 - protein, 52 aa, Triticum aestivum
  unsure (1)..(52): unsure at all Xaa locations
  Clone ID: PAT_TA_76654.pep
FTLXFQRSNQXXTKYLXKVXPESIKGLCLVHLLLCTKRPAXAAAQITTQFPP

SEQ ID NO: 182237 - protein, 126 aa, Triticum aestivum
  unsure (1)..(126): unsure at all Xaa locations
  Clone ID: PAT_TA_76655.pep
XPSXSQPNPRSPLXLLSHNLTDRSRTNRRFAHHRXTHLTDXSTLXKIPXAXXQSLLDPSWNSIXHSGTXFDPFISKESEPVSXVSPRGVSXNXLSKNAPXIAXIXHSHVFPSIDPSNIPRSIARPH

SEQ ID NO: 182238 - protein, 54 aa, Triticum aestivum
  unsure (1)..(54): unsure at all Xaa locations
  Clone ID: PAT_TA_76656.pep
RCYCCRVAVEXXFFSMKECMTECVKKMGFXXGGWGRGWXRXSDXLATLFFQKNX

SEQ ID NO: 182239 - protein, 81 aa, Triticum aestivum
  unsure (1)..(81): unsure at all Xaa locations
  Clone ID: PAT_TA_76657.pep
HRRYRERSPVXDPTHSRHDAHTRQRGRAAAHTXHACTSSXTMTTVSDXELXXVVXVXXKXSFVRRXCXXQXXVSSVRIFFS

SEQ ID NO: 182240 - protein, 64 aa, Triticum aestivum
  Clone ID: PAT_TA_76658.pep
QAAAEKQVQLAIAKVDTAKGDKAKLDAFMLAYKKVGEQVLATPPAQKFLVMEKGFTEAASSLAP

SEQ ID NO: 182241 - protein, 79 aa, Triticum aestivum
  unsure (1)..(79): unsure at all Xaa locations
  Clone ID: PAT_TA_76659.pep
LKQGSLLSSRSSNALQSSLGDGQNGILLGRDATHQRQDSTFYXPSPPCYLHIHISSSDQHVGHEIDGSMSXKHSPXHHY

SEQ ID NO: 182242 - protein, 97 aa, Triticum aestivum
  unsure (1)..(97): unsure at all Xaa locations
  Clone ID: PAT_TA_76660.pep
XNPIXXXXXFKXAQXSXQNLXSXGGMAXIKXELXPXVPXSIXCSPEIKYSPXAYXXMFXTMGKXKXSXFXVLWQXPCCIWLLQFFGEVNVVXKHRFP

SEQ ID NO: 182243 - protein, 77 aa, Triticum aestivum
  unsure (1)..(77): unsure at all Xaa locations
  Clone ID: PAT_TA_76661.pep
KHVSLLLSKMFVVGSVFLTYPSACIVEKYIXPDKKYSIADLEIXNWPXQTKTTLLMLQKWIIQXQIVMPPSIKSLRT

SEQ ID NO: 182244 - protein, 65 aa, Triticum aestivum
  unsure (1)..(65): unsure at all Xaa locations
  Clone ID: PAT_TA_76662.pep
FFXFXXGXTFTPNWXLFGGKIYXCMYKKEGNKIRKGWVFDLXFFFLXYLFGLWLRFXVVLVFSXG

SEQ ID NO: 182245 - protein, 83 aa, Triticum aestivum
  unsure (1)..(83): unsure at all Xaa locations
  Clone ID: PAT_TA_76663.pep
VVARQTGRKNEYEITXXSGXXWPVXKXWRXGWXPEXFKNCEYEFVEIVAQIDXXXKVHPLGKVDXXRXVFGRGXGVKTIRKDE

SEQ ID NO: 182246 - protein, 83 aa, Triticum aestivum
  Clone ID: PAT_TA_76664.pep
HDSPFIHSVGRMFAFQTLIQYFSSYPQTQESQSSHSMVVTDKQGHRDPYAPSLPLLSPSGPQYLNFELETQCPTIMLSDGILQ

SEQ ID NO: 182247 - protein, 83 aa, Triticum aestivum
  unsure (1)..(83): unsure at all Xaa locations
  Clone ID: PAT_TA_76665.pep
IWXCLRXXKGXXXDIQXKPCGXRVIRTPIVXRXFXXRHTXLDPLXFLPXNXHEEXXTXIPHDXXXWXXPXAXGRISFGCNGXX

SEQ ID NO: 182248 - protein, 46 aa, Triticum aestivum
  Clone ID: PAT_TA_76666.pep
LQLAPFYPSPIHNMNLYHLVAPTGRLESSKYPKTLYKIRQEQDQRH

SEQ ID NO: 182249 - protein, 46 aa, Triticum aestivum
  Clone ID: PAT_TA_76667.pep
SLLLHVTSSSRGIDGVSREERVGVSKKSAWRGKVLQGQEQPERRCL

SEQ ID NO: 182250 - protein, 139 aa, Triticum aestivum
  unsure (1)..(139): unsure at all Xaa locations
  Clone ID: PAT_TA_76668.pep
PRXVNXETXXXPXXXXXXKPXPDXXPEXXTXREQXXSXITNLPXPXQMXXXKARXDMXAHAXQXAXRVIXECXKNHGLGTRQGXNXGXMLDKGXAGKIXEQENXLXAGVNYGEGLXVSGDXREMYSSLXXXLIEVRGGR

SEQ ID NO: 182251 - protein, 103 aa, Triticum aestivum
  unsure (1)..(103): unsure at all Xaa locations
  Clone ID: PAT_TA_76669.pep
IGLSEPKFSSAYFHGPARVRDSLHWCLFYRPGTPLEDCEAGWELVVFDTIAESFRQMXAPVDXTKSCILEMDDMLGIYCCNKAAEVVDIWVLPNYDSEVWDLK

SEQ ID NO: 182252 - protein, 78 aa, Triticum aestivum
  unsure (1)..(78): unsure at all Xaa locations
  Clone ID: PAT_TA_76670.pep
CRGLLPWGVXGXGXFXXXWPRLXCFWPXWXXRGXRWLXRSLXXRXGFVAPPPPSXGGXAGXXXXCXXFLXVXCXXXGV

SEQ ID NO: 182253 - protein, 145 aa, Triticum aestivum
  unsure (1)..(145): unsure at all Xaa locations
  Clone ID: PAT_TA_76671.pep
PKAXXXPPXNHTKREPXNPPTTTXHREEPPGDTPREPDETTTKRRQTRDTXKAPQQAHKTXDETPPEAETAERGHPPXPDATGPPRAXGXHXGSPPHPTPKQXRPRKPSHPGEQQQPPSGGPPRPPGVVIASGCGSNTRLGFVSS

SEQ ID NO: 182254 - protein, 87 aa, Triticum aestivum
  unsure (1)..(87): unsure at all Xaa locations
  Clone ID: PAT_TA_76672.pep
RPKRYEXSVITRFIRKNINKTKNNTPXQTERFEHFSFXESRRXKXKXXISNAWQHPSVXYSXSXVTCHTMRPPRXRXXCXXCRXVXA

SEQ ID NO: 182255 - protein, 81 aa, Triticum aestivum
  unsure (1)..(81): unsure at all Xaa locations
  Clone ID: PAT_TA_76673.pep
PPRXXAPXRPXKPRQTPLXXREPKNKGAPPRTPKTQPPRNPXTTRPPHRQRETPRTHADPQPPPPPTSPRGNRAHTSTHAR

SEQ ID NO: 182256 - protein, 131 aa, Triticum aestivum
  unsure (1)..(131): unsure at all Xaa locations
  Clone ID: PAT_TA_76674.pep
HPFDLFIKDRGTRDILLSGRLCQGLYRLEXPGVARVFSGVXXXPSQWHARLXPPXXPIVRHXLRRHELPSLSSNKXVAVCDACQQGKSHQXPFSEXSREVKXPLELVFSDVWXPAQTSVSGHNYXXSFVDA

SEQ ID NO: 182257 - protein, 73 aa, Triticum aestivum
  unsure (1)..(73): unsure at all Xaa locations
  Clone ID: PAT_TA_76675.pep
QTFXHYAALQLLVSNILNCSGHFYRKSSYSQAVSRRKKTKSLHTDXPGLHQKSDVMVITYNFVFNSXLTSTRR

SEQ ID NO: 182258 - protein, 55 aa, Triticum aestivum
  unsure (1)..(55): unsure at all Xaa locations
  Clone ID: PAT_TA_76676.pep
SENYLSTSNXKDFSLVNXLIXKSXPKXKXRNDLXXEQANRIXGGAMGGXXMXXXX

SEQ ID NO: 182259 - protein, 44 aa, Triticum aestivum
  unsure (1)..(44): unsure at all Xaa locations
  Clone ID: PAT_TA_76677.pep
XLHTYLAXXXAXXLXLXASTVSLIVSLFSRKGXXXXHXXLLPVX

SEQ ID NO: 182260 - protein, 85 aa, Triticum aestivum
  unsure (1)..(85): unsure at all Xaa locations
  Clone ID: PAT_TA_76678.pep
PSTYIRKYYRLNIYLGINEGSPLPMPYPMEAKWRCVAPCRVHSEGVGNPSDFXFXYFSDLGGFGGGDLAGGRPSPPTSTSSSCCS

SEQ ID NO: 182261 - protein, 44 aa, Triticum aestivum
  unsure (1)..(44): unsure at all Xaa locations
  Clone ID: PAT_TA_76679.pep
LKPXXXPNTFXVLVXSASLXTLNQHRNPAXXSIXIRHLLNIXXA

SEQ ID NO: 182262 - protein, 51 aa, Triticum aestivum
  unsure (1)..(51): unsure at all Xaa locations
  Clone ID: PAT_TA_76680.pep
SMILXLRCXVXDYXEXETSYVVLXVVYLECFICGXILXXMFYGMFYGEXLV

SEQ ID NO: 182263 - protein, 85 aa, Triticum aestivum
  unsure (1)..(85): unsure at all Xaa locations
  Clone ID: PAT_TA_76681.pep
RHXMISXELWTRQHYXMXEXGLHXTTXVXNSEXXTGXSXSFRXGEXXVDXXHDXGGLVXHIXXEAMXGVRLPXXWFXXXXXAXPI

SEQ ID NO: 182264 - protein, 105 aa, Triticum aestivum
  unsure (1)..(105): unsure at all Xaa locations
  Clone ID: PAT_TA_76682.pep
YVLLKDKGKEDDILKXXFYGXVLXYFINVLNVNLKRMGTXYEXDKGLYDYVNQNLLXMDFLRXLKNFRKIVIWXYGVFKRKEREKGWIMFEWLLXLGVAGXCGVQ

SEQ ID NO: 182265 - protein, 101 aa, Triticum aestivum
  unsure (1)..(101): unsure at all Xaa locations
  Clone ID: PAT_TA_76683.pep
RGAGSHAWSLEVYIGLQEKELXRSSFHWQRLIFSPARWLESGDRCLPRRQQPSAVHENNGTQFLLVGVRSLFQVLQPQGTLESTNHWLDLAALLLLNLSLI

SEQ ID NO: 182266 - protein, 101 aa, Triticum aestivum
  unsure (1)..(101): unsure at all Xaa locations
  Clone ID: PAT_TA_76684.pep
QQDKITDSLQLDHRIQPTSMYIXSPAILLPPTRACIYICXKKXLSLXLLPNHLGFPRHYIASSHQHSTTKRLPCSGSRRQLKASMHDPGHLDYYIIENTPC

SEQ ID NO: 182267 - protein, 184 aa, Triticum aestivum
  unsure (1)..(184): unsure at all Xaa locations
  Clone ID: PAT_TA_76685.pep
DDXRRPVRYGTSSKDGTRPARTFLKHYAHPLSEXLQXXPEKPPTSXXDLXKISXXVXRVALXLXEPILXGLXLGKDYQHXXFQRGLXLLQVNCYPKEPEGDSXXGXXPHXDHGFLTILLASCSGLEVLDRSSNPWRVVQQPRHALXVHXGDYMEVLSXGXIRTXVXRAVLXPGXARISMASIHS

SEQ ID NO: 182268 - protein, 65 aa, Triticum aestivum
  unsure (1)..(65): unsure at all Xaa locations
  Clone ID: PAT_TA_76686.pep
YELQQQLTKRHXLWLGAKTXXSCLAILSITGFPSCRRLLVLAPSHLVLPFLVCWWLGAKTTVYXR

SEQ ID NO: 182269 - protein, 76 aa, Triticum aestivum
  unsure (1)..(76): unsure at all Xaa locations
  Clone ID: PAT_TA_76687.pep
TNTSGIGLHGNPTASNLQQTNFALLHQMQAMGHVDVDPGNKTGKMLKPNEXSXDASQVDWKSAQRLHPPITHPGRL

SEQ ID NO: 182270 - protein, 60 aa, Triticum aestivum
  unsure (1)..(60): unsure at all Xaa locations
  Clone ID: PAT_TA_76688.pep
TRXAWLCYSSGPNYIXFSVDNLSKKTMXNCLKLAPFHHKCAEACIIYACLXRPSSSXLSS

SEQ ID NO: 182271 - protein, 117 aa, Triticum aestivum
  unsure (1)..(117): unsure at all Xaa locations
  Clone ID: PAT_TA_76689.pep
FTMVHXQXSCSNXRSFTSSGKRWXCXQPXSXXXXTXPYXXXXEXEXRERHPSNXRETHELXPVXIVGVPXETKDXETRIIESQVFRTPXTXSSXFVXRPHHXLXPPRXXKXPSMXVL

SEQ ID NO: 182272 - protein, 60 aa, Triticum aestivum
  unsure (1)..(60): unsure at all Xaa locations
  Clone ID: PAT_TA_76690.pep
LVXLEFXCYCLXFXXWCVXACMXGXXKFRPASXLLFFFEFLIVFXXSYPLISRGKFXXXN

SEQ ID NO: 182273 - protein, 46 aa, Triticum aestivum
  Clone ID: PAT_TA_76691.pep
LVNLQGVNLVKMKNQSSLCLVCINMLSEHFHILLSAQVSPPSLLIQ

SEQ ID NO: 182274 - protein, 79 aa, Triticum aestivum
  unsure (1)..(79): unsure at all Xaa locations
  Clone ID: PAT_TA_76692.pep
WAWEXPRXXDPACXCAREXECVFKRVGXXVXVCVXAWERPPXARARVCVWXARXRGRVSXSVCVRVRXCVXECVCXLXA

SEQ ID NO: 182275 - protein, 70 aa, Triticum aestivum
  unsure (1)..(70): unsure at all Xaa locations
  Clone ID: PAT_TA_76693.pep
TPQHTKKPKNSGHSSHRIERDEPLQLDDQLQVAVERVKFPPCLLTTATSMPFFRFXYICSLSLSLXXXEI

SEQ ID NO: 182276 - protein, 175 aa, Triticum aestivum
  unsure (1)..(175): unsure at all Xaa locations
  Clone ID: PAT_TA_76694.pep
TEHYDVMQNVRRRLRELCSEYQATGPVAQLYNKRGSSRDLPRXLINSISSRWDPANDPSAPTNTRTPSEHERLKLAVRQRCGTEVVGFDGRTVRSYSLSPEQEEATTKHXSDXQSSTHEGKPDQEDAHSKDVTLPGLNLIFDGVELHPFDIGACLQARQPLWLIXEASTXSSTLI

SEQ ID NO: 182277 - protein, 48 aa, Triticum aestivum
  unsure (1)..(48): unsure at all Xaa locations
  Clone ID: PAT_TA_76695.pep
XRNTRTKILXKXKKGNSYCGIXXVSXXPDLILPPSSPLHQASLVPLNL

SEQ ID NO: 182278 - protein, 133 aa, Triticum aestivum
  Clone ID: PAT_TA_76696.pep
WVPVVMPAAPSAVQLRRRLPLWRMRLMCRAASSGNCDGASGCALGEENVATFLILKLFPRELQDENHDQIKCTDDNINSSMQIDDLASSLAQQILGRCYPLFRKRQSLGPQINRFNSTQRPWVGGFTRKGRPA

SEQ ID NO: 182279 - protein, 55 aa, Triticum aestivum
  unsure (1)..(55): unsure at all Xaa locations
  Clone ID: PAT_TA_76697.pep
RSRPQXRADIPLRLPRAMSSVSAAESNPLTDRNATKAGESVSSNKENGSVATTRV

SEQ ID NO: 182280 - protein, 33 aa, Triticum aestivum
  unsure (1)..(33): unsure at all Xaa locations
  Clone ID: PAT_TA_76698.pep
LCFRFSCKXXRYHVXXLLGYXXVQSCATSKCYV

SEQ ID NO: 182281 - protein, 76 aa, Triticum aestivum
  unsure (1)..(76): unsure at all Xaa locations
  Clone ID: PAT_TA_76699.pep
CPWPKRDGPPLSKPKTTDHRYPPEGLRMAQPCAVRFRLPPGPPLRLPIARALXYSQRAPELRVLPSTLRSLKPPPG

SEQ ID NO: 182282 - protein, 60 aa, Triticum aestivum
  unsure (1)..(60): unsure at all Xaa locations
  Clone ID: PAT_TA_76700.pep
GKGFSAVPTSSRLNVXGIQYRVLGSTPLSAGSGVKLRGTPHYXDPXAKVVLNQVLDTLSS

SEQ ID NO: 182283 - protein, 76 aa, Triticum aestivum
  unsure (1)..(76): unsure at all Xaa locations
  Clone ID: PAT_TA_76701.pep
RYYWCQXRCRSSWPELTXSMRTRAVEGSIIFVVPAWHCHASXTAEIFTIXSLWHPRFSEVAEYXRYXXRGINMMPN

SEQ ID NO: 182284 - protein, 58 aa, Triticum aestivum
  unsure (1)..(58): unsure at all Xaa locations
  Clone ID: PAT_TA_76702.pep
TSFFXFXPPPPRITFPIDNVSFXLGXLXPNXYIKQGQYTYXWSISRXXXXDSVSSNQP

SEQ ID NO: 182285 - protein, 52 aa, Triticum aestivum
  Clone ID: PAT_TA_76703.pep
RILPELDTSDYLHVFRVKVKLALYPSRHFILWEQARINIFSRNIISSFPLSS

SEQ ID NO: 182286 - protein, 71 aa, Triticum aestivum
  Clone ID: PAT_TA_76704.pep
KEQSTPSPWEEHQTIILGIAPSRKGGLSSYVLVGSIPFVLPPTASHAARVWERKKNSKNKERLLRQRRDDF

SEQ ID NO: 182287 - protein, 53 aa, Triticum aestivum
  unsure (1)..(53): unsure at all Xaa locations
  Clone ID: PAT_TA_76705.pep
QCDFACLIDDCLSLIRKKTKKTLSILFEENRVAHSLDNQYYYLYLHVXLXACL

SEQ ID NO: 182288 - protein, 60 aa, Triticum aestivum
  unsure (1)..(60): unsure at all Xaa locations
  Clone ID: PAT_TA_76706.pep
XPSLACGCSALRCGLSXXSLVLPAXPRCSGRXXSXSXPXASGLLXVLXLXFLAPCGFVPL

SEQ ID NO: 182289 - protein, 122 aa, Triticum aestivum
  unsure (1)..(122): unsure at all Xaa locations
  Clone ID: PAT_TA_76707.pep
MLPHACGNSSRPXRYXXALHKALXFFNPQRXGHLPKHNGXSWXGNXGXXDXXXDXTLXXXXXXGFYXXXDPTKFNYPXAWSMTILTXTVITTPPTTLITFPPPSSTITSQPLSIPSLFYTLT

SEQ ID NO: 182290 - protein, 199 aa, Triticum aestivum
  unsure (1)..(199): unsure at all Xaa locations
  Clone ID: PAT_TA_76708.pep
MMRAQLALGLVLLVVARRAVGGDGDVDYGGGKKEGEYTGIEKKXEGVSASAEKKXEXIYADVEKKXDDVSGFDVSSSAKXKTXVASKNVETEKKXVXXXXYAGKEKKXEVXTKAAEEKKAEAASEKKXKRKSEPSXPSTIEKKXKSKNEKKXKGKXXLSGXTGAEKKXEEKVDKPNKEKRTELKKXEPHVMVMIKRLHK

SEQ ID NO: 182291 - protein, 56 aa, Triticum aestivum
  unsure (1)..(56): unsure at all Xaa locations
  Clone ID: PAT_TA_76709.pep
RPRXSSXRRPCSDLLXHTLVNTSXLGRSEWXVVXGLARVDXANDHDVDVSLLLXXG

SEQ ID NO: 182292 - protein, 77 aa, Triticum aestivum
  unsure (1)..(77): unsure at all Xaa locations
  Clone ID: PAT_TA_76710.pep
LKRQLSFQYKDVFLARLRQSEPRTIAQVKTIARRVLADGITTYQLSPVTTVSSDVFXSLSIXHXPHCFXIQXXLLQC

SEQ ID NO: 182293 - protein, 117 aa, Triticum aestivum
  unsure (1)..(117): unsure at all Xaa locations
  Clone ID: PAT_TA_76711.pep
KARPAARQLQRSXRKLLQANSDNXGGDPPPAAANPSCRVSKCSDKERRDRRMVNNKAEAIAPDATGIWRIICTMVEQDICGMQWQTMDNGNIAAEMASDLDQLIWEQTAELVQLTLV

SEQ ID NO: 182294 - protein, 92 aa, Triticum aestivum
  unsure (1)..(92): unsure at all Xaa locations
  Clone ID: PAT_TA_76712.pep
NNPGEACLISSTXKFXHATTYSGPXPASXSPDPPPNFXXXXXLLLVVTSHDHCCTIYLXYIVTTFHXXXSFSTXLSIVRSSXIKQSMLLIFC

SEQ ID NO: 182295 - protein, 83 aa, Triticum aestivum
  unsure (1)..(83): unsure at all Xaa locations
  Clone ID: PAT_TA_76713.pep
TIRYLXTAYXLXXCPXCXHIYSYRTXRDRVRXXATXFHQIRXSRXHVPSXXSXRRXXLALLEMVEPLVVPHDELPPHDPRHDL

SEQ ID NO: 182296 - protein, 59 aa, Triticum aestivum
  unsure (1)..(59): unsure at all Xaa locations
  Clone ID: PAT_TA_76714.pep
QHGRXNSYIQLGLTTTLQTXSGAXXXXXNEAGTLLVGELLRXXDLELHPXXPRAPLCSA

SEQ ID NO: 182297 - protein, 36 aa, Triticum aestivum
  unsure (1)..(36): unsure at all Xaa locations
  Clone ID: PAT_TA_76715.pep
XYXYLLLFXFXKYICLSIHXLNRPQYTNVCRHILKC

SEQ ID NO: 182298 - protein, 65 aa, Triticum aestivum
  unsure (1)..(65): unsure at all Xaa locations
  Clone ID: PAT_TA_76716.pep
LRXSVATLSTSLXQSQSRPAFWFXSXICARHCRGRWLESIKXCAERTAQIFLKRKCGKXLLVVQL

SEQ ID NO: 182299 - protein, 68 aa, Triticum aestivum
  unsure (1)..(68): unsure at all Xaa locations
  Clone ID: PAT_TA_76717.pep
NMKXLWAITATEELDDGSTFDCDPACIDWDXYLXNTHIPAALMYASNNNQMKKAGSAKGSRYINKLYF

SEQ ID NO: 182300 - protein, 189 aa, Triticum aestivum
  unsure (1)..(189): unsure at all Xaa locations
  Clone ID: PAT_TA_76718.pep
IEHCCWRQWWPPAXSLCARYMKDIHGPILGYRPVKFIVIAVFVGLAFASIAMSTRLQPGLEQKIVLPRDSYLQGYFDDLEKYMKVXPPLYFVVKNFNYSSASENTNQICSINQCNSNSLLNEIARQSLXPETSYIAKPAASWLDDSLIWXSPEAFGCCRKFVNGNYXXPDXQPPCCQLDQDSSCSSNGS

SEQ ID NO: 182301 - protein, 70 aa, Triticum aestivum
  unsure (1)..(70): unsure at all Xaa locations
  Clone ID: PAT_TA_76719.pep
TDKDGETKTPTNLLHENVTAYLANANIEDRAEDGLGKVPQHNCSTGXLDNKDENISSSVDGFTRTWGKHG

SEQ ID NO: 182302 - protein, 156 aa, Triticum aestivum
  unsure (1)..(156): unsure at all Xaa locations
  Clone ID: PAT_TA_76720.pep
LNDISHGSLAKTGMIDYKDWQIALTRRFRAIKLWVXXRRYGAVGLRANIRRHVEMAKWFELALKADDRFEVIVPRRFSLVCFRFRPRYEGDTQXDALNRKLLNVVNASGKAFMXHTIVDNKFVIRLAIGATMXEMRHIRDTFELVQEKATEIGQDA

SEQ ID NO: 182303 - protein, 141 aa, Triticum aestivum
  Clone ID: PAT_TA_76721.pep
MRLQKLRLETRHLWGMESCLNKVHDFLESRLAHDNLLGIWGVSGVGKSSLLMQLRQSYRIFAVFHHVLYFGFGSRSTVTDVQLALGVCLGYNYEMMSLMDEKSRARVIHHTLSNTSFLLLLDELEAPVDLAAVGCGCHLGS

SEQ ID NO: 182304 - protein, 128 aa, Triticum aestivum
  unsure (1)..(128): unsure at all Xaa locations
  Clone ID: PAT_TA_76722.pep
VPKRYPQHWYXYXAKTRSGSEXIKSQFEEQERATTEIQKVNSELSHQVTXLQDQLQAERESTQERINFERAKRENLEERXKEEXAETERXLEEERRSILEXEKNXXAKXAQLSQQTQTHQMNKKRTNK

SEQ ID NO: 182305 - protein, 47 aa, Triticum aestivum
  unsure (1)..(47): unsure at all Xaa locations
  Clone ID: PAT_TA_76723.pep
SIVSCFFFLISDFXNIPIAXXXRMFLSSNSIFISISISTYLYYLXEQ

SEQ ID NO: 182306 - protein, 112 aa, Triticum aestivum
  unsure (1)..(112): unsure at all Xaa locations
  Clone ID: PAT_TA_76724.pep
VIFKIDDITEEVVVEKTGAPGESYDDFTASLPVDDCXYALYDLDFVSDDNCRKSKIFFISWSPDDSRXRAKTIYAVSRNQFRHELDGVHFEIQATDPDDMDLEVLRXRANRT

SEQ ID NO: 182307 - protein, 58 aa, Triticum aestivum
  unsure (1)..(58): unsure at all Xaa locations
  Clone ID: PAT_TA_76725.pep
NSXEVVXSXXKSIKSDYTHNRVDXPIXRPSANICPXKPPPNNATRQGYXWRIDLKTXV

SEQ ID NO: 182308 - protein, 68 aa, Triticum aestivum
  Clone ID: PAT_TA_76726.pep
QRVDNLTKWMTDHKDTFSGSNQSSAVSKRWAISKIEAEFLGSSQRRHHKFWRETRYMDHIGASRDDEQ

SEQ ID NO: 182309 - protein, 61 aa, Triticum aestivum
  unsure (1)..(61): unsure at all Xaa locations
  Clone ID: PAT_TA_76727.pep
PEQGTQDLVLSTPALPEHPQTXSCMHSVLLTFSHLLPYRMPKPSPTKTSCRSHTPRPQSRK

SEQ ID NO: 182310 - protein, 95 aa, Triticum aestivum
  unsure (1)..(95): unsure at all Xaa locations
  Clone ID: PAT_TA_76728.pep
IKEQEKLGFDRALEHRNRMSRTGEEXIRNPMEPTRXIXVLQXHIPLSRLPDKHGHQSXKTVCMSRAGXXTETXQNLLSLFPLCIIPVLQXPCTSA

SEQ ID NO: 182311 - protein, 41 aa, Triticum aestivum
  unsure (1)..(41): unsure at all Xaa locations
  Clone ID: PAT_TA_76729.pep
FGRFKTITWNNIQETQLSIQLNNRTXREEXXHIQRSASLNI

SEQ ID NO: 182312 - protein, 122 aa, Triticum aestivum
  unsure (1)..(122): unsure at all Xaa locations
  Clone ID: PAT_TA_76730.pep
LEQQFEEAILKVSXXHEKLERVQXDAACQVNEMXSNAKDLEKIIDILSFQKAKVEGDLKVMVXICMENLSSMNEFEDRVTEKVSDHATKLXDLQQSLDDIGSNFQRLHHAYDGVSTEASQLE

SEQ ID NO: 182313 - protein, 106 aa, Triticum aestivum
  unsure (1)..(106): unsure at all Xaa locations
  Clone ID: PAT_TA_76731.pep
RGTFHLSAXFLRVYSPAAXSKIRSIAXEKVIFGXXHVXGIMSAESIGNYGXXXXXDXLHKTGIFTWDXLHHLGSNKFSLSXNYIRTLGXHGLSRESSEKEMSICVC

SEQ ID NO: 182314 - protein, 57 aa, Triticum aestivum
  unsure (1)..(57): unsure at all Xaa locations
  Clone ID: PAT_TA_76732.pep
XXAATVILINXIQESGQWSAXRMXLYXXXRGASHLFXLXXFXLTXXSAVCDNSRQGD

SEQ ID NO: 182315 - protein, 76 aa, Triticum aestivum
  Clone ID: PAT_TA_76733.pep
KRTHSNIAHKTVEHCCCQFSMGSLTPGAHKTNERRTRNAPTDGALIALLICATKKTSPAHNLRTAKSFQRTAPMSK

SEQ ID NO: 182316 - protein, 75 aa, Triticum aestivum
  unsure (1)..(75): unsure at all Xaa locations
  Clone ID: PAT_TA_76734.pep
ENCYVVKLPKFLQNILQVLFAEQSQLLATMCASLAXHGVQPQVAQDCSCGVLKFTDVDVSFQDCGIVYQFGPRVM

SEQ ID NO: 182317 - protein, 71 aa, Triticum aestivum
  unsure (1)..(71): unsure at all Xaa locations
  Clone ID: PAT_TA_76735.pep
TILFSRXDQEFRITTGPFFFLHRQFFFNSLQLLRXTDSEQSGSDSLKLEPDCNEFVVFFWNYFFYTGSDSL

SEQ ID NO: 182318 - protein, 35 aa, Triticum aestivum
  Clone ID: PAT_TA_76736.pep
RALGSAINYVALQSYSSRSTHSACELSCLIITSLY

SEQ ID NO: 182319 - protein, 104 aa, Triticum aestivum
  unsure (1)..(104): unsure at all Xaa locations
  Clone ID: PAT_TA_76737.pep
PFRLQNAGPASNIAHSSGNIDMRELVHIISDQGRQNMVTALDVXMPAPSLKDGNDLWNMKSLRTLTPEISDEEEDPYSVESLVVHGVLRAGGHRASISQVKDSV

SEQ ID NO: 182320 - protein, 45 aa, Triticum aestivum
  unsure (1)..(45): unsure at all Xaa locations
  Clone ID: PAT_TA_76738.pep
AADDFGIDVLIQVILSXASLLIEYTQDRAPSYVYKLIGSKHFHYL

SEQ ID NO: 182321 - protein, 102 aa, Triticum aestivum
  unsure (1)..(102): unsure at all Xaa locations
  Clone ID: PAT_TA_76739.pep
WLPMSHLPQPNSKDRKQQXSXXXXMPTXLLCSVPXGLSSGRRSILVPGDAXNIPQXTDXGSXXXXPSVQAQFLKLPCMCIHSRPKVRXALAALPXFGGLHPC

SEQ ID NO: 182322 - protein, 62 aa, Triticum aestivum
  unsure (1)..(62): unsure at all Xaa locations
  Clone ID: PAT_TA_76740.pep
LHETHKLFKRHVLQLXNVVLKLFLNHXYLDLXHNEFVQLIHLVYVLXXXHXFQLLLPLXLIQ

SEQ ID NO: 182323 - protein, 111 aa, Triticum aestivum
  unsure (1)..(111): unsure at all Xaa locations
  Clone ID: PAT_TA_76741.pep
SGGQDALNGSVDKHGGCPGNKTVYAFSSHCAVDCDMACKDPACSDRCYIDCPYTAARFGYIMATPANKKAIGEDMDCFKRCAKEKDATNDKCLXSCKLISPALVSAPPHGA

SEQ ID NO: 182324 - protein, 94 aa, Triticum aestivum
  unsure (1)..(94): unsure at all Xaa locations
  Clone ID: PAT_TA_76742.pep
LPCSPYTXFPLXSPIXNSPTXPPLXSTSSFISDLADALVEPLPSPSPXTTKXXNHTXSHIHXIHYXTXXFFXSVLPFFLLLSPTLLSAFQNTLH

SEQ ID NO: 182325 - protein, 69 aa, Triticum aestivum
  unsure (1)..(69): unsure at all Xaa locations
  Clone ID: PAT_TA_76743.pep
PMKMKGAVHQRHLKLPNVXRRLPFSKKPPRLNLSDNIASNXXREXXXCXAVVGXIYRMNSGFXEKKYTR

SEQ ID NO: 182326 - protein, 123 aa, Triticum aestivum
  unsure (1)..(123): unsure at all Xaa locations
  Clone ID: PAT_TA_76744.pep
PWFRMVNSPFSSXHXXPYXIXIMHHXSIXQDWXPGXIGGTPXXIDXSLAALSXVVEXNLPLXRSNRNEXPQXXXSSKLWLPXGNGIXDRXTXSXGRAXLRYXXRXGNRDXHLMXLQGTSGDGG

SEQ ID NO: 182327 - protein, 54 aa, Triticum aestivum
  Clone ID: PAT_TA_76745.pep
FIADAEKEKEEWINSIGRSIVQHSRSVTDAEVVDYDSRPQPPQPKKSEASEPSE

SEQ ID NO: 182328 - protein, 95 aa, Triticum aestivum
  unsure (1)..(95): unsure at all Xaa locations
  Clone ID: PAT_TA_76746.pep
CCNKKKWQMFFQEVISTRPNACQCSVEWASLDGAMASLRTRECQGHVTSXHRDPVETAGPVAQRIRARGYEPPTVLGVRIPPLVGHHRAPKYVMM

SEQ ID NO: 182329 - protein, 102 aa, Triticum aestivum
  Clone ID: PAT_TA_76747.pep
SGIGASGFGWGEPDEFEDFVDPPATLENIHSRALSRHPSLPLLLVGSSNTHVYLWEFGKDSARATYGVLPAANIPPPYALASISAVQFDYYGQRFAAAALDG

SEQ ID NO: 182330 - protein, 57 aa, Triticum aestivum
  Clone ID: PAT_TA_76748.pep
PSGVDRFKQQFAHLEKGGAKGEKSSPQLRQNASLPRERAIGNKHGDMLPSKVNTEKP

SEQ ID NO: 182331 - protein, 113 aa, Triticum aestivum
  unsure (1)..(113): unsure at all Xaa locations
  Clone ID: PAT_TA_76749.pep
QEGPDAGEDGPQGXAEEGEHGEAAXXDXLEXELXHLXLAXXAEPERXEDKETGXYXRKSSXGGQRRGNXQNQKQSXTHNVWRXSCXLALCPQHAXGVLCPTWSGSHSVADQQV

SEQ ID NO: 182332 - protein, 94 aa, Triticum aestivum
  unsure (1)..(94): unsure at all Xaa locations
  Clone ID: PAT_TA_76750.pep
KTRWNSTYIMLSXALEXYIDIFEKLKAHEKLFSXCPTKDDWKIAKELCDRLKVFYDVTEAXSGXKYVTXNLFCPKICGIQLAIKKWSTGENKRC

SEQ ID NO: 182333 - protein, 74 aa, Triticum aestivum
  unsure (1)..(74): unsure at all Xaa locations
  Clone ID: PAT_TA_76751.pep
LFNSSYXTKXXSNTKNSTQDCXNMSQYNISLVRXDGXXDSEDXLDCRISSXCSDXTNHXLESDNLXSLSSNCLE

SEQ ID NO: 182334 - protein, 115 aa, Triticum aestivum
  unsure (1)..(115): unsure at all Xaa locations
  Clone ID: PAT_TA_76752.pep
LPGGDMMTLLMRKDTLTEDEARFYVGETGLXXXAIXRHNYIXRDXKPDNLLLDRYGHXRLXXFGLCKPLDYAAFPDLNEKDVTANRTSSAHGDGRQQTTPKRTQQEQLEHWQKNR

SEQ ID NO: 182335 - protein, 63 aa, Triticum aestivum
  unsure (1)..(63): unsure at all Xaa locations
  Clone ID: PAT_TA_76753.pep
TSRGATTSRDSPATHQQDDHRRLDRQXXALCALVTLALVHDCFSRNTSXVRLLHXEXKWNMQS

SEQ ID NO: 182336 - protein, 52 aa, Triticum aestivum
  Clone ID: PAT_TA_76754.pep
PGHTSVTDGLNKPLLNTRNFLKSESIGASKCIAVKEKREKDEESMSDYMHEA

SEQ ID NO: 182337 - protein, 66 aa, Triticum aestivum
  Clone ID: PAT_TA_76755.pep
RFIVRRYEIQSFLFSISGSIWERLLGHTYSSVIKFLNKFSPGAHILHHCLFTIEIYSLRFIQYVYI

SEQ ID NO: 182338 - protein, 76 aa, Triticum aestivum
  unsure (1)..(76): unsure at all Xaa locations
  Clone ID: PAT_TA_76756.pep
WIKNNDSDFYLDFNTKVTKKSKDTGDAGKGTAKDFLERIADLEEDAQRSXXHRFNIAADLVDQARDAGLLGIVGVE

SEQ ID NO: 182339 - protein, 63 aa, Triticum aestivum
  unsure (1)..(63): unsure at all Xaa locations
  Clone ID: PAT_TA_76757.pep
LHSGXACRQHRSTIXXXPMLHSDHSFLIATXXXXCPTXXLNIKLGLDEXSYTSFDLLPYPDRA

SEQ ID NO: 182340 - protein, 40 aa, Triticum aestivum
  Clone ID: PAT_TA_76758.pep
SCRRQAPMTTSSGLQAAEANEFQPGAAAASLSCHVSTHGR

SEQ ID NO: 182341 - protein, 61 aa, Triticum aestivum
  unsure (1)..(61): unsure at all Xaa locations
  Clone ID: PAT_TA_76759.pep
TLRNFLFIYLXFSRXXRAAXLMXLSVDSQCPXPLAXSGPLFFPPNMSISKFSRPWFSPCDL

SEQ ID NO: 182342 - protein, 55 aa, Triticum aestivum
  unsure (1)..(55): unsure at all Xaa locations
  Clone ID: PAT_TA_76760.pep
SSVFISIFSLRRKVCXFTAFXLAPATSHEWAGXWACLAPRGGDRGPXREFETVQA

SEQ ID NO: 182343 - protein, 62 aa, Triticum aestivum
  unsure (1)..(62): unsure at all Xaa locations
  Clone ID: PAT_TA_76761.pep
TPKNKXQREXTXKXTNXXXNXEXDGXXRETTRXTQVRGRQEGXPEGGRDDKGXTXQXGRXPG

SEQ ID NO: 182344 - protein, 117 aa, Triticum aestivum
  Clone ID: PAT_TA_76762.pep
KIIADALRKEGLDDAHPQDYLNFYCLGKREVTAEVPAPTSHSNENSPLRLAQKFRRFMIYVHSKGMIIDDEFVLIGSANINQRSLDGLRDTEIAMGAYQPHHSWAGSQGPPRGQVYG

SEQ ID NO: 182345 - protein, 93 aa, Triticum aestivum
  unsure (1)..(93): unsure at all Xaa locations
  Clone ID: PAT_TA_76763.pep
IHLILLKLLVYQLFICISFCQXSXQTEEPNIACFDRRNLPTEVVAPVVGGNEATTLHEAVKSVVVSRCIHQRRNRVNFRTPLVIVGCVKGKNY

SEQ ID NO: 182346 - protein, 131 aa, Triticum aestivum
  unsure (1)..(131): unsure at all Xaa locations
  Clone ID: PAT_TA_76764.pep
QGQGYPCXEALXQXNEXKRPSDKPRASSRXQDGYXIGGXGGVXGGXVETGXIKXGMVVXFXXTXLXTEVQVCVRCTHGVRCAGRRFACTMVALSSVEETLGQGMLRAWGCCIQTAKGLTRVKGGNFRLVIQ

SEQ ID NO: 182347 - protein, 70 aa, Triticum aestivum
  unsure (1)..(70): unsure at all Xaa locations
  Clone ID: PAT_TA_76765.pep
YNSLYNKLTPTSHTTPPXXPXXIQFQXPTHTXQILNPYNTNILTHYQYPXSIXXPFPSSPXHKYXHQIFF

SEQ ID NO: 182348 - protein, 147 aa, Triticum aestivum
  unsure (1)..(147): unsure at all Xaa locations
  Clone ID: PAT_TA_76766.pep
PLYPGGSCPHIDEPFDCHLNGRPDRAYEKLRWQPSGCNIPRLNPTDMLERLRGKRLVFVGDSLNRNMWESLVCILRHSVKDKRKVFEASGRREFKTEGSYSFLFTDYNCSVEXFRSPFLVQEWETRVSNGNKKETLRLDIVEQSSPK

SEQ ID NO: 182349 - protein, 67 aa, Triticum aestivum
  unsure (1)..(67): unsure at all Xaa locations
  Clone ID: PAT_TA_76767.pep
HLGXXLRHLXXXXCNYWDSQTSAIPGVRXELSSVLRXTAQFXKGXDXESXKSXSXRXTFPKTYFECQ

SEQ ID NO: 182350 - protein, 141 aa, Triticum aestivum
  unsure (1)..(141): unsure at all Xaa locations
  Clone ID: PAT_TA_76768.pep
KLNNYSLVYPQPAIIFNHHNTMTSTXVXXLIXISPPLPTXXHXXSNSSHXXTXNSSRSFLXFNPTXSSNXQFSLSGTISSXXPIXSFIFIITTFTLNSLPNXHPNNHPFPPTFPQLXTXHPLKYTPFTPITXPILXSTPPF

SEQ ID NO: 182351 - protein, 72 aa, Triticum aestivum
  unsure (1)..(72): unsure at all Xaa locations
  Clone ID: PAT_TA_76769.pep
EXSLQYISSASWVFVSDINILSSHNIMIFKILSSQNQQTKLLTFTPVCPHXFASSHPHSLLPWVAADLQRLR

SEQ ID NO: 182352 - protein, 54 aa, Triticum aestivum
  unsure (1)..(54): unsure at all Xaa locations
  Clone ID: PAT_TA_76770.pep
ARSICACXTWGVFRXARRTDKTGQXXAHKHXPFIIRGHVSXXXLKRALIWGFIT

SEQ ID NO: 182353 - protein, 103 aa, Triticum aestivum
  unsure (1)..(103): unsure at all Xaa locations
  Clone ID: PAT_TA_76771.pep
EDLSAGNQDAKVASEGNKVYINYVGKLQDGKTVHSNGEEKPYKFKLGSEKVMRGWNLGITGMCVGEKRRLTIPPSLCDNGGKLVVELPKDSXIIYEVELVKVR

SEQ ID NO: 182354 - protein, 131 aa, Triticum aestivum
  unsure (1)..(131): unsure at all Xaa locations
  Clone ID: PAT_TA_76772.pep
LLVISVVAGEVXFGRXXKAINXKXVLFFXXRKENVXFXFXVFFXRFFVCCGXKKERVEKVCDIVKREXGVGDENVVFGLFKFGDXGGDXLDKVEIVMGVEEGFGXSVEELSXQXIXKVEEGGKXIERVVXK

SEQ ID NO: 182355 - protein, 117 aa, Triticum aestivum
  unsure (1)..(117): unsure at all Xaa locations
  Clone ID: PAT_TA_76773.pep
VKFLRINPRVRPDESTNXRVVKILXEVVVKKEXXVAVVNSRVXXMFEMWFXNIKRVGIXNYLVVELDDXIENFCKXKEVXVYGGDPDEGIDXIGKXGGNHAVCXLKFGILREFLXXG

SEQ ID NO: 182356 - protein, 86 aa, Triticum aestivum
  unsure (1)..(86): unsure at all Xaa locations
  Clone ID: PAT_TA_76774.pep
ASQGTXLNITQGSXRGXXKFXRSXRXEKQQQFRXXLGASKEXRAAXXXWEXGQXAVVGVQGRKKXQRAGIVRRGSSSSFGEXEEQQ

SEQ ID NO: 182357 - protein, 90 aa, Triticum aestivum
  unsure (1)..(90): unsure at all Xaa locations
  Clone ID: PAT_TA_76775.pep
KAAXAAXLSSNIFVXPLHSIPCFCRCGVHIFLFHFCLCLHQLVXXHGRCPSSSSSSSSSSSSSSXXXXSXXXXLDXCXVRXKVGRPSXRE

SEQ ID NO: 182358 - protein, 64 aa, Triticum aestivum
  unsure (1)..(64): unsure at all Xaa locations
  Clone ID: PAT_TA_76776.pep
XSXXCKLLPVPATFSDVFIGRWSTGTXKTQFTXQSGXVXGTGXXXGXIHLFFSINVASSFSTSE

SEQ ID NO: 182359 - protein, 47 aa, Triticum aestivum
  unsure (1)..(47): unsure at all Xaa locations
  Clone ID: PAT_TA_76777.pep
LXXVLKGGDWEKXGVTKFNXFEENXLXXXWGNXEXGGKDXXLKKLGS

SEQ ID NO: 182360 - protein, 54 aa, Triticum aestivum
  unsure (1)..(54): unsure at all Xaa locations
  Clone ID: PAT_TA_76778.pep
TTQLSHKMEEEDMAMXXXXPQLYHDFLFKTSINFCKXLTYLXNQSQLLQXXSSX

SEQ ID NO: 182361 - protein, 54 aa, Triticum aestivum
  Clone ID: PAT_TA_76779.pep
FFTHVGFGLLTICGFQSFHLLVYLSFLIYPPYYSQSCFLLRDTTFSIHFYFNFS

SEQ ID NO: 182362 - protein, 79 aa, Triticum aestivum
  unsure (1)..(79): unsure at all Xaa locations
  Clone ID: PAT_TA_76780.pep
VFXCIAHRVPTFTPLXXSXSYLCMVPGHLXMVVPPGQXLFLGEVXXPFLXTFTLLPPAXLALKPXDFRNPNXLGLRGXA

SEQ ID NO: 182363 - protein, 102 aa, Triticum aestivum
  Clone ID: PAT_TA_76781.pep
AIAKAEELQDELGSDYPTFVKPMPQSLTSLFSMEHLPDHRMRMVLVDEEEEEFKVLYRPHSSSLITGWSEFAVDNELVEGDCLVFQLIKRALFKVYIFRASS

SEQ ID NO: 182364 - protein, 43 aa, Triticum aestivum
  Clone ID: PAT_TA_76782.pep
RWRNYHFRAEGLFFFMIVPWIHFYPPLAHSSLCKAWLVFATLC

SEQ ID NO: 182365 - protein, 68 aa, Triticum aestivum
  Clone ID: PAT_TA_76783.pep
SKGKKLFNLGLQFLQQLEEEHSLENSKSLEVSAIRTKYLDNCAQHYFERGHIKHMMPFVKAFSSMDHV

SEQ ID NO: 182366 - protein, 73 aa, Triticum aestivum
  unsure (1)..(73): unsure at all Xaa locations
  Clone ID: PAT_TA_76784.pep
AIARPSXPLRVATEGRRXAGXPXXPXVXIXXVIILTGHMFCSSXNASSFFXFCXXHFCCYRXXXCKLVANQWN

SEQ ID NO: 182367 - protein, 171 aa, Triticum aestivum
  unsure (1)..(171): unsure at all Xaa locations
  Clone ID: PAT_TA_76785.pep
RRAKTAGAPGRPTXGAAGMGXAXKAXXGXXSNXRTRGSXAPTGEGXSEXXSGSXXXPXEXXXGXAGXAGAXGAGTRRGPXXAXGGGKLGGQLGGPKRTGTPPXAAEIXRGNXGEPXXNGEKNTXAXSXRAGQPAGHNRXEQQDNXPAAGXPPAGKDRTHGGERQAASQGQK

SEQ ID NO: 182368 - protein, 62 aa, Triticum aestivum
  unsure (1)..(62): unsure at all Xaa locations
  Clone ID: PAT_TA_76786.pep
NLQISHYGNLXWXFNCSNSLLHMMIVRVCLPIRRSFPSIIFHYIAGIQKXITRSLSPXSWXS

SEQ ID NO: 182369 - protein, 59 aa, Triticum aestivum
  unsure (1)..(59): unsure at all Xaa locations
  Clone ID: PAT_TA_76787.pep
ANYPMLHMSMCYYQXATTKHCHSILLVLMQISIDVIRSGPSVFXXFSSPVWXAEHFPAT

SEQ ID NO: 182370 - protein, 43 aa, Triticum aestivum
  unsure (1)..(43): unsure at all Xaa locations
  Clone ID: PAT_TA_76788.pep
VRLETMXSEXASLVYXLAPIGFTDLLLLAFXQTGLSSXHTSPP

SEQ ID NO: 182371 - protein, 48 aa, Triticum aestivum
  Clone ID: PAT_TA_76789.pep
LTHQIHDIKYNINTTMFSIQYNKVHSQYNRHRDETRGIVARVTHIIRA

SEQ ID NO: 182372 - protein, 58 aa, Triticum aestivum
  unsure (1)..(58): unsure at all Xaa locations
  Clone ID: PAT_TA_76790.pep
WAXXPPHXSAPRGQNEWIXDRTSXQFXKTKPXYXQXLXTPTVDXILPSTPAPXPPITT

SEQ ID NO: 182373 - protein, 73 aa, Triticum aestivum
  unsure (1)..(73): unsure at all Xaa locations
  Clone ID: PAT_TA_76791.pep
PGLKPCYMAVALHRTIQQGPKETSICAYSKTNESANITNSLTYSNRRVARTXRVYXXRAXTSLHGLELYTHKR

SEQ ID NO: 182374 - protein, 95 aa, Triticum aestivum
  unsure (1)..(95): unsure at all Xaa locations
  Clone ID: PAT_TA_76792.pep
NYIXXIDXACHIDXFIAXXAHTHVXKGGPVTGRAANVLAAANTAAEXAMXLLRPRKKNNXLTEPIQKVAAAYXXKIXEGXXSHQVRQFXXDGEXV

SEQ ID NO: 182375 - protein, 72 aa, Triticum aestivum
  Clone ID: PAT_TA_76793.pep
PSVAFTYEHAFSSACREHGHTHILILGTNKKDKWKRKTQSNVRVDKTAMALYMWPVVSELFRPCRTPRSPVA

SEQ ID NO: 182376 - protein, 65 aa, Triticum aestivum
  unsure (1)..(65): unsure at all Xaa locations
  Clone ID: PAT_TA_76794.pep
KKSGEXXKXXXTTXPRXPXPPPPXPPGTTTTAQPAGGCIXPHPNLQLLLLPEASILIHGRVLALL

SEQ ID NO: 182377 - protein, 91 aa, Triticum aestivum
  unsure (1)..(91): unsure at all Xaa locations
  Clone ID: PAT_TA_76795.pep
LARSLALNCVVRLPTSXKPLSTTRHLPSVSRRYLSXXXXXXGXXRWXASPQSRLNIXTQSGGRPDCRTSGSGRGARRGRXSWRXSCCWLGR

SEQ ID NO: 182378 - protein, 40 aa, Triticum aestivum
  Clone ID: PAT_TA_76796.pep
LYNARRGSNNINVHVSSLLRHSTTTIIISTYSKTTECDSG

SEQ ID NO: 182379 - protein, 44 aa, Triticum aestivum
  Clone ID: PAT_TA_76797.pep
MRMETPCGGDLFLQLVEKMIELSKENVNAKKGSTLSRRCGSCIW

SEQ ID NO: 182380 - protein, 89 aa, Triticum aestivum
  unsure (1)..(89): unsure at all Xaa locations
  Clone ID: PAT_TA_76798.pep
HLXLPLEVGXVLVPVGVSGXCCPDLXYMSLLXRGTSRVNSCXTPATYIXRSXXRQGVKXELKVXVALPXXSXRKXYKPGXALPIXIHLF

SEQ ID NO: 182381 - protein, 61 aa, Triticum aestivum
  unsure (1)..(61): unsure at all Xaa locations
  Clone ID: PAT_TA_76799.pep
PCSVYPQQTHGPDNRPRKQNGFIQLHIVGLDNDGGKPKYGRTRSWLKHGFVILQIXLSSEV

SEQ ID NO: 182382 - protein, 64 aa, Triticum aestivum
  unsure (1)..(64): unsure at all Xaa locations
  Clone ID: PAT_TA_76800.pep
HVAPPDGGDVFVGXQASLXXAGREXYQDRRRLPTXPVGSXTKPQQGLKCXKQXCTTRPQDNXXL

SEQ ID NO: 182383 - protein, 72 aa, Triticum aestivum
  unsure (1)..(72): unsure at all Xaa locations
  Clone ID: PAT_TA_76801.pep
ARAGSLSSVSMXTFYNLPLLTSILLYXXXXXFYFXTSXXQVKXSNDGLXXXXXXYXHNQCHHQKHNKQHNCG

SEQ ID NO: 182384 - protein, 70 aa, Triticum aestivum
  unsure (1)..(70): unsure at all Xaa locations
  Clone ID: PAT_TA_76802.pep
STETVTFRVQVIXRRALVQGSPCGRSSSTSKPXLWFLVLXXXQPSSSFLSTHSCXRVFSIICLXTQAVFG

SEQ ID NO: 182385 - protein, 93 aa, Triticum aestivum
  unsure (1)..(93): unsure at all Xaa locations
  Clone ID: PAT_TA_76803.pep
WIXPLPTVRAWANGASGLVTVPVHLYAVQSXSKGLGRILXCHPSTPKVXNTGSTEGRHGGRPRQLVTWGPRLREECFVGNCLYNRRSRTCLAT

SEQ ID NO: 182386 - protein, 83 aa, Triticum aestivum
  unsure (1)..(83): unsure at all Xaa locations
  Clone ID: PAT_TA_76804.pep
FLPCVLQQLSLGCCPSXSYGWVPERVALRTCLNSCQSLSTSGATNSLXCSQTPFSEWSDYTWHTTADAVTAVGSTLQTLLVSC

SEQ ID NO: 182387 - protein, 72 aa, Triticum aestivum
  unsure (1)..(72): unsure at all Xaa locations
  Clone ID: PAT_TA_76805.pep
WXKLGGVDRXTKENIAERMGDIRRAXLEADVSVPVERSFXESVTXKXIGTDVXGGVQPXQQXXKVXXDALAX

SEQ ID NO: 182388 - protein, 64 aa, Triticum aestivum
  unsure (1)..(64): unsure at all Xaa locations
  Clone ID: PAT_TA_76806.pep
HTLTSLHXHHLXCXHLXXRCXQPHTRGRARAHALXHTRTHSHSHXHARARSLSHSHTLXLSHAR

SEQ ID NO: 182389 - protein, 72 aa, Triticum aestivum
  unsure (1)..(72): unsure at all Xaa locations
  Clone ID: PAT_TA_76807.pep
CLFCDASSFLXGPAQVSAKEPSSGSRVSPEFYXTXVIXLGKPCTDSLCNDECMKIFPGPGNCEKGKCLWGFC

SEQ ID NO: 182390 - protein, 56 aa, Triticum aestivum
  unsure (1)..(56): unsure at all Xaa locations
  Clone ID: PAT_TA_76808.pep
MGIISEALFAFRIYNHTLTTSCAEPKSSFLKTGAGAERXSPSPTVRRRPTRRRGEV

SEQ ID NO: 182391 - protein, 100 aa, Triticum aestivum
  unsure (1)..(100): unsure at all Xaa locations
  Clone ID: PAT_TA_76809.pep
WVNVSXLVVEELIXCEYXVLKEXFVDEYXXSKFVFEFDFXXXNXXSXPLXMSKXXGTGVXXFTCXLFSKLFXDKEXFXLLFNFLKPYNYKGXIMMLXDRI

SEQ ID NO: 182392 - protein, 66 aa, Triticum aestivum
  unsure (1)..(66): unsure at all Xaa locations
  Clone ID: PAT_TA_76810.pep
GGTNXKLVKEFGIDPNNAFAFWDWVGGRYSVCSAVGVLPXSLQYGFPIVXKFLEGXSSIDNXFHTS

SEQ ID NO: 182393 - protein, 80 aa, Triticum aestivum
  unsure (1)..(80): unsure at all Xaa locations
  Clone ID: PAT_TA_76811.pep
TASCMGSSGESTRLLLSLAEVQEKXCSGSGKIERSCSVIHLVNILAYLLLYYDFHLEKKKAKHVKLYGCSMFXIXXXVEN

SEQ ID NO: 182394 - protein, 73 aa, Triticum aestivum
  unsure (1)..(73): unsure at all Xaa locations
  Clone ID: PAT_TA_76812.pep
RQKEQFTLLGPLRAKVVSRPVDSXXGDGHISPGVALQRXMPYCCALFTISRCRALXAWHCSRKNNLXXXLNTV

SEQ ID NO: 182395 - protein, 72 aa, Triticum aestivum
  unsure (1)..(72): unsure at all Xaa locations
  Clone ID: PAT_TA_76813.pep
IAPMTXMAMMGNXASQTKLDLMSSXXRXDXXTRPXVSLXILSVRTPCRXRXXRVSSXARXIRAISXVYRGSK

SEQ ID NO: 182396 - protein, 104 aa, Triticum aestivum
  unsure (1)..(104): unsure at all Xaa locations
  Clone ID: PAT_TA_76814.pep
ARTGLLSSDKALSLKLWDMDNKXSCIGIFXXRGTVRQIMFNPKHTSTFATLXXXYWSRGHVIQMWKIDQASSVRRIYIXNVETIDFFTYTGDQHFIAXIXNKIV

SEQ ID NO: 182397 - protein, 84 aa, Triticum aestivum
  unsure (1)..(84): unsure at all Xaa locations
  Clone ID: PAT_TA_76815.pep
LFSATKTYMHDYMDIXKQXETIIIXGAAEHVCSCTMCICVMDGANTAASXHXXPXIXXTSGRXACCPVHXCXHDAXRDRTCAPR

SEQ ID NO: 182398 - protein, 72 aa, Triticum aestivum
  unsure (1)..(72): unsure at all Xaa locations
  Clone ID: PAT_TA_76816.pep
RGRPRYNRRFVTRRRRLRQEARPQLLREVGXPXPXSQEKGSSFALVFLSFVVTQDYDXGRDITEVLKYACFA

SEQ ID NO: 182399 - protein, 116 aa, Triticum aestivum
  unsure (1)..(116): unsure at all Xaa locations
  Clone ID: PAT_TA_76817.pep
XRTQRSVNMVXEAGRQGMLSPNRGYNLARPTNPEPRVAMXXXXEYQHREXKSGSPRASKIAPSRRKNDVETPSPXXPEXPDLGXHLXLRXGLXPRALTAXPSRKXXSANXAAASTG

SEQ ID NO: 182400 - protein, 48 aa, Triticum aestivum
  unsure (1)..(48): unsure at all Xaa locations
  Clone ID: PAT_TA_76818.pep
FITTTTXGNRPHNPHYXCHXVLLXVHDXDLAXRXXEXSXGGGGKXRWX

SEQ ID NO: 182401 - protein, 61 aa, Triticum aestivum
  Clone ID: PAT_TA_76819.pep
PRCCNQERKQWSAITSDTPLETVGHHASHGDCKLLILGSVGFDEVAAPLKDRLVMLRRLPC

SEQ ID NO: 182402 - protein, 75 aa, Triticum aestivum
  unsure (1)..(75): unsure at all Xaa locations
  Clone ID: PAT_TA_76820.pep
CFMICSADFQNNECIXWXAMLXIRQMSWNLTDXDLRLRVTXXKLSSIEICXLNSEXKHTPDTFALVKGMSXESCE

SEQ ID NO: 182403 - protein, 68 aa, Triticum aestivum
  unsure (1)..(68): unsure at all Xaa locations
  Clone ID: PAT_TA_76821.pep
CSGLLSRSLSGLDRWMAMASGXGXAXNKSTSACSGCCXGGAADSDRPPRRGSRGKLTKHGPDLIYRPA

SEQ ID NO: 182404 - protein, 54 aa, Triticum aestivum
  unsure (1)..(54): unsure at all Xaa locations
  Clone ID: PAT_TA_76822.pep
XINTPLLPXTDVYXPHTXNANRXRRXFRXPLGGKRAYCLSXQSNPLMAIGYVNV

SEQ ID NO: 182405 - protein, 166 aa, Triticum aestivum
  unsure (1)..(166): unsure at all Xaa locations
  Clone ID: PAT_TA_76823.pep
SRLRSTRGLSILPHRKKKXKKTGKTITXEVEXSDTIXNXKXKNQNKEGXPPDQQRIXXASKQLEDGRTLADYNIQKESTLHLVLRLRGGMQIFVKTLTGKTITLEXESSDTIDNVKAKIQDKEGIPPDQQRLXXAGKQLEDGRTLADYNIQKESTLHLVXRLRGGQ

SEQ ID NO: 182406 - protein, 72 aa, Triticum aestivum
  unsure (1)..(72): unsure at all Xaa locations
  Clone ID: PAT_TA_76824.pep
IXQNXKHINYKPKSTKXIXKSSXTKSXKYXNKKKYINKKXTQTSHTXSKXLNQKYISLIIPFSNQIKTYPNN

SEQ ID NO: 182407 - protein, 69 aa, Triticum aestivum
  unsure (1)..(69): unsure at all Xaa locations
  Clone ID: PAT_TA_76825.pep
MQHXMGVNGVIVDXVPEXTGAVSDLMTVPETDTEVNDLGSQAVKDAAPTPNFTQREXSFLLRLMPELVQ

SEQ ID NO: 182408 - protein, 93 aa, Triticum aestivum
  unsure (1)..(93): unsure at all Xaa locations
  Clone ID: PAT_TA_76826.pep
YNSLYSXLPXTLHXXPPPXPXXKFNYPXXXQXPLLYFLXYYINXXTXKPRTHPSLALSIFIPPNIIXMTTYNLPPXXXHXXLXPTCYXXXPXS

SEQ ID NO: 182409 - protein, 57 aa, Triticum aestivum
  Clone ID: PAT_TA_76827.pep
TRILLLRCVTVYGTAKFTFCAVNGLVPFLCCSPKRTLVILSKMAVQSSARCGALRFE

SEQ ID NO: 182410 - protein, 63 aa, Triticum aestivum
  unsure (1)..(63): unsure at all Xaa locations
  Clone ID: PAT_TA_76828.pep
MHGLTLWFFQAIALLWKTQNCLESLVLIFFSQRDVAPSYSSXNYMSADNDTSKLCSHLVYPRL

SEQ ID NO: 182411 - protein, 88 aa, Triticum aestivum
  unsure (1)..(88): unsure at all Xaa locations
  Clone ID: PAT_TA_76829.pep
CSPGLLPSGCVKGATEKILTDGYLLLTRPGQRSLSSTPCPRSPPPGPRSRRHNPCTVYGLDYNXLRCMAVTTLVTSIVWYWRHWMMCC

SEQ ID NO: 182412 - protein, 40 aa, Triticum aestivum
  unsure (1)..(40): unsure at all Xaa locations
  Clone ID: PAT_TA_76830.pep
KDLIKQANQRKHNLAGQQNIVQAHFKPSXXXNXLXSYQSR

SEQ ID NO: 182413 - protein, 82 aa, Triticum aestivum
  unsure (1)..(82): unsure at all Xaa locations
  Clone ID: PAT_TA_76831.pep
LDISHNSFVGELPTNVLGLRQTYAMDFSSNCFIGSIPESLGKLNMLAYLNLSCNSFRGSILRPLEKLKSLASLDLSFXXFSG

SEQ ID NO: 182414 - protein, 130 aa, Triticum aestivum
  unsure (1)..(130): unsure at all Xaa locations
  Clone ID: PAT_TA_76832.pep
AFDYIRRSLEAYPGVTPFEGLASGVVALVQHLPAKSPAILXGGHSLVVKAKDLCTTAMIQDRSLWRSWEESTEPCKKVLDLLLRLIFLVDIQSFSYLLKELAEFVTSLPKEGQDVLLDDMHAHVAESDDV

SEQ ID NO: 182415 - protein, 53 aa, Triticum aestivum
  unsure (1)..(53): unsure at all Xaa locations
  Clone ID: PAT_TA_76833.pep
KXXHTKVFDKXXARLPHXHXNDXXSGXITHETDXXSPPPXXIQLNEPTGTNTP

SEQ ID NO: 182416 - protein, 122 aa, Triticum aestivum
  unsure (1)..(122): unsure at all Xaa locations
  Clone ID: PAT_TA_76834.pep
KFGMGIDKPDVSFVVHNTLXKSXESYXQESGRAGRDGLPAHCVVLXQKKDFSRIVCMLRSADXFKSETFKVAMDQAKKMQAYCELKTECRRQTLLGHFGEQFNSQRCKDGPSPCDICLKEAS

SEQ ID NO: 182417 - protein, 63 aa, Triticum aestivum
  unsure (1)..(63): unsure at all Xaa locations
  Clone ID: PAT_TA_76835.pep
LPRCAWPLLGLIVLASSDRCGEQTAVYFYVSRGLDGAXQTSFCQDESRSSRARDVTKRVVGST

SEQ ID NO: 182418 - protein, 113 aa, Triticum aestivum
  unsure (1)..(113): unsure at all Xaa locations
  Clone ID: PAT_TA_76836.pep
LTXXTIXXXCSXFGRWFWVXMLLGXLXMLGXNFYWDCCVVVRWXYYVLXXLLAWTNWWGGRVVXXVEMCXKCFRVGLXFXLFRXGIFXXDLXPLXXHLFGIFRARIRSGMYLH

SEQ ID NO: 182419 - protein, 105 aa, Triticum aestivum
  unsure (1)..(105): unsure at all Xaa locations
  Clone ID: PAT_TA_76837.pep
ARKPRVERSMGRXIGXNXXYLRPSLLXXSXNXARNRSFFXGSGXNXYKXHTEGFGDVXGMIGXTRTGXTTVLTGVIIIRYXSXXXGSEFXXXDXXPXDXSSLWNL

SEQ ID NO: 182420 - protein, 106 aa, Triticum aestivum
  unsure (1)..(106): unsure at all Xaa locations
  Clone ID: PAT_TA_76838.pep
SCKRWQHLADTLLSIKAIXPDEDKDLAKLXTGYQDMVGFLHXHKVAQTNSQVPVIXEASTFSLKLRKRRSLVLERLNQAPVDGSSGPSSGGSGSCSSSTQGSQLDF

SEQ ID NO: 182421 - protein, 60 aa, Triticum aestivum
  unsure (1)..(60): unsure at all Xaa locations
  Clone ID: PAT_TA_76839.pep
NCALKEKTSHTXPXXTVRAEIXITDTSRISGNXLPNHRSLPTQLRSXARQRXFSLVRLSR

SEQ ID NO: 182422 - protein, 103 aa, Triticum aestivum
  unsure (1)..(103): unsure at all Xaa locations
  Clone ID: PAT_TA_76840.pep
THFQPLSWNLRMKIAHGAAKGLAFLHSEXAKVIYRDFKTSNILLDAVYISTALKDLLLCSDFGLAKDGPTGDKNHVSTRVMGTYGYAAPEYLATGHLTTKSDV

SEQ ID NO: 182423 - protein, 54 aa, Triticum aestivum
  unsure (1)..(54): unsure at all Xaa locations
  Clone ID: PAT_TA_76841.pep
YNXHXPKNKNTKIXEKQFHTXANSQNFNYXNXPTXKKINDCITNXANYSXKXPX

SEQ ID NO: 182424 - protein, 67 aa, Triticum aestivum
  unsure (1)..(67): unsure at all Xaa locations
  Clone ID: PAT_TA_76842.pep
QDVMNDPHIAADGFTYEGDFIRSWFXTGSDTSXPMTNLPXEHDEXMPQHXPSVXPSQEWLQQQNVAA

SEQ ID NO: 182425 - protein, 53 aa, Triticum aestivum
  unsure (1)..(53): unsure at all Xaa locations
  Clone ID: PAT_TA_76843.pep
TISIPXSPXLLQXSSPTHILSCALXHXSSKLXQXTXEIQKXHNXINSSKNSNL

SEQ ID NO: 182426 - protein, 58 aa, Triticum aestivum
  unsure (1)..(58): unsure at all Xaa locations
  Clone ID: PAT_TA_76844.pep
TXGNSKRFYDKLSXXRMXTHGAXFWLFFFFSDGNFSLENXXGXXXFRATQXALIIWVN

SEQ ID NO: 182427 - protein, 69 aa, Triticum aestivum
  unsure (1)..(69): unsure at all Xaa locations
  Clone ID: PAT_TA_76845.pep
XNIILLPSEXKIFPIXLTHVSYKLGVCLQRNKKMATVKWRVCLNGQSQIASTDHVYQFKYDLAIIRWKA

SEQ ID NO: 182428 - protein, 58 aa, Triticum aestivum
  unsure (1)..(58): unsure at all Xaa locations
  Clone ID: PAT_TA_76846.pep
RYCLRXYRKFTXIDGXYSNXNKPXRVXNXLNQXXAGVVRAESNMVRCVFAXQQSDRXQ

SEQ ID NO: 182429 - protein, 52 aa, Triticum aestivum
  unsure (1)..(52): unsure at all Xaa locations
  Clone ID: PAT_TA_76847.pep
NMPYDDFRFFNYQPSLRVELPEQGESFXPYXXPIXLXFCSRGLRIQFXSKHL

SEQ ID NO: 182430 - protein, 61 aa, Triticum aestivum
  unsure (1)..(61): unsure at all Xaa locations
  Clone ID: PAT_TA_76848.pep
KDEEAGHGEQGXNXRXQXXXVVXIRARSQXXSRAPSXXXSIIXLXLSTKXFTKQENLYDPV

SEQ ID NO: 182431 - protein, 42 aa, Triticum aestivum
  unsure (1)..(42): unsure at all Xaa locations
  Clone ID: PAT_TA_76849.pep
KFNYLFPPQLXLLILFPKXQPLSKTLPNLSYFYLXTSLFXHL

SEQ ID NO: 182432 - protein, 42 aa, Triticum aestivum
  unsure (1)..(42): unsure at all Xaa locations
  Clone ID: PAT_TA_76850.pep
MVASSLNPEAPLFIPAAFQQVEDFSPQWWDLVKSTXWXRXHW

SEQ ID NO: 182433 - protein, 130 aa, Triticum aestivum
  unsure (1)..(130): unsure at all Xaa locations
  Clone ID: PAT_TA_76851.pep
LRVTRVKVSGVDCGLDGFTVNNCKGFSLAPSESIRMLISXKADFSSVKVQRDLELAMTTGIFVIPMTANXPVCMLKQCKRSYFSIHWKALMLFFGTVFLFVVVIVRGAPYSLSVNQDYYAKADRKDTIST

SEQ ID NO: 182434 - protein, 147 aa, Triticum aestivum
  unsure (1)..(147): unsure at all Xaa locations
  Clone ID: PAT_TA_76852.pep
TNTTHNTSNPLPPPFPPKFNYPPTXKXFXXKNYTLLYTISXKXXQXIKIXPLIILFIYSXXKPYIPLXILSIXXCXXXXSFXHLLHXNKKXDFIEQFXEXLLVKQDGXNXEXRDVTXXXMRXVXSNXXVXPSVFIFFGRPGTRGGAP

SEQ ID NO: 182435 - protein, 72 aa, Triticum aestivum
  unsure (1)..(72): unsure at all Xaa locations
  Clone ID: PAT_TA_76853.pep
AKPXSLSPARLAXXAVCXSXCXLCGVWFRTCGMFEXGSHLGQYXCHLVCLHHFPXSVFXLFXGVIWLVSSPG

SEQ ID NO: 182436 - protein, 71 aa, Triticum aestivum
  unsure (1)..(71): unsure at all Xaa locations
  Clone ID: PAT_TA_76854.pep
QXHTQXRRGNPEXXXTXGRHXXAXXHTRCMHRDHECVYXLRGDLGVAGHNHITGAVAFXKEINIHSKEKXQ

SEQ ID NO: 182437 - protein, 147 aa, Triticum aestivum
  unsure (1)..(147): unsure at all Xaa locations
  Clone ID: PAT_TA_76855.pep
PTPXQPXXXXXKTTTPPPQKPPXHSPPXPQXTPPTPTNPXPPPXXPXKPHPPKQXXPPXQXTTQXPXXPHPPPXKTTPTKXQHHPQXXQQPPTPXXPPPTXAXRXRRPRPRRRRRRHEGPRGHGVRHLPGARRRPGQGGELGVQQRG

SEQ ID NO: 182438 - protein, 217 aa, Triticum aestivum
  Clone ID: PAT_TA_76856.pep
MKHNGNITGSNDIISNLLLNETKLSCQNPLILPRGDDCVTEEERNIEVQWLCKQGKQLDLGLDTVGAAISIFDRVLTQTCVRSKYANCVAVTSLYIAIKLFEESLDSICIEDILTDFNVDYSINEVLRMERSILAKLKWHLIFPTVERFIFAMLSQLGTAITVDPTALREKVEELFSSWNLMSQYRPSLLALSLISVVMHPDEDGLESLKLCAKLMK

SEQ ID NO: 182439 - protein, 222 aa, Triticum aestivum
  Clone ID: PAT_TA_76857.pep
MCAYVKIYFSSLDPPLLITDVKCFLLIALDTWRKDVQPGDLKDTINEAAPDKIKSLVVSEVSREFHPNFSAKWRTYLYIFPLDGDAKSISEDEQSSMILENPEYKAPRSFDVAKVDKIIRQLEGKMLSYKIFARDTQASRSDGPATECFMFHSRAAVTKLYSADENCKEGTTVMCVELVANRFLRKMVRVLVATSIREAAAGADEDALLNLMDATCRRATAP

SEQ ID NO: 182440 - protein, 239 aa, Triticum aestivum
  Clone ID: PAT_TA_76858.pep
VTVQEPPAASAPEATTPMDTAPVEASADPEASGSAQPTNDPDVVITRAEFVEPGRPTVLAKCSAKGELLQPHRVNLDLSDYANLSIGELVSGYISQVHKSRDAEVAMVNQIQQKSEAVGKKLEADLADLKNRLKMQEMETRKANAKFVSSIAAQEKLKTEFDAERKAWAEEKVALVNRAEQAEKALSEKTAELSGLKRQVSQMVAAVFGPRSANLNQSVVTKLKAVYTLVEQLYTGSQR

SEQ ID NO: 182441 - protein, 191 aa, Triticum aestivum
  Clone ID: PAT_TA_76859.pep
FYYNFSFTSMNPLVWIALGFIGMRGSTRWHINVEDTGGNTPHSVSVYRTPETLISAGTNIQEGKYISIAASTVTSQSISKGAFWNNMSGLGTSGMYLTNSLTQTGIGIELPMMSNYKFLYAKPDNWTVGNGDDNSYIDTYQVDVMVHPTVSSAMKFAIIQKNDAVGTDFNFHFFLNAPQIYYNANAGSVPA

SEQ ID NO: 182442 - protein, 115 aa, Triticum aestivum
  Clone ID: PAT_TA_76860.pep
DMIRASVSHGQIMVPLNTSAQSQQNVQDSTKKPVSVAIASGADAVEEKDGNEVSDDDWDDDWDTFQSLPATAAKDDAHSAIVVSPIPEQGSVASSQEQIHQGNTNHDIGDMDVAV

SEQ ID NO: 182443 - protein, 226 aa, Triticum aestivum
  Clone ID: PAT_TA_76861.pep
DAFEVKIRRWIRAARAAVRGVFASERRLCFLIFHDLPLSNPTIATPAPTTTPAAPFVETVKGAALQLFGFAEAISIGRRSPEKLFKIIDLHDALVDLLPDVSDIFAASKAGEPIYVQTTEIRARLADAVRGVLSEFENAVLRDPSKTPVPGGTIHPLTRYVMNYIVLISDYKTTLSELIVSRPSASSRVPADGNDLTPSFPDLDLPDPDSQLPLSAHLIWTIVVLE

SEQ ID NO: 182444 - protein, 81 aa, Triticum aestivum
  Clone ID: PAT_TA_76862.pep
MHLSRGAADAVGWSTIGLFVLFAALGLYCIFQSIYFWFRIRKGTLLSLGYFNGPWVTRIALILITIWWGVGEIVRLSFLKR

SEQ ID NO: 182445 - protein, 256 aa, Triticum aestivum
  unsure (1)..(256): unsure at all Xaa locations
  Clone ID: PAT_TA_76863.pep
HEATACTVISVLLQLLGLTXWADLFETLRLCFDSQDLNQKEGAAETIYKICENFPEDSIVDAGLRDLLIYDFVPRLMQLFESPHMSLRRLSLLCVNQCIFVVPSVRAPPPPLIFHLMILIYLQEAFRNQFLQGLLELSKQTSTNVKKLVCSSWTLLMERQLIPELYLETAINFVLLASNELDEDLALEACKFWSYCDSSKGLQEVLPELIPTLVQKMVYTDHDDSLADIKEYESISIRDQDLKRHFHASRLHRFET

SEQ ID NO: 182446 - protein, 217 aa, Triticum aestivum
  Clone ID: PAT_TA_76864.pep
GDDCNALYVDGPGTRLDAPANSISGNLLIADFRSEYSGFIEDTVLPADGIALKGIVVRATSGADNYYALTDLNGAYSFAGLPAGTYEVQALALPSSVSASERPNLFLGGLSSITSGDPFDDASSSNVGRFGPAKSVSTPGTANFRVLLNDRQWNDPNYEMPQLLYLRFREDNYFNGNGRSASYWIYQIDQALSGSCPSADYSETLLNAYNTALATLV

SEQ ID NO: 182447 - protein, 90 aa, Triticum aestivum
  Clone ID: PAT_TA_76865.pep
MQIFVKTLTGKTITLEVESSDTIDNVKAKIQDKEGIPPDQQRLIFAGKQLEDGRTLADYNIQKESTLHLVLRLRGGMQIFVKTLTGKTIT

SEQ ID NO: 182448 - protein, 83 aa, Triticum aestivum
  Clone ID: PAT_TA_76866.pep
SARGKARESVKIEHEKKLSTLQSLEYRGRGSAKLDKTKASINKLQSLIVVTSQAATTTSSAIVSVRDNELAPQLVELCFALLS

SEQ ID NO: 182449 - protein, 229 aa, Triticum aestivum
  Clone ID: PAT_TA_76867.pep
RHEDETLAAESRSPSRLRRDGSTPTPMIVDQMPMPQKRRRRRRRPLEGVSRRRLGDGGASLSGSLVDPDSDSSSRVDGGSPPPGLPDDEPAMSGSVVDSDGGSPPPDEPATEPRYHEIVASRLAQLELPVGSEWDLAGFSDIPSREILEALTRKSFHDDESRAALVQYQIQCFLNEETQEGRDRDSQDSAVVVVAEPANDAITKQQHKSDCEKLGARMTEIETYTELDQ

SEQ ID NO: 182450 - protein, 256 aa, Triticum aestivum
  unsure (1)..(256): unsure at all Xaa locations
  Clone ID: PAT_TA_76868.pep
SARGDNPMELFCILAVCEKQKNPGEALLNKAKQMQWSLLALIASCFPDVTLLSCLSFWLEITAARELSLIKVDGISSKVAKNVGSAVEVTNKLPSVSRNVEYRYNRKNPKRRRFLEASPDSFKSGFSLDIASGPNGTATSNPSDIDAQQERRKPTSEETEIPVDIDERLASLSSIVAVLCEQQLFLPLLRSFDLFLPSCSLLPFIXSLQAFCQMRLSEASAHLTSFSARIKDEASQSNSFKEASSITGWVVATAVK

SEQ ID NO: 182451 - protein, 258 aa, Triticum aestivum
  Clone ID: PAT_TA_76869.pep
GYSKSAEISSQQFIELVHRNWRNRLQAASVNALESYCIQVKRCTEIALSCVEVDRHKRPTIGNILNELNETETSSQFPDALLKDLEPTKNQESQQTHITEAEEKREREELIETTNCFGEVVDNCKLDKMARYMGKHKTREDRAREAWNLVDEHDKDDEAFRYVKGLKSLYGNGQSTLCRLYNATGDTLYQVANYDWSGHIGRAPYPATIGNGQWAAFHHIHRAGESSGSVAAVVYRGKNKHGQDKDYIVAWSTPCSLW

SEQ ID NO: 182452 - protein, 123 aa, Triticum aestivum
  Clone ID: PAT_TA_76870.pep
MAPWMGLVLVLVVLCVRPAASANTVPAASYIVHMEKSAMPSPFSSHLRWYASTLAAAAPGAKMLYAYDYATHGFAARLREEELAVLRRSPGFISCYRDDARVVRDTTHTPEFLGVGAAGGIWE

SEQ ID NO: 182453 - protein, 207 aa, Triticum aestivum
  Clone ID: PAT_TA_76871.pep
METEVGSPATATAAPINFSLPVDSEHKAKSIKIFSFGNPHMRAFHLGWMSFFTCVVSTFAAAPLIPIIRDNLNLTKADIGNAGVASVSGAIFSRLAMGAICDLLGPRYGCAFLVMLSAPAVFCMSVIDGPGGYITIRFLIGVSLATFVSCQYWISTMFNSKIIGTVGGLTAGWGDMGGGATQLIMPLVFDGILACGATRFTAWRIAY

SEQ ID NO: 182454 - protein, 81 aa, Triticum aestivum
  Clone ID: PAT_TA_76872.pep
IPINKQQSILITIHKQQSIVPYKHVQSQGNKQQSMVPYKHTISRQQTAINWPRCLPCQGNQSKNKQQSISRQSIKQQTTLV

SEQ ID NO: 182455 - protein, 83 aa, Triticum aestivum
  Clone ID: PAT_TA_76873.pep
RWEGSVFYGRISMVIYCTYSSHKCFHDSVAYSLTSFLCVLEEEKQLCLSPAVFWKRNKYSNTDSSVSVIWRWFIPWKSSHHFL

SEQ ID NO: 182456 - protein, 54 aa, Triticum aestivum
  Clone ID: PAT_TA_76874.pep
RTELKLRKEELLQNFFIVVYESLLSSKIFFLGIFVFCFVFCIYLFLGDCDGFNC

SEQ ID NO: 182457 - protein, 178 aa, Triticum aestivum
  Clone ID: PAT_TA_76875.pep
MGGNKNKSEYFDKLKSLLESYKSVFIVTVDNVSSQQMHEIRHALRGEGVVLMGKNTMVRRALRTFLVDTPEYERLLPYVKGNIGFVFTNAELKGIRDKILENRVAAPARAGAVAPVDVWIPAGNTGMEPGKTSFFQALGVPTKIARGTIEITTDLKLVEAGSKVGPSEATLLNMLNIS

SEQ ID NO: 182458 - protein, 258 aa, Triticum aestivum
  Clone ID: PAT_TA_76876.pep
HEVTAMLTAPNADGRPLFAAKDINRFYLQHCPNIFPPVSKGPFGLLKTMTGPKYNGEHLRSVVKELLGDTRVDQTLSNIVIPTFDIKLLQPTIFSTYDAMKDVSKNALLSDVCIGTSAAPTYLPGHHFETKDEEGKPRAFNLIDGGVASNNPTLLAMTDVSKQILMGNPDFFPIKPADYGKFMILSLGTGAAKIEEKFDVAQCSKWGVLGWLYNRGATPIIDSFSQASTDLVDIHASVLFQALHCEKRYLRIHDDGLN

SEQ ID NO: 182459 - protein, 234 aa, Triticum aestivum
  Clone ID: PAT_TA_76877.pep
TRRMSPNLASRISRSPLYDGNVISFDAAVLSVSQDVDCLREDPEEEIYENGRGNHFRQVSEIQEEPEVEEVACQHAMNGDLDHKESAIRRETEGEFRLLGRRDGNSRFAGGRLFGVEEIDGAISMGRRVSFNTEANMIADRLHRASDAAEASGYPFRDDDVSDGYDDAQDWSRREPEIICRHIDHVDMMGLNRTTLRLRYLINWLVTSLLQLKLPGLKDSDGVPLVHIYGPKIK

SEQ ID NO: 182460 - protein, 201 aa, Triticum aestivum
  Clone ID: PAT_TA_76878.pep
MESSWMPYPAQQLRRLVLHGWFHNLPGFISSSWHPRLSYLWIEVRKLQPWDIHDLGTLPALRYLYLKSILDTAMEERATQSSPLNIDGFPCATECWFEGVTVNPLGFRPGTMPMVRCLAFGAQVWNILDIRHSIKHLGPDGLELDYLSWSIMHLSSLEQLSVDLHGEEASSARYTRAEAALKHATYNHPNRPKVNIWSPRG

SEQ ID NO: 182461 - protein, 205 aa, Triticum aestivum
  Clone ID: PAT_TA_76879.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEKATSSIF

SEQ ID NO: 182462 - protein, 114 aa, Triticum aestivum
  Clone ID: PAT_TA_76880.pep
EAGMTINRSMSYMPQPDTSTHDYIQSLVMRNHRPLVYMEWNGRWRVDCDSLSTSYIPWPPPVPNGASHVWMFGFKIGNDKRHPSMITFLSALACNKGFNPYTGGLIHPLISYGP

SEQ ID NO: 182463 - protein, 167 aa, Triticum aestivum
  Clone ID: PAT_TA_76881.pep
QLSVAEITNSAFELSCMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182464 - protein, 162 aa, Triticum aestivum
  Clone ID: PAT_TA_76882.pep
SWGVAQADRGRGCCVREDHVDVQITALRDPPGFPPGERTQGPLKRELQKGGHALRRGLLPPGWGSMRGPRPPSEEEEAALRLLARSTEVTRALSYNFWMQELRLGEAAGLRFEGAGEDVVGGAASMAEGEAISGGDERIVVFVGGVWMGGSSEMVMAAIGKS

SEQ ID NO: 182465 - protein, 258 aa, Triticum aestivum
  Clone ID: PAT_TA_76883.pep
RLEVLVSKSLEFNFVSLIGGQYEGMLYGRIRRLTVHGGEAPQDSSPNRMAVYPGTRNDIKEMTLQHVRSLSIFDPEAHRLLARLGDFTLLRVLDLEDCKGLEEKHMRHICQMYLLRFLSLKGTAIKVMPSRIGDLEHLQTLDVRQTQLKCLPARIGDLKHLQTLDVRQTQLESLPETVTKLEKLEYLLFSTKGNNWSGWMLPKGIRKMKALRHVNKAVVIHDPNVAKEIGELDQLEELCIYVDTRENIPEDVPIELAC

SEQ ID NO: 182466 - protein, 260 aa, Triticum aestivum
  Clone ID: PAT_TA_76884.pep
RHEAQENFVTVLDGSKQQLPVASKTRRLAVQKRVAEQGDPLTNIRPENLRSFNTMGCHFSTDLSLSCFERLRVVAIEECTFNEGESYNLKYLGRLLQLRYLGLYNTRIDELPQDIGDLRFLQTLDLRGTRVKELPGRVARLRQLKCLRADEGTAVPDWMGNLTSLEELLLGEVGKSVNFVNELSKLTELRKLEIRTEKLDKNQSKALVQSMRNLEKIQVLRLTMRYWWPSLGELNWGDFDPPRQLRELHLMSIASSQPPA

SEQ ID NO: 182467 - protein, 235 aa, Triticum aestivum
  Clone ID: PAT_TA_76885.pep
EALPVGLVAWVPAKARAVARWLSGGRLPAPVADGADPIRGDPPRRNPSLLELDLAQVAAAAAALCVAIVAGIHLIPSLVQRRADSSDSDSSGGDEEESGHHSDRHVWYPPIQSLETGDRRLFFPGLTASARQLPDARQGDDQLHRLSDVENPLILTPSTERFSGPCELSNETTRTWVMRLKITTKLVCLCKRQLHQQNQELAEECFAVVAKQSVEQILEVACSFSDASWSDAHIS

SEQ ID NO: 182468 - protein, 171 aa, Triticum aestivum
  Clone ID: PAT_TA_76886.pep
RPRRAWRSSTFPLPRGRLRRRARAAPSDHPRCPLVGMKRRGETNARRRLTKRRQAGASDLPTPVPRKRVTVVASGQRNKEISAASPLPIAPQPSSVTVVSTITDSDRGDNSMANNQGIDSDVKKSVMNPHHLEIGAIKDNKLYIDMNAWAFLRFKSNPLDKKAISVYHAEI

SEQ ID NO: 182469 - protein, 262 aa, Triticum aestivum
  Clone ID: PAT_TA_76887.pep
RHEEIVKNKAYFKRYQVQFRRRRECKTDYYARKRLIIQDKNKYKTPKYRLVVRVTNRDIITQIVAADINHDVVLASAYAHELPRYGIKLGLTNYAAAYATGLLLARRVNDKFKLKYEGNTEVNGEDYNVEADEEGAKPFKALLDVGLARTTSGARVFGALKGATDGGLDVPHNDHRFPGSKREGGEWHTAPDVHRKYIFAGHVAEYMKYLQENDEELYGRQFKRYIDAGIKPDSLEKLYAAAHKAIRAAPTKPRGDLELGFF

SEQ ID NO: 182470 - protein, 164 aa, Triticum aestivum
  Clone ID: PAT_TA_76888.pep
RVVFAPTAAGPGIPEIKAYLNGVDTPNMFGAPQLIVKIIGSICAVSSGLDLGKEGPLVHIGACLANLLSQGGSGRFRLRWRWLRYFNNDRDRRDLITCGASSGVCAAFRSPVGGVLFALEEVATWWRSALLWRTFFSTATVVVVLRGFIEVCRGGRCGLFGEGG

SEQ ID NO: 182471 - protein, 214 aa, Triticum aestivum
  Clone ID: PAT_TA_76889.pep
GSKGEWGKEERKSNPWKRGDDIDIRIRAHDSKFQIFADQKEIKEYEHRVPLSSISHFSIDGDVFITHIHWGGRYYPVPYESGIPGEGIAPGKTLVIYGTPEKKGKRFHINLLKKNGDIALHFNPRFDEKAIVRNSLLSNEWGNEEREGKMVLEKATGFDLEIHNEAYGFQIFLNGERFATYAHRTEPNDLHGIQIGGDVEITGIQIVDSAPHHA

SEQ ID NO: 182472 - protein, 226 aa, Triticum aestivum
  Clone ID: PAT_TA_76890.pep
GRGRIRRSCAGGRGAMAGVDAARYAQSPAHHAVAMQDHAALRRVLDALPQARKPEEIRTEADSIAEEARAEAVSAILDRRDVPGRETPLHLAVRFGDAAAAEMLMAAGADWSLQNEHGWSALQEAICAREEALARVIVRHYQPLAWAKWCRRLPRVVAAMRRMRDFYMEITFHFESSVIPFISRIAPSDTYRVWKRGANLRADMTLAGFDGFKIQRSDQTILFLGE

SEQ ID NO: 182473 - protein, 153 aa, Triticum aestivum
  Clone ID: PAT_TA_76891.pep
TLLYTWARGRGAMPFISFLFLRDLCVQVGPDCLDTCLKGIYKAYLVNCKLSKSISGSKLQHIQFLGNCVKELYILDPQSAYQHAFVFIRQLAVILRGALTERGPKTSKDKKQKERNKPTNKQLEVLFLLVFAKYFLVFWKHKCCLLIGGISFF

SEQ ID NO: 182474 - protein, 241 aa, Triticum aestivum
  unsure (1)..(241): unsure at all Xaa locations
  Clone ID: PAT_TA_76892.pep
LYRRVLPSPPAVEFASAEGKRLFAEALQGGTMEGFFNLISYFQTQSEPAFCGLASLSVVLNALAIDPGRPWKGPWRWFDESMLDCCEPLHKVKAEGITFGKVVCLAHCAGARVQSFRADQTTIHDFRAHLTRCASSQDCHLISSYHRSPFKQTGTGHFSPIGGYHAEKDMALILDVARFKYPPHWVPLTLLWDAMNTTDEATGLLRGXCGHGSWKSMAKYCVEDVPNLLKDENLDNVTTLL

SEQ ID NO: 182475 - protein, 94 aa, Triticum aestivum
  Clone ID: PAT_TA_76893.pep
APCTATRAAAQASKTLTPPHPRPAATPTKETSKKGSAFAPLAHPQHRDPTGRPTLASIDPSCSPERETRSVLQHRGAGTRSVLLHRARDELLVP

SEQ ID NO: 182476 - protein, 229 aa, Triticum aestivum
  Clone ID: PAT_TA_76894.pep
RHEAQFPQAAASGDLTIHGGYKDGINKDSYVKENFQDAYASAFMATIDTVDTWRGWIKDETRWQALQNYNITSPDWGGRLIEGLLATFQVSNYIEIPFGGEDGHWKGPGSGRKIASVDVVSDFLRDDWQTASPFQRTFYDTDISSRLTVGLGKQVPNTPSDSLVLIPDVDPQVIANFDAEKFGIVQNDPDDYKAVVVRTWGAGKWKTTPSHEDDQEIDGLYAIISIDGQ

SEQ ID NO: 182477 - protein, 134 aa, Triticum aestivum
  Clone ID: PAT_TA_76895.pep
MGSSHRHLMRLLDDPFFPFPPPPPTSSLSSSCPFLPPPPPSPFAFPHHPDLLDLYLPADPFFAPPPIPSPHAFLLHDLTDRVAALELAARAARAAAPQPARRKYTYAATEPGGRKVKWTAEDKPRGGGRALKWE

SEQ ID NO: 182478 - protein, 219 aa, Triticum aestivum
  Clone ID: PAT_TA_76896.pep
GDPVYYEVECGVREVPGSDFKVRKKKARLSSNQKEQLKDGYFISHKTKLTSTQKEMVKQMVQSIYSEIPIFVAVMSKCNVVVEFYLTFPRHYAKKYLTEEPHMCLQRQGRKWEARYCEYNGGKKLTIGWKQFVKDNKLKMGDICLFKLLSNERTMKVYIISENVANYRAGLQNDADREAVFRRGAHDVDGARDPDSRFLRTTKTEAMEDDVVFKTEDGA

SEQ ID NO: 182479 - protein, 110 aa, Triticum aestivum
  Clone ID: PAT_TA_76897.pep
VHHKKWQKEMDKKGVLTSRDVPKRVQASQLNAGSDQMTNISPAQYDKDVNDNENLPHSRAAECILAIYISEPHQFSVISPVSCSTTEACTAQYMYYYCEGSKIWTQQVQR

SEQ ID NO: 182480 - protein, 89 aa, Triticum aestivum
  Clone ID: PAT_TA_76898.pep
RISMPGILVVDEREQECWVRFSECELKLASFFHLQLHIVNTCFQVINIVSDAFKLDFRHCSQARLFGWCGQPTGMEVKGIEISKCAYLE

SEQ ID NO: 182481 - protein, 236 aa, Triticum aestivum
  unsure (1)..(236): unsure at all Xaa locations
  Clone ID: PAT_TA_76899.pep
ARGWKRLALLEFAYLQCNPRVSYAFMKKTWDMFGFTWWVNADILFEDLNIAWIKMEDKIFSRIEFTPLAPRIELRWRMQHVYFETFDDEETTTFLRNATKCDILEKSHFRSAIDDEKMATKQMKKFFELSNGRLFHLETRTATLEGYFAPAVINTFMPLIRSNTIYCKCLPSAVEERYRYEQLVYANKDKTCLHFGTEIAQKFYAKEDFDLLRKVIFANQTIEILSFTXLVRRVQL

SEQ ID NO: 182482 - protein, 75 aa, Triticum aestivum
  Clone ID: PAT_TA_76900.pep
MGKGNRDDMLSNLPDDILVNILDRLDVTYAVRTSILSRRWSRLSTKLSRLTISILDFLPRNGPIFEIDEVVRSNA

SEQ ID NO: 182483 - protein, 71 aa, Triticum aestivum
  Clone ID: PAT_TA_76901.pep
VRWHQPHCYFINRISHLFQVSSTLNVPILYYSSPGFPKIKQNKKNLGQGLLPYKWLRNRAVMLCPWQPQDK

SEQ ID NO: 182484 - protein, 75 aa, Triticum aestivum
  Clone ID: PAT_TA_76902.pep
CEGGLDMWEVRCVCGARDDDGERMVACDACDVWHHTRCVGLADSDAVPPLFLCILCGGALLAAGPMLEEALTLAK

SEQ ID NO: 182485 - protein, 136 aa, Triticum aestivum
  Clone ID: PAT_TA_76903.pep
MARTKQTARKSTGGKAPRKQLATKAARKSAPSTGGVKKPHRYRPGTVALREIRRYQKSTELLIRKLPFQRLVREIAQDFKTDLRFQSAAIGALQEAAEAYLVGLFEDTNLCAIHAKRVTIMPKDIQLARRIRGERA

SEQ ID NO: 182486 - protein, 193 aa, Triticum aestivum
  Clone ID: PAT_TA_76904.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGACW

SEQ ID NO: 182487 - protein, 237 aa, Triticum aestivum
  unsure (1)..(237): unsure at all Xaa locations
  Clone ID: PAT_TA_76905.pep
MGKEKTHVNLVVIGHVDSGKSTTTGHLIYKCGGIDKRTIEKFEKEAAELGKGSFKYAWVLDKLKAERERGITIDIALWKFETPKYYVTVIDAPGHRDFIKNMITGTSQADCAILIIAAGTGEFEAGISKDGQTREHALLAYTLGVKQLIVAINKMDTTQWSEARYHEIVKETSNFIKKVGFNPKSVPFVPISGFNGDNMIDASSNCPWYKXGWEKETKAGKSTGQTLLDAIDAIEPP

SEQ ID NO: 182488 - protein, 253 aa, Triticum aestivum
  Clone ID: PAT_TA_76906.pep
ARGDSVVGYQYFEVATQKKNKKGKRGARRSLNNNLIVIKGLPKLTGYIECLPAKAFTGDLQLLTLNLRNQSEHAVKNIKMKISHPRFVIPGDSSDLDLEFPQCLRKHVQSDSNTVPEGTKENVKGSLFAFPQDIKIQGDATFSWPIWFHAATPGNFSLYLSLYYEMESTTDIPYRTLRMHYNVEVLPSLDVSFAISMCSSRFQEYIVRMDVINKTPSDSFALHQLSCVRTKWAVSTLPSRDSISFVETVPANQ

SEQ ID NO: 182489 - protein, 124 aa, Triticum aestivum
  Clone ID: PAT_TA_76907.pep
SHLLAPCLLFFLFGAKRSISAPLLGKAISVIFRLIHRSNHGSHTLSPIFHFAPVNTLSSTHGGAALDRPSIAPLQSSPCISAPITRSRWLMMRSRLRWLHQQLSASTCTGQLRCVTSPLVYLDG

SEQ ID NO: 182490 - protein, 71 aa, Triticum aestivum
  Clone ID: PAT_TA_76908.pep
YILLGDGVSINSTDEYGRNVLLYAARAGHVDVVEYALSQHCALNQTTETGRTALIYACHEGHDTIIQALLD

SEQ ID NO: 182491 - protein, 229 aa, Triticum aestivum
  Clone ID: PAT_TA_76909.pep
RGEAEEAVKSVNNYNREAFVEVPAFQAGIQTFVPQNRSSSRKASMLLEQRNFTEKGYKDSGSQLPMFRTGSGKSVLISESSVQKAKAVLEEEVKINRDNHNLLNMDKNIPVFASPLKTSCARTVNISSAGVSRAATLLGLEENTLSTQFFGHVGDKLGTKIKFERKNPEQRLASGPTENQVRKEPHRPFELSNNTVSDSGEHSIRFSTAGGRSMAISSDALQRARSLLG

SEQ ID NO: 182492 - protein, 127 aa, Triticum aestivum
  Clone ID: PAT_TA_76910.pep
MWWLPPCFHGGNAAKGEGRDHFDPNPVSPAASARSMSTATSSTITAPSGSDLTGSINASDMSADSIQRPQQYPSFADRPANLRVFTYAELRAATRNLSRSLMLGEGGFGCVYRGAIKVNAGAGDETP

SEQ ID NO: 182493 - protein, 98 aa, Triticum aestivum
  Clone ID: PAT_TA_76911.pep
GTRRGGQLEEAWKLVENVDTQPNSSILGAMLGACKTHGNMPLGETAAKNLISKGAESSVHYTVLANLYAESNLWEDAQSTRKLMAETSGGKEAGCSVL

SEQ ID NO: 182494 - protein, 189 aa, Triticum aestivum
  Clone ID: PAT_TA_76912.pep
MNAAAKVAQQVLGTEPTNLSHNYKEHPTEKMKACRWQAAAKVSLDEVPAPMITDPKDVILHVTGTTVCGSDLHIYHKDLLQQKSGMILGHEFCGIVADVGPGVTKFKKGDRVVSSFQIACGDCDMCRRGLTSMCDKTNDSTVQARLYGGKFGGIFGYTDFTGGYAGGQAEQVRVPFADSNLLKIPDNIP

SEQ ID NO: 182495 - protein, 186 aa, Triticum aestivum
  Clone ID: PAT_TA_76913.pep
ARGALQASLALAGKAVITNRCDYDVWVWSISTGHASSSFMVPAGSSHSEAYTGSSTSLKVSKSDALVAGKHTQFEYSIAAGQLWYDISFVDCANGESASNCPGHDEGLAMNASNDSCGKIDCPAGDYCPTQAYYVDTPLQKLGIAEPVFMCPLSLGTSVDLSMTVCSGNPKIKRSIAGRIQIDGEA

SEQ ID NO: 182496 - protein, 221 aa, Triticum aestivum
  Clone ID: PAT_TA_76914.pep
ARGAVLTDRVLLVDPSNEMGELFCEPFPGTTWLLPPDFPLTSYTNFSIQTAESHANMVKNKVISTVDVAQGLPAFAYIHLDHDATGEDKQFYCDEDQRVLRDIQWLVMRTDSYIVPGLFLVMAFQEELDMLFPEPDTVFHHLGRYLFHPSNHVWGLVTRYHDAYLAAAHQRVGIQVRVFGSAPNSPELLEQITTCAQKEGLLPELLTAGAPAATTSPPFPE

SEQ ID NO: 182497 - protein, 64 aa, Triticum aestivum
  Clone ID: PAT_TA_76915.pep
KVLCVLASVKILIFYVSQLHLAFLGFAPLLQIMASANLKYLELGELLYALRQRPDAFTATDTKV

SEQ ID NO: 182498 - protein, 130 aa, Triticum aestivum
  Clone ID: PAT_TA_76916.pep
RACSEIYFERGGLLGVCLKLKTLKIWPVIRNCHGGPRRLLLQLLPRPESLLFLAGPPSFRCWTATPTSACCYPMSRPGQRRLMRSTSCQSKLGQSRSKRRTEAAEGGSAYSPAPPPGSGVIFLTVGGGGG

SEQ ID NO: 182499 - protein, 85 aa, Triticum aestivum
  Clone ID: PAT_TA_76917.pep
RQRPPPAAPTGSMTQVAAVHHRAAEPLGLRGDQRDAREAERPHRGVRVVGGGGLPCAGPLEEERRAGVAEEPQEVPRDAGVPGRG

SEQ ID NO: 182500 - protein, 194 aa, Triticum aestivum
  Clone ID: PAT_TA_76918.pep
MSSAGSNWLILGGCGFIGRNLVTYLVNNKLATKIRVADKSMPATSAMNATHKAIFEQKDIVEFKQADLSKDDHVNRVFADFNVDYVVNLCGETKFGLNENEYKTKILDTATKTGAAAAKANVKKFVEISTAQIYNPDKSPSNEDQKQKPWTVQAKFRLQAEEALSKLQKEQDLRLVILRPALVYGIGDLTSITP

SEQ ID NO: 182501 - protein, 202 aa, Triticum aestivum
  Clone ID: PAT_TA_76919.pep
LLGELDRLFYLDISNNSLQGEVPASLTRMPALLAGGGNGRGDDDQKVQDFPFFMRRNVSAKGRQYNQVSSFPASLVLGRNNLTGGVPAGLGALARLHIVDLSWNGLSGPIPPELSGMTSLESLDVSHNALSGAIPESLTRLSFLSHFAVAYNNLSGEIPIGGQFFTFSSADFAGNPFLCGFHVGRKCDRKIDDQATDGSTTG

SEQ ID NO: 182502 - protein, 133 aa, Triticum aestivum
  Clone ID: PAT_TA_76920.pep
SLSLPSCLNSERGPTHCFTRSSLCGLFVTLYFYMLSALLSRCRGTFFLLLNSLLASLFHHLVTFASLVLDLKLLLSHLSNSSCHLHPPIVCITSFLPRTLLNNPLLESLSCLPLSFHHFVLATLTHLFRQTDI

SEQ ID NO: 182503 - protein, 174 aa, Triticum aestivum
  Clone ID: PAT_TA_76921.pep
MARSRQSMLLAFAVGAMAAVLLASPAAAKSYNITKILAAHPEFSKFNAMLSKTRLASDINRRQTITVLALDNSAMAALDHYTLPTVRHILSLHVLVDYYGNKKLKQLSRGATASASMFQSTGTASGMSGYVNITSHKGGKVEFVSQDADDTVKPSRYVKSIKEIPYDISVLEIN

SEQ ID NO: 182504 - protein, 98 aa, Triticum aestivum
  unsure (1)..(98): unsure at all Xaa locations
  Clone ID: PAT_TA_76922.pep
HPPPVQSTSQSRRRPAPCRPLPPHSPPRPRCSSPAAGSRGSRSSRPAPPPSPRTAPPPPPPTVRGSAASPXPPARPRLRFRPSPPGDGRSSAGGGGCG

SEQ ID NO: 182505 - protein, 218 aa, Triticum aestivum
  unsure (1)..(218): unsure at all Xaa locations
  Clone ID: PAT_TA_76923.pep
EIIHQISETVYPMYKAFIEPDLKTAHIRIINKFNPFSGFQNPMYILKSPRSLTPDQIKAALGEDQTESNEETYDIYLLPPGEDPEACQSYLRMRNREGKYNLMFEEWVTDNPFIISPRITFEVSVRLLGGLMALGYTIAAILKRSSRVFSDGKATVKIDWLEQLNRRYIQVQGRDRLYVKFVAEQLGXLDGSYIPRTYIEQIQLEKLMNDVMALPDDL

SEQ ID NO: 182506 - protein, 130 aa, Triticum aestivum
  Clone ID: PAT_TA_76924.pep
GTRKAIPHSIFISGGGAFPSEAPNLHLALHLCFHIFLRRLFPDLFGVNHPSQFSPYQSIWLPLVGLEFGSCVNSAGEGLVDPRWTADEIHMNILCTCPFHTEIIFRHGRYIHIGGFRSTNMCYLLITSVP

SEQ ID NO: 182507 - protein, 78 aa, Triticum aestivum
  Clone ID: PAT_TA_76925.pep
YFLLRISVVMMDTDILGVISKLGECSIGSVRATFRTLGGRASFTKMSGHSRHMSAYKSTMLSRLGVPLKETFSSGTCG

SEQ ID NO: 182508 - protein, 179 aa, Triticum aestivum
  Clone ID: PAT_TA_76926.pep
GTRLSSIKSGEETTATTAASISVAAVALRRPSRASSEHPGRRRSADGATACAWRCCSGALVAGSRCCGAALARWTGARCCKEASLAAPEAPRRHRSCIRRGVAMERSAAAPGGAMQRLRGGPELRAATVRRRRLQWSFTCEAQSCEAAPGAPMELHRRARSCSAAGRAALELRRGCNGA

SEQ ID NO: 182509 - protein, 65 aa, Triticum aestivum
  Clone ID: PAT_TA_76927.pep
KNFYQLKRLISFFLVELMQKRSFIMISSASSNERVKRFQGTPTIIQDDSPITHVDVTEDIPASDV

SEQ ID NO: 182510 - protein, 163 aa, Triticum aestivum
  Clone ID: PAT_TA_76928.pep
DQTSISRHYSSQLRFERRGRDDDHDSAGPEERNAGGSGSAPYTKCTPPPNSTVCDLSNSRFDICELCGDARTIGQSSTVMYVLHTQTSDGEEWSIRAQSRKNLPWIKKVTVKSLNTSQPAAKCTSKHAMPAIVFALGGLTANVWHDFSDVLVPLFLTARQFDR

SEQ ID NO: 182511 - protein, 211 aa, Triticum aestivum
  Clone ID: PAT_TA_76929.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAAAAPAPAAAAPKKAKAKK

SEQ ID NO: 182512 - protein, 167 aa, Triticum aestivum
  Clone ID: PAT_TA_76930.pep
NLHRHLPVVSSPPTPSPPMPTSKYAAGVARPSSPRRFFSDNSLAFFSDAAAPPPTTCSSSPAFPRRRSRPSPKSATPLLHPPLMQKPQHLRLSPLSPPTPTFAYAGYALHIIGGGGSFHAYVLQVLPIRVRATPRGLLCCVQLERHPRAPHSRSPPIDSIWKMAGLV

SEQ ID NO: 182513 - protein, 124 aa, Triticum aestivum
  Clone ID: PAT_TA_76931.pep
RHEDAMDYFASVGFAPGFHVNPADFMLDLANGFAQAEYSDRAAEGVSVKQSLIASYARELAPKVKAAIGAGAHVENGHAGGGAGEQPLESCSGSGCTRWTNQFTILLRRSLKERRHETFTSFRL

SEQ ID NO: 182514 - protein, 181 aa, Triticum aestivum
  Clone ID: PAT_TA_76932.pep
MSVSELAPSFAASTSIVCLSGFQEVNPEYLPAIYPVCGNLTSLNVSFASLTAEDLTPVIRQCHKLQTFWVLDTVGDEGLRAVAETCSDLRELRVFPLDATEDSDGSVSDVGLQAISEGCRKLESILYFCQRMTNAAVVAMSNNCPDLVVFRLCIMGRHRPDRITGEPMDDGFGAIVKNCKK

SEQ ID NO: 182515 - protein, 189 aa, Triticum aestivum
  Clone ID: PAT_TA_76933.pep
RTRAVSQMSNTYGIPSQQQQQSTQPSQSQQQQQQQQQRRTFGFTETSSVSLIPDGNKPSVNSTPVAPVTTTSTLSNYTKPAVTSQSSYSHSQPTQQVQQPLHQQHTSQQQMYNPMYGAHYPYVNLYSPVAGRAEDTPYATPYHMPYAAYGYGCFIIGTNDATYADASCDSQSSSTTAGFPSRRPSSNFQ

SEQ ID NO: 182516 - protein, 191 aa, Triticum aestivum
  Clone ID: PAT_TA_76934.pep
MARRGGMGQLLVAGCCLLVALALACSVASGQTSQTGQPIKLPPKATFQTITIPKNSTKRLYAVTCHERRGKPCVVSCPSRCPNKCLAYCKYCMAFCVCDLVPGSSCGDPRFTGGDGNTFYFHGKKDQDFCIVSDEALHINAHFIGNHNPAIRRNFTWIQAIGVSFGQHRLYVGARKADVWDEEEDHIHVML

SEQ ID NO: 182517 - protein, 82 aa, Triticum aestivum
  Clone ID: PAT_TA_76935.pep
KCCYKSQHLSRVLINLKLIMLSPKVCSKSISVAQEITSISSQRFRNSSCSMNKRYHFNTMALIQCWRIQEINKTSSGSANIT

SEQ ID NO: 182518 - protein, 206 aa, Triticum aestivum
  unsure (1)..(206): unsure at all Xaa locations
  Clone ID: PAT_TA_76936.pep
RGTCLLICSAFIIKAQDTAVPATVTMRLSARPIEDDGTINGDASIELDKCREIVDNCHYYTTSMPEGSVQRDNATRMCNNFQNSQANCVRLYYSNPKCFSYCWGQCMALPWNAYWSCLKFCGYCYDIAETCQSGQDACKNAADNYNVGADCHCPNAQVDDCQLKMQRQDIPCYQTCIDNCNTFKTWQTWKRCFDGCEGCYDYXRSY

SEQ ID NO: 182519 - protein, 101 aa, Triticum aestivum
  unsure (1)..(101): unsure at all Xaa locations
  Clone ID: PAT_TA_76937.pep
MANRWWDEGRLTEAPPASGLASNHNQQQQLEDAMAAPKVDGESSHSGGGSGQEQDDEPXGGARWVVPANRRPRGRPPGSKNKPKPPIFVTRDSPNALRSHV

SEQ ID NO: 182520 - protein, 163 aa, Triticum aestivum
  Clone ID: PAT_TA_76938.pep
GRIFIARQRRPSHRFPALPAMDASTTSSSSPLCFAQKPPSPRPLLNPTPRATHAGAGRQRATRLRGISPSPSPSPPTPQQQQQQPMEAFGFDALKETFSVDVAAAEARPLNVPLAAPFTIASSRLDAVSNVAVRVELSSGAVGWGEAPVLPSVTAEDQPAALA

SEQ ID NO: 182521 - protein, 230 aa, Triticum aestivum
  Clone ID: PAT_TA_76939.pep
MGRKMPRAIITDQDEAIAKAISEVMPQVKHRFCKFHVMRKAREMLGGFIAARGNISSELRALVNNSLTEAEFEEGWAALIEMYSASENEYLQLLWETRKEWVPVYFREDFYPFVETTGCCEGANSLFKDYVLPKDRIEKFLERYEDVQERIMETDDEDRLQSRTEPSCFSMQPIEKHAARIYTRQIFLKVQRELLHSTAFNVQEIQTGTVYRLEKVSAYQNPEFDRNSFE

SEQ ID NO: 182522 - protein, 94 aa, Triticum aestivum
  Clone ID: PAT_TA_76940.pep
QYTFIIRSNIAKGFIVPIHRRIRIKHDHLNTLTKQTIACLNRFQAVRLNDDGKHDHLNTLTIQTIARLNHFQAVRLDDDGVYIPSFQPVLGPSG

SEQ ID NO: 182523 - protein, 196 aa, Triticum aestivum
  unsure (1)..(196): unsure at all Xaa locations
  Clone ID: PAT_TA_76941.pep
MLRVAGRRISSHLAWRPAAAASAGSSPLAGGLPGDDFPRDQNPRFAIESPFHVAARGFSAESLVPRDQDVELAELTPTTAALKNPCAKIVYDEYNHERYPPGDPSKRAFAYFVLSGGRFVYASLLRLLVLKFVLSMSASKDVLALASLEVDLSSIEPGTTVTVKWRGKPVFIXRRTEDDVKLANSVDVTSLRDPQE

SEQ ID NO: 182524 - protein, 174 aa, Triticum aestivum
  Clone ID: PAT_TA_76942.pep
MIKVQAPELYRDSGAFEARKRQSLRARYVYGLIFFATNLLAWFIRDYGAKLLGGLHHIPVCGAGDSKCFRSGGVLRVSLGCFIFFWVMFATTFGTRKLQGVRNSWHSGCWALKFLVYAVSIVTPFIIPNIFIQLYGEIARMGAGIFLILQLISMLHLISWCNKRWMPDAGSNQC

SEQ ID NO: 182525 - protein, 143 aa, Triticum aestivum
  Clone ID: PAT_TA_76943.pep
MECAAKGIVEDPCASGANRRCGSCGAVAYCSKDHQFIHWKVHKEECARLATQMSRIDMLSQFPFTFSVEPHALNHTKRSMRCLFLESMKVHLKGLWKSGCMCGPDIASVKDLSITTEWNMESSLCPCTEPENPVPAPLASWED

SEQ ID NO: 182526 - protein, 127 aa, Triticum aestivum
  unsure (1)..(127): unsure at all Xaa locations
  Clone ID: PAT_TA_76944.pep
WGQSLGGLVRPRSGRPQLCRTHQRPAAAMAAPPRTQSTPSRPPREQTXPAAPPRAPAAPARPAAAXSTRTRAPPPPSTGEGFARRHPPATARRGRGRRGAWAAARVSPPESPLERRGGWEGSLVYDR

SEQ ID NO: 182527 - protein, 56 aa, Triticum aestivum
  Clone ID: PAT_TA_76945.pep
EIATRAGKCFHNCGSFEPKLYSRVLFLKQIPSFLYFLTINLNELFIAVTDVMLNRL

SEQ ID NO: 182528 - protein, 57 aa, Triticum aestivum
  Clone ID: PAT_TA_76946.pep
ILPKAWVVLRCVATRSTLASRRQCRAKGCVYYLIHLFSRQVHEGIYMVASFMHMLLF

SEQ ID NO: 182529 - protein, 78 aa, Triticum aestivum
  Clone ID: PAT_TA_76947.pep
KHLTLVPLWIRFCSTLSRSLITSLHFFSRQHKYFRLVFKLRQHNCRRRGQESAHELVASRRIIKGLQMHLKMCMFKFG

SEQ ID NO: 182530 - protein, 55 aa, Triticum aestivum
  unsure (1)..(55): unsure at all Xaa locations
  Clone ID: PAT_TA_76948.pep
KLWWCLLRATEVNGPELINIYVGESEKNIRDLFQKAXISIPXVIFFDELDSLAPA

SEQ ID NO: 182531 - protein, 40 aa, Triticum aestivum
  Clone ID: PAT_TA_76949.pep
GGGGKADGKDTLRLRLDLNLDVEVELKARIHGDLTLALLS

SEQ ID NO: 182532 - protein, 72 aa, Triticum aestivum
  Clone ID: PAT_TA_76950.pep
MAGESSTRRPLFGGAISTAFPVRFQDVSNIREVPDHQEVLVDPARDESLIFELLDLKGEVEDGGSALWFLRD

SEQ ID NO: 182533 - protein, 164 aa, Triticum aestivum
  Clone ID: PAT_TA_76951.pep
QDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 182534 - protein, 249 aa, Triticum aestivum
  unsure (1)..(249): unsure at all Xaa locations
  Clone ID: PAT_TA_76952.pep
WELTSHSSFLTYIDLXNNSLHGALPASICSLSALSILDLTYNQLTGKNPYEIXNLQSLSYLGLSFNRLTGHIPVSLGNLTMLNVLVIHQTMVSGSIPEEVGRLVNLQILQLSNNTLSGFIPKTFGNLTQLSVLLLFGNRLSGPIPQELGKLVHLQGLYLNANDFSGPIPISITNVTKLNTPFLFANQITGSIPPELGDLNMLNKLDLDRNEITGSIPXRLGNLTMLSELYLNTNQITGPIPSELGILLN

SEQ ID NO: 182535 - protein, 103 aa, Triticum aestivum
  Clone ID: PAT_TA_76953.pep
GCYEQRTTDGTLQSRETVTTTCCCLISGRPLMRENLAVERHASKIYTRAMFEQFGHILYECGTYQVEEIERHKTYVAIHSEAEKRDKWCRVAYKVRMLDGGDE

SEQ ID NO: 182536 - protein, 206 aa, Triticum aestivum
  Clone ID: PAT_TA_76954.pep
MFPLSALPRCIALRSKHDNSYLRSVHDESQGGSFIELSAGDGGVMNPRSRFYLEPSKEHDGLVHVRCCYNNKYWVPQQRVLHGSTRWTIGTANELEEDLSKPSCTLFKHIPVADEEDSTCRFLHSQLGKYACVKSSSDMSKRPYLHIAHEEADQDNLLRAFTILDVSEQKQLPTYLAFKGDNGQFLGAKIVEGYNYLEYSQTDIGD

SEQ ID NO: 182537 - protein, 123 aa, Triticum aestivum
  Clone ID: PAT_TA_76955.pep
KTGAKPLFIKYGLNHVTDLIESKKAKLVVIAHDVDPIELVVWLPALCRKMNVPYCIVKGKARLGHLVHKKTATVVAVTDLKKEDTAKLDQFVANIRGTYNDDVSHRHKWGGGTVGIKAQHVIR

SEQ ID NO: 182538 - protein, 220 aa, Triticum aestivum
  Clone ID: PAT_TA_76956.pep
LVTQKRDVLPRERTLSKNRYPKLHIPDHISEFPMSRIEKATNNFHSKNLIGEGGYGPVYKGKLGGIIVAIKMLGPHGKPHGKQGFPEFQQEVVVLSRTEHPHIVRLIGVCQESCILIYEHLPNGTLMDGLSKGLPWKDRVRILAEQRSALAHLHSSFPHAIIHADLKLTNILLDAGNVSRLGDFGTARIVQMKPLKEDTICRWTNPMGTMGYMDPIFFMT

SEQ ID NO: 182539 - protein, 126 aa, Triticum aestivum
  Clone ID: PAT_TA_76957.pep
VRSLTARSAGLAINSQRPWWIFGRCSVTRLTSYFLCTDAGIFLDIGGCIIYSFQPGNRSLSTRSSVSDIQLGRAFAGFLPGSGTRFLLFFFPVHHCVQRSVMFSNVAQGMFVLFIGKFGSEIIDYR

SEQ ID NO: 182540 - protein, 58 aa, Triticum aestivum
  Clone ID: PAT_TA_76958.pep
HKHYYRLGQIFFTTSLRTDQTEGFVSVCILSCLPARECPFTRQDKCSSQYASLLHMTV

SEQ ID NO: 182541 - protein, 161 aa, Triticum aestivum; identical to SEQ ID NO: 129051
  Clone ID: PAT_TA_76959.pep

SEQ ID NO: 182542 - protein, 215 aa, Triticum aestivum
  Clone ID: PAT_TA_76960.pep
SGRRPGLLVVRAARGKFERNKPHVNIGTIGHVDHGKTTLTAALTMVLASVGGSAPKKYDEIDAAPEERARGITINTATVEYETETRHYAHVDCPGHADYVKNMITGAAQMDGAILVVSGADGPMPQTKEHILLAKQVGVPSIVVFLNKKDQVDDEELLELVDLEVRELLTAYEYDGDNVPIVSGSALRALEALMATPGLKRGDNEWVDGIFSLID

SEQ ID NO: 182543 - protein, 156 aa, Triticum aestivum
  Clone ID: PAT_TA_76961.pep
RAALQGYVHIRVLTNHPECHANQSFTADWNRVHHRKNQSFTLTGTGFTIGKTRASIATSFTEKQPDQGPLSEPQRNQRLRKLLTPLNLGSRMRQATKLHHKNGRRSPTRRPSSHRPYRRVVNPITTLQASKGEVEKRNTNREARSMKKTSLTPMQE

SEQ ID NO: 182544 - protein, 154 aa, Triticum aestivum
  Clone ID: PAT_TA_76962.pep
WLRVLLLPESARLAPPATPAPSLPPDPDAPPTLVHPDHDARPAAGHSGLVVAPAPPTPARFPPPALDPHAPPALDPSMPSSALDPSLPPRPLALDPTTAPPGSGPLCAALPRWRTVTTNPSSSPAVRAYTPAPFNSYLEYVCDGCMPPPAMDKV

SEQ ID NO: 182545 - protein, 260 aa, Triticum aestivum
  Clone ID: PAT_TA_76963.pep
RACDIDTYEIGGTGPYKTGTTLVDPKGVQAWLPAEYDDSRYGWKRDPGWKLGECIWAQHGVWDPSTDTLINNSYFSKAPDGTQVGMHEWINIYYKNHWAKFRKAVRSVHETAIVFMQSPVFEIPPVLKGTPEEDNRMVFTPHFYDGITLMTKNWNRYWNVDVLGVIRGRYLSPVFAIKIGETAIRNCFKDQLATMRDEGLQNIGETPCLFSEIGIPYDMNDKSAYKTGDYSSQIRALDANHYALEGSNLNYTIWTYCATN

SEQ ID NO: 182546 - protein, 199 aa, Triticum aestivum
  Clone ID: PAT_TA_76964.pep
QDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 182547 - protein, 236 aa, Triticum aestivum
  Clone ID: PAT_TA_76965.pep
TRQRFKDSEDDAKSVLVQILNVVAFCHIQGVVHRDLKPENFLFTSKDENSQLKTIDFGLSDFVKPDERLNDIVGSAYYVAPEVLHRCYSTEADVWSIGVIAYILLCGSRPFWARTESGIFRSVLKADPSYNEAPWPSLTPEAMDFVKRLLCKDPRRRMTAAQALGHPWIRNYNDIKMPLDVLIFRLIKAYIRSSSLRKAALKALSKTLTVDELFYLKGQFSLLEPDRNGCITLDNI

SEQ ID NO: 182548 - protein, 199 aa, Triticum aestivum
  unsure (1)..(199): unsure at all Xaa locations
  Clone ID: PAT_TA_76966.pep
IPPPPHLHLLPGSSRCAHPPAFPRSGRHISRLLAPAHSACLLFQKNWGPSAGIQAFLGSTQCLPTLARSPPGGAPAPTFFLIPVPTPPPPPDCPDGDTMPSQSSPASSGRLGPSXSSSPEQSSRETLCLHGPHLPLSATALPSSSASPTRPTAYTATPSLAATMSSQRGQPPTPASAATTSSLSVSLLASSQLARETVE

SEQ ID NO: 182549 - protein, 143 aa, Triticum aestivum
  Clone ID: PAT_TA_76967.pep
PSSEILVSSTHIEGSASSECPHSSYPTSQLTQRSAVTHSLTTYILATLPEKLYFTPSSTSTFILPSSFDIMASVLPTRRPKLTLQINTAAVSPVVPSIKLASPVVSKKFKPAPVHRFSYGSGSDSDDNGKFWSGEDASSATSS

SEQ ID NO: 182550 - protein, 212 aa, Triticum aestivum
  Clone ID: PAT_TA_76968.pep
KNGEWHVVSVDDRLPCGHSGKLFFATCRDPSEFWVPIVEKAYAKLHGSYDAIAYGNIADGLKDLTGEAVEVILLDDKSYNLQPDQLWKTLVYNIKESYLMGCALENSSANTEHELPTGLLVNHAYSVIDCEEVKGVKLMRIRNPWGRGEWNGAWGDGSKEWTPQLMKHFKYTFDNDGTFFMRFEDFLKNFNRIYVLRLMTDSEGEVWHKFNF

SEQ ID NO: 182551 - protein, 172 aa, Triticum aestivum
  unsure (1)..(172): unsure at all Xaa locations
  Clone ID: PAT_TA_76969.pep
MPDPAGLLPFAQPPTPPLASSRRRPEPRPKQPSPXPQIAPPLPSPGRAVAATLPRSPHNHCHTPPPPXPVPPPAPRPKSPPPTAAPHAPPPGPSTSTSSLCFSSIAGVLGSGDASDHRSSPPGCLSCQIRRPHTAPLHLPPPPGLATSDGDHHCTRCRVWTAAMVGSDLPPG

SEQ ID NO: 182552 - protein, 236 aa, Triticum aestivum
  Clone ID: PAT_TA_76970.pep
MMSFQSTRIGVCRNVNNTLRIQNISNMARTVQPPIIFVDNNAQRRTNNLLGPNKNFPFPGDVAIANSFGAQQLSFDNNQIEVNTIKPEPQPDSPFKSLSIEQILSLSPNVKKAADYEPEPFVDKLKSNCNIELKAVNCPRLLKKDLKYLFVDMDLTDKQITVLNLSQKSDADMGTWSPDMEVERMKLTASFIDSANAICQALKEFGYWADFIDPSSGRPYLGKFTNASLFETDDRY

SEQ ID NO: 182553 - protein, 216 aa, Triticum aestivum
  Clone ID: PAT_TA_76971.pep
CNKTEESTTRHLPLSSQKPLDRDGQAAEGVVKKSGAAVVRNLFDLNDDVPHEDNSESSVVSHECDVVALQNNHAKRTFLFDLEEVPACEDGAAWTSQQECTPSGKLGASKEADMCFPSATDAAQIILALSTDVPTTTGTPDGMLQWFAELAISSMDDHAEQAKVQGCIDNSSDDGSDSFEALTLKLEECKTDERWTRTPEPPLTDDDQAVSAVNLL

SEQ ID NO: 182554 - protein, 161 aa, Triticum aestivum
  unsure (1)..(161): unsure at all Xaa locations
  Clone ID: PAT_TA_76972.pep
PPTFSPKSSGNVGAQRRCPPAPTLPTSRGPRLVMDPALPRPSSLVLDPPPPDGSRRPSTIPPPEHHHAAGGARRHDHCLPVXPVPEPLLPPCSHHCLPSSSRNHRAVAPPPPRAAAPAPSXAPPHPLQPPLPPRVTYPRVGKPSDLPHHHPLVATRCQIRS

SEQ ID NO: 182555 - protein, 83 aa, Triticum aestivum
  Clone ID: PAT_TA_76973.pep
PTSVRFPEFRKEYRPFCSVRVMLGVYYMIARRDWRHAMRHWIWAVRVICLHFLCGRSRVCLDYVRGCSSVQQIKQYFTELAHN

SEQ ID NO: 182556 - protein, 154 aa, Triticum aestivum
  unsure (1)..(154): unsure at all Xaa locations
  Clone ID: PAT_TA_76974.pep
RLSATASCSSSAGCSASRPAPPLKTTTPGSGCSPRISSRSTSSAWSTAPARSPPASASPASRAFSSPGPPWISPSXTTSSSTTRCSRSRSSSRPAPPPGPRPSTAPWPPSWPSSCWRSTSCRAASSASSAARPPSPASPATPVPARSPPPPRAS

SEQ ID NO: 182557 - protein, 171 aa, Triticum aestivum
  Clone ID: PAT_TA_76975.pep
MAGGGGDEEVTLLGHWGSAYVTRVRLALHLKGVRYEYVEEDLRNKSDLLLRCNPVHRAVPVLIHNGRPVCESQIILQYIDQAFGPPTLLPADPHERAVARFWAAYADDVLGAPWEKAYRARTEEERAGWMRRVVAATDALERGLSECTDGGKKGCFFGGERVGFVDVVLGG

SEQ ID NO: 182558 - protein, 129 aa, Triticum aestivum
  Clone ID: PAT_TA_76976.pep
CSTLFSRMRYSQSTLESIGFRTHAPCFKLRGRDPETRRNRQNPPEKHQATCGLLLRQDPSTPSPTRSPGPPRTTPSHQRRRRCGAGQLLFIYLISHNISLLDTPPLFPDHVVVKHCPWPTAAQPSVCTA

SEQ ID NO: 182559 - protein, 83 aa, Triticum aestivum
  Clone ID: PAT_TA_76977.pep
ECLQDMAGLISKINRSAMGPLPTCYSSSMKSLIKIMLRKNPEHRPTASEILKNPYLQPYVDQCRALYDASNTMRTPPKSLSTS

SEQ ID NO: 182560 - protein, 94 aa, Triticum aestivum
  Clone ID: PAT_TA_76978.pep
ILNRKSGNNPRGWISIISPSLNYFVVNKVLRRSTTNSFLNMFRRGHGSKHTAAWITHLCFFGSDRETQYLQSGEHGCEQKWWLEVVGTSTAGNE

SEQ ID NO: 182561 - protein, 246 aa, Triticum aestivum
  unsure (1)..(246): unsure at all Xaa locations
  Clone ID: PAT_TA_76979.pep
GQFDHTAFVSISQKPNMTGLLYRIQLKLGMNWSCVCEVEDITDDLRNYLTHKRYLIIVDDLWDQSAWNTISRAFPXYGSEDDRQFEEITAEILKKCGGLPLAIITIASLLASRPKKLRDEWERIRNSLGTQFSVNPTLEGVKNILNLSYIHLPLHLRACFLHLGIYPEDRAIERDDLVRQWSAEGLVRKLHGQDSEVVAKSYFNELINRSLIQPGRIEYGELLSCRVHDMMLDLILTKCEEHNFLS

SEQ ID NO: 182562 - protein, 62 aa, Triticum aestivum
  Clone ID: PAT_TA_76980.pep
AYSCLWRFASLCSGGDPPRRPPRLASRRRRPVVAQRAPSAATATPSCRIEEPFDVQQELLIW

SEQ ID NO: 182563 - protein, 128 aa, Triticum aestivum
  Clone ID: PAT_TA_76981.pep
LGQGGSQDFFDLSVIDGFNTPMSFQPVGGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 182564 - protein, 200 aa, Triticum aestivum
  Clone ID: PAT_TA_76982.pep
ARDWLAVIPPASLYSFEVICVTLWVLLMNKVIVPATRTFFTSGAELTQLQRIGIGRFLMIFAMAMAALLEAKRLESVQHGNPLSIVWQLPQYFVIAGAECFVIIAQLEFFHGQAPDSMKSMLTAFALLTTALGNYLSSAIITLIARLTREWQSPGWIPDDLNEGHLDYFYWCLTAISFVNFIVYVYFASKYRLKKIVIDG

SEQ ID NO: 182565 - protein, 133 aa, Triticum aestivum
  unsure (1)..(133): unsure at all Xaa locations
  Clone ID: PAT_TA_76983.pep
MPIHSVHPSVDPPESVHIIFLEDHRQWSPGPLVPARRRCRTRIRRWPRPTPWRSAGAGARWCVCVVVQVVGGDVAADMPRLAETARSLGREAGMSEKTSGAAXADEMGFLGADTDGIPWSXSMLQWQRTGFHF

SEQ ID NO: 182566 - protein, 238 aa, Triticum aestivum
  Clone ID: PAT_TA_76984.pep
KNHSDTGVKILKFVIRDHYNVDTCHLNSWLQKAVTPGIEEVTLLLPTKHRKMYEFPCSALLDGRGNSIWYLYLTNCAFRPPVGFDCLRSLAKLHLYGVCITGDELGHLISNCFALEELEVSCCMKLICLEIPFWLERLSCLTVSQCDKLRVIKSTAPHLSIFDFFGEPVQLVLGESSKVKDLRVGYSFAPNAVSYAITKLPFIAPHLETLTVYSFCERVSTPMVADKFIHIKHLNIYF

SEQ ID NO: 182567 - protein, 252 aa, Triticum aestivum
  unsure (1)..(252): unsure at all Xaa locations
  Clone ID: PAT_TA_76985.pep
GTSANQILKAAXLAINSDVLAEMEIPEAYLESLPKSGRSCLGEIIYRYITAEQFSPECLLDCLDLSSEHHTLEVANRIEAAIHVWRLKGQKKTAPQAKSKKSWGGKVKGLVGDTKSQVLSQRADGLLQSLRLRHPGLPQTSLDMNKIQYNKDVGQSILESYSRVLESLAFNTIAXIDDVIYVDDATKKSAAAETVSIFNRGTGAPVQKKISPSPFSIQHTPYASPFATPTFCSSTPVNGNSPGRAPQPPPSK

SEQ ID NO: 182568 - protein, 179 aa, Triticum aestivum
  Clone ID: PAT_TA_76986.pep
GPAAAERGEHQEAVEILDNRQRALEQSEAAGDGDPMIVALGAELQEMRGRVSNRQSYMRSGRAYMLAGMSAHQQQRATSRQMLEPEEQQTSMMARNSGVRRMIRRGVGSSGGGYMAAAAPVAEASNEATMSYATPAMRAMLLRSREARGASAEQGQQEEQQPMAGKDDAGSSGPKDVNQ

SEQ ID NO: 182569 - protein, 90 aa, Triticum aestivum
  Clone ID: PAT_TA_76987.pep
GTRSSTMPKAAGGGRPPETAPSSAATRHLPLGTTMSASPAAPTTLAASSSPPLLLPAATRSCDGMNGSSSSLVCWFFFSPLQLILGVGVV

SEQ ID NO: 182570 - protein, 245 aa, Triticum aestivum
  Clone ID: PAT_TA_76988.pep
PRSAEVAKRALTRGLDPSQIRVYGLPIRPSFCRAVLDKDELRKELGLHPELPAVLLMGGGEGMGPVEETAKALGHELYDHRRRRPAGQVVVVCGRNQALRSTLQSLTWKVPVKVMGFEKQMEKWMGSCDCIITKAGPGTIAEALIRGLPIILNDFIPGQEVGNVPYVVDNGAGVFCKDPREAARQVARWFTTETDELRRYSRNALKLAQPEAVFDIVRDIHKLQPQPAALTRIPYSLTSQFSYHI

SEQ ID NO: 182571 - protein, 49 aa, Triticum aestivum
  Clone ID: PAT_TA_76989.pep
APAAITTGKMPLTTVQLLWVNLIMDTMGALALATDTPTKALMDRPPIGR

SEQ ID NO: 182572 - protein, 229 aa, Triticum aestivum
  Clone ID: PAT_TA_76990.pep
HQPRSCKEAAEKTVNAAMFQIGLGSNDYINNFLQPFMADGTTYTHDQFIRLLVATLDRQLKRLYGLGARKLAFNGLPPLGCIPSQRVKSATGECIAQVNSYAVQFNAAAKKLLDGMNAKLPGAQMALADCYSVVKELIDHPERNGFTTSDTSCCGVDTKVGGLCLPDSTPCRDRKAYVFWDAYHTSDAANRVIADRLWAGMTTASAPAPAPRAGAPGPAAVPAPSPSRA

SEQ ID NO: 182573 - protein, 159 aa, Triticum aestivum
  Clone ID: PAT_TA_76991.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATT

SEQ ID NO: 182574 - protein, 71 aa, Triticum aestivum
  Clone ID: PAT_TA_76992.pep
CPFASHLPEGEVHPSRAFKLCSSIDLDRHNFLHCCLLCRLHLIGCSQQLPVLNCSCKNMFLMQNRSIYFLI

SEQ ID NO: 182575 - protein, 206 aa, Triticum aestivum
  Clone ID: PAT_TA_76993.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDN

SEQ ID NO: 182576 - protein, 85 aa, Triticum aestivum
  Clone ID: PAT_TA_76994.pep
SSLSGLLLDKSSKTDCKVFFSFRCANPTLTVRLSVCRNRNYLVTFFSLNFIGLIPLLGEISLQGARDGRLSVCVGRCRSVLCLVY

SEQ ID NO: 182577 - protein, 91 aa, Triticum aestivum
  Clone ID: PAT_TA_76995.pep
DRWQRRMIKNRESAARSRARKQACTNEMELELVQLRRENRMLIQREQDFINDRLAKAAQAPVPDCSSGTTSSTLQQKQQRQKQRCRSAPAP

SEQ ID NO: 182578 - protein, 116 aa, Triticum aestivum
  unsure (1)..(116): unsure at all Xaa locations
  Clone ID: PAT_TA_76996.pep
AASLPRTTGRRLPPARRRTPPPSCVPPKXPPPSPAPLDAAFRRPRHRTPPPSPTPLDAASLHSTAGCRRHHDPPPPPDALSPRPLPDVPPPCPSPAARSRASASSTADSTRGVGPT

SEQ ID NO: 182579 - protein, 97 aa, Triticum aestivum
  Clone ID: PAT_TA_76997.pep
VAAGVLRVVGSAPGPGSGDKAALTDRLVDKLFSDSGERLASSVAGSFARHLVMAFYSAPSPAGQTSSSPDWVNVVATGKGHKAISSWVEVLGGTAVG

SEQ ID NO: 182580 - protein, 177 aa, Triticum aestivum
  Clone ID: PAT_TA_76998.pep
YPAVEACRPDRRTLWHHADVVTTIKEWLNKPAKLGRLHTGASFLRGRDMLRRVSGKGTLVLSAYGGLFRRTFPSVTASTSRTDALRSMLWDCLIAGGGSFFADFRLRWKVGSPLASSFSTSDQFFLTLASDLATLLPESAQPFAVCCCCCSSLRALVALSGLFLVTLTLSLTVGFAL

SEQ ID NO: 182581 - protein, 81 aa, Triticum aestivum
  Clone ID: PAT_TA_76999.pep
LLHAAVQRPELVRRLHDERRPQPDGGREAAVRDAEAAERGEVPQEQVDGVLEQPRLGQPFHQQGGGPEEVEPEEHPREQVE

SEQ ID NO: 182582 - protein, 184 aa, Triticum aestivum
  Clone ID: PAT_TA_77000.pep
MFGFGHHGHHGQNPPAHAPAAAGGNQPTFKIFCKADEGYCLSVRDGNVVLAPSNPRDEHQHWFKDMRFSSQIKDEEGNPAFAIVNKATGLAVKHSLGQSHPVKLVPFNPEYLDESVMWTESSDVGKGFRCIRMVNNIRLNFDALNGDKDHGGVHDGTTVVLWEWAKGDNQSWKILPWGEEAYTG

SEQ ID NO: 182583 - protein, 128 aa, Triticum aestivum
  Clone ID: PAT_TA_77001.pep
PANESIQFVAGDMFEHIPSADVVLLKWILHCWQDEHCINILRRCKEAIPSRDAGGKVIIIDMVVGYAGAASAENVSMETQVLSDVYKMYMDGVEREEDEWAKIFSEAGFSDYKISPVLGFRSIIEVYP

SEQ ID NO: 182584 - protein, 135 aa, Triticum aestivum
  Clone ID: PAT_TA_77002.pep
QHEVAVVDVAVPHPRHLVRRPRGALLRGHSRFLPSSPFTNSARTHASFNVHELGLLGLISYAAASPRSHAMCGVRTRGAAVVKGSAWETERAAGRPACGAGDRSKERASKQASEEISWQVAVWLGLTRERSTGER

SEQ ID NO: 182585 - protein, 162 aa, Triticum aestivum
  Clone ID: PAT_TA_77003.pep
DVDIKVNHTLFLKVNHTLLVARTTFTHVVSPSFRRSSLDEVGNSRTDNRYLHRVGAVPRDRRRDTGLGKGVVALVRQRRGFPGLLLPGGVVAVVDVVLRFGEGEPHAVVQLLAPRQRRLRPGVRAVLGQQLLDVVDRVVGVDDAREGCHLGQAPGVRAGAVV

SEQ ID NO: 182586 - protein, 191 aa, Triticum aestivum
  Clone ID: PAT_TA_77004.pep
VETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIK

SEQ ID NO: 182587 - protein, 252 aa, Triticum aestivum
  Clone ID: PAT_TA_77005.pep
CASLRKMSASFTDISKVEDCFENLHQMKDNNIFKDLTEISKEGTTYATVRSIRDSFLKRIGNKHQIYSFCKELSTKLSNSLFNWEMICAILEVLFSCRNELTHYAESACDLLLLVAMAFPSLFRGSEEYLLKLFTEDSVLINEKSLKMLAYLAKSPCNLSINFSSDVYLLLEQKCIEGTRAESKYAISAIASLIQSPDDKKFAKLCKRVVGGLHDSHNIPTLLQSLGLILEDSPSMYTSYDDQFINFVQRVF

SEQ ID NO: 182588 - protein, 144 aa, Triticum aestivum
  unsure (1)..(144): unsure at all Xaa locations
  Clone ID: PAT_TA_77006.pep
EEAVAMESXTIRHMIEDDCADNGIPLPNVNSKILSKVIEYCNKHVQAKPADGAAAAAGASDAAAPTAPAEDLKNWDAEFVKVDQATLFDLILAANYLNIKGLLDLTCQTVADMIKGKTPEEIRKTFNIKNDFTPEEEEEIRREN

SEQ ID NO: 182589 - protein, 140 aa, Triticum aestivum
  Clone ID: PAT_TA_77007.pep
CLSAERENVGKLVGAGAAEAALSAISEEETAAAVLASLAKRGGAEAIVNIDGAVAKLVAEMRRGTEWSRECAAAALVLLCRRAGAAAAAQVLAISGVEWAIWELMGSGSERARRKAASLGRTCRRWAAANAAQNADCPAS

SEQ ID NO: 182590 - protein, 226 aa, Triticum aestivum
  Clone ID: PAT_TA_77008.pep
HDLTVCEQIDQTTICHASVSEKAIQAESRNHDSPSNSIADRKQIDAQDKIKAIELYAVDHHPGAVCSRSEPSSGTSLLKGSPSGPTPIFLELENKQLEKIQVKLETEHDMSVSNAKPESSRDNPEATQCGTEVSALSQDHIQSSQTQDLSVGAKPSSSEMAATQITTCSQFSPDNALTAQAPLQHHMDNSQTYQSINLFLAGQNMQQMQQQGPAYAISQNVHTSPH

SEQ ID NO: 182591 - protein, 122 aa, Triticum aestivum
  Clone ID: PAT_TA_77009.pep
LAEKDQLKWELRKGRAFEGWSEGVLEFAPTYKYEVGTGKYIGDDQKGGRRTPAWCDRVLSFGKGVRLLGYGRSELTLSDHKPVTATYAAEVEVFCGRKLQRALTLTDAEVDSGDVVVPDLEF

SEQ ID NO: 182592 - protein, 153 aa, Triticum aestivum; identical to SEQ ID NO: 135118
  Clone ID: PAT_TA_77010.pep

SEQ ID NO: 182593 - protein, 165 aa, Triticum aestivum
  Clone ID: PAT_TA_77011.pep
FCLAPALAAPLLTGAATPHYPSPIPGHGDFLRAHMRPAATLVNHRSPTPRASSVLSIYCPAPPLVCRPTAPRHVSARAAPGSALVVLLRLSNLDSDAAHGSASHSSSDPLFSYTIWFFLWQARADSLPAIVMTIHSTLTAHPDPPPRALACTGINVTTLRKSEDA

SEQ ID NO: 182594 - protein, 143 aa, Triticum aestivum
  Clone ID: PAT_TA_77012.pep
GTRRASARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLL

SEQ ID NO: 182595 - protein, 224 aa, Triticum aestivum
  Clone ID: PAT_TA_77013.pep
RRYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAG

SEQ ID NO: 182596 - protein, 236 aa, Triticum aestivum
  unsure (1)..(236): unsure at all Xaa locations
  Clone ID: PAT_TA_77014.pep
GTRRYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPXGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKP

SEQ ID NO: 182597 - protein, 223 aa, Triticum aestivum
  unsure (1)..(223): unsure at all Xaa locations
  Clone ID: PAT_TA_77015.pep
GTSLLFWNLNYWDKASTLAGEVDEPRKTFPKAVFGAVALVVGAYLIPLLAGTGALPSETAAEWTDGFFSEVGQRIGGPWLRVWIQAAAAMSNMGLFEAEMSSDSFQLLGMAEMGMIPAIFARRSRHGTPTYSILCSAXRGVVVLSFMSFQEIIELLNFLYGLGMLVVFAAFLKLRFKDPDLPRPYRIPLGSVGAAVMCVPPVLLIGTVMCLASATTIVVNIIV

SEQ ID NO: 182598 - protein, 207 aa, Triticum aestivum
  unsure (1)..(207): unsure at all Xaa locations
  Clone ID: PAT_TA_77016.pep
MAMSRRSASHLLSSFRPFSLLLQPLADAPSPAAAAAAASARRAMSSASALRARGDDKELARWRESMDRMRNIGISAHIDSGKTTLTERVLYYTGRIHEIHEVRGRDGVGAKMDSMDLEREKGITIQSAATYCTWNGYQINIIDTPGHVDFTVEVERALRVLDGAILVLCSXVGGVQSQSITVDRQMKRYEIPRVAFINKLDRMGADP

SEQ ID NO: 182599 - protein, 222 aa, Triticum aestivum
  Clone ID: PAT_TA_77017.pep
RHQPDAVLAFLAGLGLSAADVASVVAKDPLLLCAKVEKTLAPVVDGLTGLGLSRPEIAHLVSVAGEKFRCRAIIYRLHYYLALFGSSGKLLRVLDRSPYILSSNLERVVKPNAAFLRECRIGACDIAKLCVAQPRMLTSNVERVRAMAARAEGLGVPRGSRMFWRMLNALAFLREKDITAKVEYLKDTFRWSDAEVGIALCKAPMVLALSKDLLQRKSEFLI

SEQ ID NO: 182600 - protein, 66 aa, Triticum aestivum
  Clone ID: PAT_TA_77018.pep
LDGDPDSSLSNWTLVFPTHFGFIQAAFLSCSLLVQVTRHFMLISWKNIYLKVCIAGLNIHHPKAAL

SEQ ID NO: 182601 - protein, 229 aa, Triticum aestivum
  Clone ID: PAT_TA_77019.pep
FGTRRPRPRRLGRSGQGEQAGLRASDLRAHGGAKKDLELAPTWVVCRRRAPRRLLVGKLWPVGALLLQPKIRPKPVLVEALKFVQVSSKDYNFKTDQLKSIRQDMTIQNIEDELSVQVYEYHARLALCNRDMAELNLCLTKLHCLYGNKRNGGHHGEFAAYVILLSAIQDKNTELMSKLGRLSSDLKQQEAVKHAKEVAHSIQTGNYASFFRLYKVAPNLNGYLMCLCF

SEQ ID NO: 182602 - protein, 166 aa, Triticum aestivum
  unsure (1)..(166): unsure at all Xaa locations
  Clone ID: PAT_TA_77020.pep
SARGLANRQGFIRRLSIQHIDHELAHLLAQEDLSHVRSLTVTSSACTKHLPSLAKFEALRVVDFAGCEGLEEYDMKSIGKLFQLKYLNFPATRISKLPSEIVLLRDLETLHFGATPVEELPTGFAQLTKLQHLXFGGGWTIIPKKIGNMRNLREISGFSITKSPAD

SEQ ID NO: 182603 - protein, 142 aa, Triticum aestivum
  unsure (1)..(142): unsure at all Xaa locations
  Clone ID: PAT_TA_77021.pep
ACSGGLVRQKMKYLRFLRKXRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKRKEKAKISYDRRKQLAKLRVKAE

SEQ ID NO: 182604 - protein, 275 aa, Triticum aestivum
  unsure (1)..(275): unsure at all Xaa locations
  Clone ID: PAT_TA_77022.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESXLHLVLRLRGGMQIFVKTLTGKTITLEVESSXDTIDNVKAKIQDKEGIPPDQQRLIFAGKQLEDGRTLADYNXQKESXPFHLVLXLRGGXCRXFVKTXLXGKXITLEGGGPWTPLDNXKXAKXQDXEGIPPGPP

SEQ ID NO: 182605 - protein, 155 aa, Triticum aestivum; identical to SEQ ID NO: 116314
  Clone ID: PAT_TA_77023.pep

SEQ ID NO: 182606 - protein, 168 aa, Triticum aestivum; identical to SEQ ID NO: 124109
  Clone ID: PAT_TA_77024.pep

SEQ ID NO: 182607 - protein, 161 aa, Triticum aestivum; identical to SEQ ID NO: 129051
  Clone ID: PAT_TA_77025.pep

SEQ ID NO: 182608 - protein, 190 aa, Triticum aestivum
  unsure (1)..(190): unsure at all Xaa locations
  Clone ID: PAT_TA_77026.pep
KTLTGKTXTLEXEXXDTIDNVKXKIXDKEGIPPDQXXLIFAGKQLEDGXTLADYNXQKESTLHLXLRLRGGMQXIFVKTLXXKTITLEVESXDTIXDNXKAKIQDKEGIPPDQQRLXFXGKQLEDGXTLADYNIQKESTXHLVLRLXGGMQIFVKTLTXXTITLEVESSDTIDNVKAKIXDXGGYPPGPA

SEQ ID NO: 182609 - protein, 281 aa, Triticum aestivum
  unsure (1)..(281): unsure at all Xaa locations
  Clone ID: PAT_TA_77027.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGXPPDQQRLIFAGKQLEDGRTLADYNXQXKEXXLHLXLRLXXGMXIFXKTLXGKTITLXXXRSWEPXDNVKGXXXGQGGXPPGXXRAXFFRQQLX

SEQ ID NO: 182610 - protein, 153 aa, Triticum aestivum
  Clone ID: PAT_TA_77028.pep
MAPKADKKPAAESKVEKAAEKTPAGKKPKAEKRLPAGKTASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 182611 - protein, 121 aa, Triticum aestivum
  Clone ID: PAT_TA_77029.pep
FGTRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 182612 - protein, 103 aa, Triticum aestivum
  Clone ID: PAT_TA_77030.pep
FGTRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 182613 - protein, 90 aa, Triticum aestivum; identical to SEQ ID NO: 173870
  unsure (1)..(90): unsure at all Xaa locations
  Clone ID: PAT_TA_77031.pep

SEQ ID NO: 182614 - protein, 300 aa, Triticum aestivum
  unsure (1)..(300): unsure at all Xaa locations
  Clone ID: PAT_TA_77032.pep
MQIFVKTLTGKTITLEVESSDTINNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEVESSDTIDNVKAKIQDKEGIPPDQQRLIFAGKQLEDGRTLADYNXQKESTLHLVLRLRGGMQIXVKTLTGKTYLLXXESLGTIDNXKXKXQDKGGXPSDQQXLIXXXXQXXDGXTLADFXIQKXXXFXWGS

SEQ ID NO: 182615 - protein, 173 aa, Triticum aestivum
  Clone ID: PAT_TA_77033.pep
APAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 182616 - protein, 160 aa, Triticum aestivum
  unsure (1)..(160): unsure at all Xaa locations
  Clone ID: PAT_TA_77034.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGXLGSLLLERLSE

SEQ ID NO: 182617 - protein, 235 aa, Triticum aestivum
  unsure (1)..(235): unsure at all Xaa locations
  Clone ID: PAT_TA_77035.pep
VSDIPLSLPCLGKKKKKKRGLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTXRVVDSMTDNLRPTRAEATXDVANAVLDGSDA

SEQ ID NO: 182618 - protein, 207 aa, Triticum aestivum
  Clone ID: PAT_TA_77036.pep
PSLSRPPVSAHLLRLRRRRTHRGSSDSPDQERRAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATT

SEQ ID NO: 182619 - protein, 135 aa, Triticum aestivum; identical to SEQ ID NO: 129600
  Clone ID: PAT_TA_77037.pep

SEQ ID NO: 182620 - protein, 142 aa, Triticum aestivum; identical to SEQ ID NO: 130116
  Clone ID: PAT_TA_77038.pep

SEQ ID NO: 182621 - protein, 162 aa, Triticum aestivum
  Clone ID: PAT_TA_77039.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKL

SEQ ID NO: 182622 - protein, 78 aa, Triticum aestivum; identical to SEQ ID NO: 106980
  Clone ID: PAT_TA_77040.pep

SEQ ID NO: 182623 - protein, 159 aa, Triticum aestivum
  Clone ID: PAT_TA_77041.pep
MVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFKAGMAKSIHHARVLIRQRHIRVGRQIVNVPSFMVRVESEKHID

SEQ ID NO: 182624 - protein, 141 aa, Triticum aestivum
  Clone ID: PAT_TA_77042.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAV

SEQ ID NO: 182625 - protein, 161 aa, Triticum aestivum; identical to SEQ ID NO: 126315
  Clone ID: PAT_TA_77043.pep

SEQ ID NO: 182626 - protein, 109 aa, Triticum aestivum
  unsure (1)..(109): unsure at all Xaa locations
  Clone ID: PAT_TA_77044.pep
GIRTRAMSGRGKGGKGLGKGGAKRHRKVLRDNIQGITKPAIRRLARRGGVKRISGLIYEETRGVLKIFLENXXXDAVTYTEHARRKTVTAMDVVYALKRQGXTLYGFGG

SEQ ID NO: 182627 - protein, 205 aa, Triticum aestivum
  Clone ID: PAT_TA_77045.pep
CRFTRPIPNRGTRREEGKGREEETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATS

SEQ ID NO: 182628 - protein, 58 aa, Triticum aestivum
  Clone ID: PAT_TA_77046.pep
RGSRKRIESARARARTMAALRLALRRFCDRALGRSAGIYELKAAKEFPDIDPGHLKAA

SEQ ID NO: 182629 - protein, 162 aa, Triticum aestivum
  Clone ID: PAT_TA_77047.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLKG

SEQ ID NO: 182630 - protein, 155 aa, Triticum aestivum; identical to SEQ ID NO: 123772
  Clone ID: PAT_TA_77048.pep

SEQ ID NO: 182631 - protein, 110 aa, Triticum aestivum
  unsure (1)..(110): unsure at all Xaa locations
  Clone ID: PAT_TA_77049.pep
MVKFLKPGKAVILLQGRXAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVG

SEQ ID NO: 182632 - protein, 129 aa, Triticum aestivum
  Clone ID: PAT_TA_77050.pep
MGISRDSMHKRRATGGKQKAWRKKRKYELGRQPANTKLSSNKTVRRVRVRGCNVKWRALRLDTGNFSWGSEAVTRKTRLLDVVYNSSNNELVRTQTLVKNAIVQVDAAPFKQWYLTHYGVEIGRKKKAA

SEQ ID NO: 182633 - protein, 49 aa, Triticum aestivum
  unsure (1)..(49): unsure at all Xaa locations
  Clone ID: PAT_TA_77051.pep
AQIVYATIAGDIVMAAAYSHELXRYXLEVGXTNYAAXXCTXXLXSRRVL

SEQ ID NO: 182634 - protein, 167 aa, Triticum aestivum
  unsure (1)..(167): unsure at all Xaa locations
  Clone ID: PAT_TA_77052.pep
GLRXSALXITFSEASIFADPHGRGLRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPAKPGQKWHIYYATEQPAATP

SEQ ID NO: 182635 - protein, 96 aa, Triticum aestivum; identical to SEQ ID NO: 117442
  unsure (1)..(96): unsure at all Xaa locations
  Clone ID: PAT_TA_77053.pep

SEQ ID NO: 182636 - protein, 161 aa, Triticum aestivum; identical to SEQ ID NO: 129051
  Clone ID: PAT_TA_77054.pep

SEQ ID NO: 182637 - protein, 175 aa, Triticum aestivum
  Clone ID: PAT_TA_77055.pep
ALLHRRSLVKYSTDPANPTKSAKAMGRDLRVHFKNTRETAFALRKMSLNKAKRYLEDVLAHKQAIPFRRYCRGVGRTAQVKNRQPNGQGRWPAKSAKFVLDLLKNAESNAEVKGLDVDALYISHIQVNQAQKQRRRTYRAHGRINPYMSNPCHIELILSEKEEPVKKEAESQIAR

SEQ ID NO: 182638 - protein, 96 aa, Triticum aestivum; identical to SEQ ID NO: 117442
  unsure (1)..(96): unsure at all Xaa locations
  Clone ID: PAT_TA_77056.pep

SEQ ID NO: 182639 - protein, 145 aa, Triticum aestivum
  Clone ID: PAT_TA_77057.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSD

SEQ ID NO: 182640 - protein, 147 aa, Triticum aestivum; identical to SEQ ID NO: 134856
  Clone ID: PAT_TA_77058.pep

SEQ ID NO: 182641 - protein, 84 aa, Triticum aestivum
  unsure (1)..(84): unsure at all Xaa locations
  Clone ID: PAT_TA_77059.pep
GTRLALQWILVKXLDCTHSNYQTLMRPXIVIYCHYLPVSGLGNLRACCLXLDVVAVSQAPSPESNPNSPSPVTTMVGPYPTIES

SEQ ID NO: 182642 - protein, 96 aa, Triticum aestivum; identical to SEQ ID NO: 117442
  unsure (1)..(96): unsure at all Xaa locations
  Clone ID: PAT_TA_77060.pep

SEQ ID NO: 182643 - protein, 157 aa, Triticum aestivum
  Clone ID: PAT_TA_77061.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTN

SEQ ID NO: 182644 - protein, 101 aa, Triticum aestivum
  unsure (1)..(101): unsure at all Xaa locations
  Clone ID: PAT_TA_77062.pep
IINTFYSNKEIFLRELIXNSSDALDKIRFESLTDKSKLDAQPELXIHIIPDKATNTLTIVDSGIGMTKSDLVNNXGTIARSGTKEFMEALAXGADVSMIGQ

SEQ ID NO: 182645 - protein, 168 aa, Triticum aestivum; identical to SEQ ID NO: 124110
  Clone ID: PAT_TA_77063.pep

SEQ ID NO: 182646 - protein, 60 aa, Triticum aestivum
  Clone ID: PAT_TA_77064.pep
MAGYMSSKKTMEDPNTFGTRIHRMLKLGLSIDEDDEAPENDTDMPPLEDDAGESKMEEVD

SEQ ID NO: 182647 - protein, 167 aa, Triticum aestivum
  Clone ID: PAT_TA_77065.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKRKE

SEQ ID NO: 182648 - protein, 202 aa, Triticum aestivum
  Clone ID: PAT_TA_77066.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAQGPRDHAPAPAAAAPAQAAA

SEQ ID NO: 182649 - protein, 147 aa, Triticum aestivum
  Clone ID: PAT_TA_77067.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTI

SEQ ID NO: 182650 - protein, 193 aa, Triticum aestivum
  Clone ID: PAT_TA_77068.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPA

SEQ ID NO: 182651 - protein, 267 aa, Triticum aestivum
  unsure (1)..(267): unsure at all Xaa locations
  Clone ID: PAT_TA_77069.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNXQKESTLHLVLRLRGGMXIFVKTXTGKNITLEVESSDPIDNXKAKXQDKGGIPXD

SEQ ID NO: 182652 - protein, 180 aa, Triticum aestivum
  Clone ID: PAT_TA_77070.pep
ADPEPGGTRREEGKGREEETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITD

SEQ ID NO: 182653 - protein, 88 aa, Triticum aestivum
  unsure (1)..(88): unsure at all Xaa locations
  Clone ID: PAT_TA_77071.pep
TAAAGTRLALQWILVKXLDCTHSNYQTLMRPXIVIYCHYLPVSGLGNLRACCLXLXVVAVSQAPSPESNPNSPSPVTTMVGPXPTIXS

SEQ ID NO: 182654 - protein, 168 aa, Triticum aestivum
  Clone ID: PAT_TA_77072.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 182655 - protein, 136 aa, Triticum aestivum
  unsure (1)..(136): unsure at all Xaa locations
  Clone ID: PAT_TA_77073.pep
MSIFEYNGSAVVAMVGKNCFAIAXQLYQRLVFKHKLYQLREERDMKPETFASLVSALLYEKRFGPYFCQPIIAGLGEKDQPFICTMDCIGAKELAKDFVVSGTASESLYGAXESMYKPDMEPEELFETIXQALLSS

SEQ ID NO: 182656 - protein, 186 aa, Triticum aestivum
  Clone ID: PAT_TA_77074.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTAT

SEQ ID NO: 182657 - protein, 170 aa, Triticum aestivum
  unsure (1)..(170): unsure at all Xaa locations
  Clone ID: PAT_TA_77075.pep
SPIDCQSPLPAGSSPPPQVCXIFVKTLTGKTITLEVESSDTIDNVKAKIQDKEGIPPDQQRLIFAGKQLEDGRTLADYNIQKESTLHLVLXLRGGMXIFXKTXTGKTITXLXVESSXDTIDNVKAKXHDKEGIXPXDXXXLXFAWXSXLEDXXTXCLTTXCXXXXTXHPC

SEQ ID NO: 182658 - protein, 96 aa, Triticum aestivum; identical to SEQ ID NO: 117442
  unsure (1)..(96): unsure at all Xaa locations
  Clone ID: PAT_TA_77076.pep

SEQ ID NO: 182659 - protein, 196 aa, Triticum aestivum
  unsure (1)..(196): unsure at all Xaa locations
  Clone ID: PAT_TA_77077.pep
EEPGARGKGREEEITEPSARTGQQAPRSRTGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAXEITDKLGLHSLRQRHWYIQSTCATS

SEQ ID NO: 182660 - protein, 164 aa, Triticum aestivum; identical to SEQ ID NO: 123778
  Clone ID: PAT_TA_77078.pep

SEQ ID NO: 182661 - protein, 178 aa, Triticum aestivum
  Clone ID: PAT_TA_77079.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKRKEKAKISYDRRKQ

SEQ ID NO: 182662 - protein, 170 aa, Triticum aestivum
  Clone ID: PAT_TA_77080.pep
FGRLSRPPVSAHLLRLRRRRTNRGSSDSSDQERRAGRKSTYAGGDEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVF

SEQ ID NO: 182663 - protein, 136 aa, Triticum aestivum; identical to SEQ ID NO: 165744
  Clone ID: PAT_TA_77081.pep

SEQ ID NO: 182664 - protein, 183 aa, Triticum aestivum
  Clone ID: PAT_TA_77082.pep
RHEEEPGARGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHS

SEQ ID NO: 182665 - protein, 125 aa, Triticum aestivum
  Clone ID: PAT_TA_77083.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKL

SEQ ID NO: 182666 - protein, 113 aa, Triticum aestivum; identical to SEQ ID NO: 129529
  Clone ID: PAT_TA_77084.pep

SEQ ID NO: 182667 - protein, 51 aa, Triticum aestivum; identical to SEQ ID NO: 133538
  Clone ID: PAT_TA_77085.pep

SEQ ID NO: 182668 - protein, 161 aa, Triticum aestivum; identical to SEQ ID NO: 109588
  Clone ID: PAT_TA_77086.pep

SEQ ID NO: 182669 - protein, 184 aa, Triticum aestivum
  Clone ID: PAT_TA_77087.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRL

SEQ ID NO: 182670 - protein, 155 aa, Triticum aestivum; identical to SEQ ID NO: 123772
  Clone ID: PAT_TA_77088.pep

SEQ ID NO: 182671 - protein, 144 aa, Triticum aestivum
  Clone ID: PAT_TA_77089.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGGHELSKSTGNAGARVA

SEQ ID NO: 182672 - protein, 165 aa, Triticum aestivum
  Clone ID: PAT_TA_77090.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKS

SEQ ID NO: 182673 - protein, 215 aa, Triticum aestivum
  unsure (1)..(215): unsure at all Xaa locations
  Clone ID: PAT_TA_77091.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELXEFYMRK

SEQ ID NO: 182674 - protein, 161 aa, Triticum aestivum; identical to SEQ ID NO: 126315
  Clone ID: PAT_TA_77092.pep

SEQ ID NO: 182675 - protein, 96 aa, Triticum aestivum; identical to SEQ ID NO: 117442
  unsure (1)..(96): unsure at all Xaa locations
  Clone ID: PAT_TA_77093.pep

SEQ ID NO: 182676 - protein, 77 aa, Triticum aestivum; identical to SEQ ID NO: 127431
  Clone ID: PAT_TA_77094.pep

SEQ ID NO: 182677 - protein, 101 aa, Triticum aestivum
  unsure (1)..(101): unsure at all Xaa locations
  Clone ID: PAT_TA_77095.pep
CWELYCLXHGIXPDGQMPXDKTXGGGDDAFNTFFXETGAGKHVPXAVFXDLEPTVIDEXRTGAYXQLFHPEQLISGKEDAANNXARGHYTIXGKEIXDLXL

SEQ ID NO: 182678 - protein, 209 aa, Triticum aestivum; identical to SEQ ID NO: 179608
  Clone ID: PAT_TA_77096.pep

SEQ ID NO: 182679 - protein, 141 aa, Triticum aestivum
  unsure (1)..(141): unsure at all Xaa locations
  Clone ID: PAT_TA_77097.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVXPDALKVLRLQPGHRYC

SEQ ID NO: 182680 - protein, 114 aa, Triticum aestivum
  Clone ID: PAT_TA_77098.pep
RLIFAGKQLEDGRTLADYNIQKESTLHLVLRLRGGAKKRKKKTYTKPKKQKHKHKKVKLAVLQFYKVDDATGKVTRLRKECPNADCGAGTFMANHFDRHYCGKCGLTYVYNQKA

SEQ ID NO: 182681 - protein, 158 aa, Triticum aestivum
  Clone ID: PAT_TA_77099.pep
MVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFKAGMAKSIHHARVLIRQRHIRVGRQIVNVPSFMVRVESEKHI

SEQ ID NO: 182682 - protein, 95 aa, Triticum aestivum
  Clone ID: PAT_TA_77100.pep
MAPTKGEGPAIGIDLGTTYSCVGVWQHDRVEIIANDQGNRTTPSYVAFTDSERLIGDAAKNQVAMNPINTVFDAKRLIGRRFADAPVQSDIKMWP

SEQ ID NO: 182683 - protein, 161 aa, Triticum aestivum
  Clone ID: PAT_TA_77101.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLK

SEQ ID NO: 182684 - protein, 86 aa, Triticum aestivum
  unsure (1)..(86): unsure at all Xaa locations
  Clone ID: PAT_TA_77102.pep
AAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 182685 - protein, 147 aa, Triticum aestivum
  Clone ID: PAT_TA_77103.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVCCC

SEQ ID NO: 182686 - protein, 96 aa, Triticum aestivum; identical to SEQ ID NO: 117442
  unsure (1)..(96): unsure at all Xaa locations
  Clone ID: PAT_TA_77104.pep

SEQ ID NO: 182687 - protein, 172 aa, Triticum aestivum
  Clone ID: PAT_TA_77105.pep
GCGRRWRSAPGGPVLRPHSPLTNVIQSTFSANIGSRWGSLARTFSAKPLGNEVIGIDLGTTNSCVSVMEGKNAKVIENSEGTRTTPSVVAFSQKGERLVGTPAKRQAITNPQNTFFGTKRMIGRRFDDPQTQKEMKMVPYKIVKAPNGDAWVETTDGKQYSPSQIGAFVLTK

SEQ ID NO: 182688 - protein, 41 aa, Triticum aestivum
  unsure (1)..(41): unsure at all Xaa locations
  Clone ID: PAT_TA_77106.pep
KPSPPWTSSTPSSARDAPSTXSGARLRRGESSSHHLIRCSD

SEQ ID NO: 182689 - protein, 191 aa, Triticum aestivum
  Clone ID: PAT_TA_77107.pep
PYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182690 - protein, 153 aa, Triticum aestivum
  Clone ID: PAT_TA_77108.pep
DVHDWARQEEGLCVLQDFSYASYEVMGMDASALAYGDIVKRVLRCFGPSEFSVAVTIFGGRGHAATWGKKLDAEAYDCNNVVEQELPCGGVLIYQSFAANEEVAVSAGSPRSVFHCFEAETVESHPLVKEGKLANLLAWRAEDSLEEGVVLCE

SEQ ID NO: 182691 - protein, 64 aa, Triticum aestivum
  Clone ID: PAT_TA_77109.pep
FSRIDHKFDLMYAKRAFVHWYVGEGMEEGEFSEAREDLAALEKDYEEVGAEFDEGEDGDEGDEY

SEQ ID NO: 182692 - protein, 117 aa, Triticum aestivum
  Clone ID: PAT_TA_77110.pep
EGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 182693 - protein, 70 aa, Triticum aestivum
  unsure (1)..(70): unsure at all Xaa locations
  Clone ID: PAT_TA_77111.pep
GXGTACKXGNGCGGCNMYXEVEAAGATLLVSATXTHKXSSGGMEMAAENGGCGCTQCKCGTSCGCSCCSC

SEQ ID NO: 182694 - protein, 135 aa, Triticum aestivum
  Clone ID: PAT_TA_77112.pep
HWVVQGAVDVDIGANPSAEGGGDDEGVDDQAVKVVDIVDTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 182695 - protein, 146 aa, Triticum aestivum
  unsure (1)..(146): unsure at all Xaa locations
  Clone ID: PAT_TA_77113.pep
LXNGVLWXVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 182696 - protein, 115 aa, Triticum aestivum
  Clone ID: PAT_TA_77114.pep
LQQIRGQLTIFYGGSVCVYDSVPPEKAQAIMLIAAAAAAASKSNGTTAVKPPAMSATNAIQAMLTRSLSLQSTSVANGQPQAVADPGSICKLQADLPIARRHSLQRFLEKRRDSI

SEQ ID NO: 182697 - protein, 92 aa, Triticum aestivum
  unsure (1)..(92): unsure at all Xaa locations
  Clone ID: PAT_TA_77115.pep
XKXGAKRHRKVLRXNIQGITKPXIRRLARRGGVKRISGLIYEETRGVLKIFLENVIRDAVTYTEHARRKTVTAMDVVYALKRQGRTLYGFGG

SEQ ID NO: 182698 - protein, 138 aa, Triticum aestivum
  unsure (1)..(138): unsure at all Xaa locations
  Clone ID: PAT_TA_77116.pep
DGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTXXLYFAHGLKEVKC

SEQ ID NO: 182699 - protein, 111 aa, Triticum aestivum
  unsure (1)..(111): unsure at all Xaa locations
  Clone ID: PAT_TA_77117.pep
LXPLSTXALLKQVDYXIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182700 - protein, 154 aa, Triticum aestivum
  Clone ID: PAT_TA_77118.pep
PSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182701 - protein, 168 aa, Triticum aestivum
  unsure (1)..(168): unsure at all Xaa locations
  Clone ID: PAT_TA_77119.pep
MLVYQDKLSGDELLSXSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 182702 - protein, 52 aa, Triticum aestivum
  Clone ID: PAT_TA_77120.pep
SAQSKPSLARYNKKPTITSREIQTSVRLVLPGELAKHAVSEGTKAVTKFTSS

SEQ ID NO: 182703 - protein, 174 aa, Triticum aestivum
  unsure (1)..(174): unsure at all Xaa locations
  Clone ID: PAT_TA_77121.pep
EKAYHEXQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182704 - protein, 173 aa, Triticum aestivum
  unsure (1)..(173): unsure at all Xaa locations
  Clone ID: PAT_TA_77122.pep
EKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEX

SEQ ID NO: 182705 - protein, 112 aa, Triticum aestivum
  unsure (1)..(112): unsure at all Xaa locations
  Clone ID: PAT_TA_77123.pep
LPPLSTEALLKQVDYLIRSXKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182706 - protein, 96 aa, Triticum aestivum; identical to SEQ ID NO: 117442
  unsure (1)..(96): unsure at all Xaa locations
  Clone ID: PAT_TA_77124.pep

SEQ ID NO: 182707 - protein, 73 aa, Triticum aestivum
  Clone ID: PAT_TA_77125.pep
KKSNNVQRKLEKRQQGRTLDSHIEEQFSGGRLLACISSRPGQCGRADGYILEGKELEFYMRKLQKKKGKGATA

SEQ ID NO: 182708 - protein, 157 aa, Triticum aestivum
  Clone ID: PAT_TA_77126.pep
GSSPPGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182709 - protein, 50 aa, Triticum aestivum
  unsure (1)..(50): unsure at all Xaa locations
  Clone ID: PAT_TA_77127.pep
RIIXAKDHASVQINIGHVDENGLYDGXFTTFALSGFVRAQGDADGSLDRL

SEQ ID NO: 182710 - protein, 49 aa, Triticum aestivum
  unsure (1)..(49): unsure at all Xaa locations
  Clone ID: PAT_TA_77128.pep
TIRELEEKRKEKXKISYDRXKXLXKLRVKXEKAAEEKLGTQLEILAPIX

SEQ ID NO: 182711 - protein, 136 aa, Triticum aestivum
  Clone ID: PAT_TA_77129.pep
GHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 182712 - protein, 138 aa, Triticum aestivum
  unsure (1)..(138): unsure at all Xaa locations
  Clone ID: PAT_TA_77130.pep
SVSNGXRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182713 - protein, 66 aa, Triticum aestivum
  Clone ID: PAT_TA_77131.pep
LKGILGYVDEDLVSTDFQGDNRSSIFDAKAGIALNDNFVKLVSWYDNEWGYSTRVVDLIRHMHSTK

SEQ ID NO: 182714 - protein, 90 aa, Triticum aestivum
  Clone ID: PAT_TA_77132.pep
AAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 182715 - protein, 128 aa, Triticum aestivum
  unsure (1)..(128): unsure at all Xaa locations
  Clone ID: PAT_TA_77133.pep
WHXHCXRKRRSRTCLLMRTHHSERLYWKSLSCIYGFSLADTHPNQNQNANKNLQMNGYCFFFFFFFLACTRPAGLTIAGVAWRVVDSSSHTGAARHGEENVHAPTRVAEARQFAGDLGVVAAGWMDPR

SEQ ID NO: 182716 - protein, 130 aa, Triticum aestivum
  unsure (1)..(130): unsure at all Xaa locations
  Clone ID: PAT_TA_77134.pep
DVVPKDVNAAVATIKTKRTIQXVXWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182717 - protein, 152 aa, Triticum aestivum; identical to SEQ ID NO: 122933
  Clone ID: PAT_TA_77135.pep

SEQ ID NO: 182718 - protein, 106 aa, Triticum aestivum
  Clone ID: PAT_TA_77136.pep
RKGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 182719 - protein, 140 aa, Triticum aestivum; identical to SEQ ID NO: 136440
  Clone ID: PAT_TA_77137.pep

SEQ ID NO: 182720 - protein, 88 aa, Triticum aestivum
  Clone ID: PAT_TA_77138.pep
MGLKEEFEEHAEKAKTLPDTTTNESKLCLYGLYKQATVGPVNTARPGGLFDMAGKAKWDAWKAVEAKSKEEAMADYITKVKQLLEEAA

SEQ ID NO: 182721 - protein, 102 aa, Triticum aestivum
  Clone ID: PAT_TA_77139.pep
MGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKM

SEQ ID NO: 182722 - protein, 94 aa, Triticum aestivum
  Clone ID: PAT_TA_77140.pep
IFSIQVGKAAGERWKSLSESEKAPYVAKANKLKGEYNKAIAAYNKGESAAAAAPKKAAAKEVEEDDEEESDKSKSEINDDDDDEGSDEDEDDDE

SEQ ID NO: 182723 - protein, 92 aa, Triticum aestivum
  Clone ID: PAT_TA_77141.pep
MGISRDSMHKRRATGGKQKAWRKKRKYELGRQPANTKLSSNKTVRRVRVRGGNVKWRALRLDTGNFSWGSEAVTRKTRLLDVVYNSSNNELV

SEQ ID NO: 182724 - protein, 43 aa, Triticum aestivum
  Clone ID: PAT_TA_77142.pep
MVRVSVLNDALKSMYNAEKRGKRQVMIRPSSKVIIKFLIVMQK

SEQ ID NO: 182725 - protein, 127 aa, Triticum aestivum
  Clone ID: PAT_TA_77143.pep
MATETETFAFQAEINQLLSLIINTFYSNKEIFLRELISNSSDALDKIRFESLTDKSKLDAQPELFIHIIPDKATNTLTIVDSGIGMTKSDLVNNLGTIARSGTKEFMEALAAGADVSMIGQFGVGFY

SEQ ID NO: 182726 - protein, 200 aa, Triticum aestivum
  Clone ID: PAT_TA_77144.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEKA

SEQ ID NO: 182727 - protein, 194 aa, Triticum aestivum
  Clone ID: PAT_TA_77145.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIG

SEQ ID NO: 182728 - protein, 152 aa, Triticum aestivum
  Clone ID: PAT_TA_77146.pep
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVI

SEQ ID NO: 182729 - protein, 157 aa, Triticum aestivum
  Clone ID: PAT_TA_77147.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERL

SEQ ID NO: 182730 - protein, 198 aa, Triticum aestivum
  unsure (1)..(198): unsure at all Xaa locations
  Clone ID: PAT_TA_77148.pep
ERLIGDAAKXPVAMNPINTVFDAKRLIGRRFADAPVQSDIKMWPYKVIPGPADKPMIVVQYKGEDKQFSAEEISSMVLIKMREIAEAYLGVTIKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFV

SEQ ID NO: 182731 - protein, 194 aa, Triticum aestivum
  Clone ID: PAT_TA_77149.pep
CSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLPGGERVPFLFTVKQLVATGKPESFSGPFLVPSYRGSSFL

SEQ ID NO: 182732 - protein, 197 aa, Triticum aestivum
  Clone ID: PAT_TA_77150.pep
PPTGEPGARGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCAT

SEQ ID NO: 182733 - protein, 160 aa, Triticum aestivum
  Clone ID: PAT_TA_77151.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDL

SEQ ID NO: 182734 - protein, 167 aa, Triticum aestivum
  Clone ID: PAT_TA_77152.pep
NDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRG

SEQ ID NO: 182735 - protein, 214 aa, Triticum aestivum; identical to SEQ ID NO: 158836
  Clone ID: PAT_TA_77153.pep

SEQ ID NO: 182736 - protein, 134 aa, Triticum aestivum
  Clone ID: PAT_TA_77154.pep
MAEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEPGTIRGDFAVDIGRNVIHGSDSVESARKEIALWFPE

SEQ ID NO: 182737 - protein, 54 aa, Triticum aestivum
  Clone ID: PAT_TA_77155.pep
ECRQKYSRNQPSKLTTKFTTPRWHIYHLLDMKQQNSNFYPLLSSSNLLCSRNHL

SEQ ID NO: 182738 - protein, 174 aa, Triticum aestivum
  Clone ID: PAT_TA_77156.pep
RRRRTHRGSSDSSDQERPAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLG

SEQ ID NO: 182739 - protein, 164 aa, Triticum aestivum
  Clone ID: PAT_TA_77157.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDL

SEQ ID NO: 182740 - protein, 130 aa, Triticum aestivum; identical to SEQ ID NO: 108435
  Clone ID: PAT_TA_77158.pep

SEQ ID NO: 182741 - protein, 196 aa, Triticum aestivum
  unsure (1)..(196): unsure at all Xaa locations
  Clone ID: PAT_TA_77159.pep
MVSLNLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAXGPRDHAPAPAAAA

SEQ ID NO: 182742 - protein, 96 aa, Triticum aestivum; identical to SEQ ID NO: 117442
  unsure (1)..(96): unsure at all Xaa locations
  Clone ID: PAT_TA_77160.pep

SEQ ID NO: 182743 - protein, 227 aa, Triticum aestivum
  unsure (1)..(227): unsure at all Xaa locations
  Clone ID: PAT_TA_77161.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXEXTLHLVXRXRX

SEQ ID NO: 182744 - protein, 64 aa, Triticum aestivum
  unsure (1)..(64): unsure at all Xaa locations
  Clone ID: PAT_TA_77162.pep
MSTAEATREENVYMAKLAEQAERYEEMVEFMEKVAKTADVGELTXEERNLLSVAYKXAIGAXRA

SEQ ID NO: 182745 - protein, 60 aa, Triticum aestivum
  unsure (1)..(60): unsure at all Xaa locations
  Clone ID: PAT_TA_77163.pep
SPATAAATSPPPTTPSAMAVAEPVPGGDVKLFNRWTFEDVQXTDISLNDYLAETSMKHYT

SEQ ID NO: 182746 - protein, 194 aa, Triticum aestivum
  Clone ID: PAT_TA_77164.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAA

SEQ ID NO: 182747 - protein, 103 aa, Triticum aestivum
  Clone ID: PAT_TA_77165.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIER

SEQ ID NO: 182748 - protein, 129 aa, Triticum aestivum
  Clone ID: PAT_TA_77166.pep
MAVTFSDLHTADGLKALEAHLAGKTYISGDGITKDDVKVFAAVPVKPSAEFPNAARWYDTVAAAVASRFPGQSSGVSASSAPAAAAPAASKDEDDDDDMDLFGDETEEDKKAAAEREAAKPAKKKESGK

SEQ ID NO: 182749 - protein, 97 aa, Triticum aestivum
  Clone ID: PAT_TA_77167.pep
RHEEIASLEKFLQERIKVAGGKAGNLGDSVTVTRDKSKVTVTSDGAFSKRYLKYLTKKYLKKHNVRDWLRVIAANKERNVYELRYFNIAENEGEEED

SEQ ID NO: 182750 - protein, 175 aa, Triticum aestivum
  unsure (1)..(175): unsure at all Xaa locations
  Clone ID: PAT_TA_77168.pep
ARGRPPVSAHLLRLRRRRTNRGSSDSSDQERRAGRKSTYAGGDEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLX

SEQ ID NO: 182751 - protein, 103 aa, Triticum aestivum
  unsure (1)..(103): unsure at all Xaa locations
  Clone ID: PAT_TA_77169.pep
VRDAARAGKGLGKGGAKRHRKVLRDNIQGITKPAIRRLARRGGVKRISGLIYEETRGVLKIFLENVIRDAVTYTEHARRKTVTAMDVVYALKRQGXTLYGFGG

SEQ ID NO: 182752 - protein, 36 aa, Triticum aestivum
  unsure (1)..(36): unsure at all Xaa locations
  Clone ID: PAT_TA_77170.pep
MKRNPRVTSSRRKCXKAHFTAPXSVRRVXMSAALSS

SEQ ID NO: 182753 - protein, 161 aa, Triticum aestivum
  Clone ID: PAT_TA_77171.pep
MSSEAAKVVVPESVLLKRKREELWAAEKKSSENVKVIYARAKQYAEEYDAQDKELVQLKREARMKGGFYVSPEAKLLFVVRIRGINAMHPKTKKILQLLRLRQIFNGVFLKVNKATINMLRRVEPYVAYGYPNLKSVRELIYKRGYGKLNKQRIPLTNNKV

SEQ ID NO: 182754 - protein, 213 aa, Triticum aestivum
  Clone ID: PAT_TA_77172.pep
GISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATEEAKKSNNVQRKLEKRQQGRTLDSHIEEQFSGGRLLACISSRPGQCGRADGYILEGKELEFYMRK

SEQ ID NO: 182755 - protein, 197 aa, Triticum aestivum
  Clone ID: PAT_TA_77173.pep
IGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLD

SEQ ID NO: 182756 - protein, 161 aa, Triticum aestivum; identical to SEQ ID NO: 129051
  Clone ID: PAT_TA_77174.pep

SEQ ID NO: 182757 - protein, 168 aa, Triticum aestivum; identical to SEQ ID NO: 124110
  Clone ID: PAT_TA_77175.pep

SEQ ID NO: 182758 - protein, 170 aa, Triticum aestivum
  Clone ID: PAT_TA_77176.pep
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKR

SEQ ID NO: 182759 - protein, 56 aa, Triticum aestivum
  unsure (1)..(56): unsure at all Xaa locations
  Clone ID: PAT_TA_77177.pep
MGKVHXIARXRPGKVRGQTPKVAKQDKKKQPRGRAHKRIQYNRRFVTAVVGFGKKR

SEQ ID NO: 182760 - protein, 161 aa, Triticum aestivum; identical to SEQ ID NO: 129051
  Clone ID: PAT_TA_77178.pep

SEQ ID NO: 182761 - protein, 161 aa, Triticum aestivum; identical to SEQ ID NO: 129051
  Clone ID: PAT_TA_77179.pep

SEQ ID NO: 182762 - protein, 214 aa, Triticum aestivum
  unsure (1)..(214): unsure at all Xaa locations
  Clone ID: PAT_TA_77180.pep
FGTRQQRWRARXEDVRLGANKYSERQPIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAXGVVKGFQQGLYMGNGGGANVVAPGYTKGSGLGAEIIGTFVLVYTVFSATDAKRNARD

SEQ ID NO: 182763 - protein, 168 aa, Triticum aestivum
  Clone ID: PAT_TA_77181.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLG

SEQ ID NO: 182764 - protein, 140 aa, Triticum aestivum
  unsure (1)..(140): unsure at all Xaa locations
  Clone ID: PAT_TA_77182.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSXPYKGIGDCFXRTXXDEXX

SEQ ID NO: 182765 - protein, 150 aa, Triticum aestivum
  Clone ID: PAT_TA_77183.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGGHELSKSTGNAGARVACGIIGL

SEQ ID NO: 182766 - protein, 175 aa, Triticum aestivum
  Clone ID: PAT_TA_77184.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSP

SEQ ID NO: 182767 - protein, 161 aa, Triticum aestivum; identical to SEQ ID NO: 182683
  Clone ID: PAT_TA_77185.pep

SEQ ID NO: 182768 - protein, 123 aa, Triticum aestivum
  Clone ID: PAT_TA_77186.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAES

SEQ ID NO: 182769 - protein, 111 aa, Triticum aestivum
  Clone ID: PAT_TA_77187.pep
MKLIAAYLLAYLGGNSSPSAADVKNILDSVGAEADEEKLEFLLAELKGKDITEVIASGREKFAAVPSGGGAIAVGAPAAASGGAAAPAAESKEEKVEEKEESDEDMGFSLF

SEQ ID NO: 182770 - protein, 164 aa, Triticum aestivum
  Clone ID: PAT_TA_77188.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQI

SEQ ID NO: 182771 - protein, 96 aa, Triticum aestivum; identical to SEQ ID NO: 117442
  unsure (1)..(96): unsure at all Xaa locations
  Clone ID: PAT_TA_77189.pep

SEQ ID NO: 182772 - protein, 162 aa, Triticum aestivum; identical to SEQ ID NO: 182621
  Clone ID: PAT_TA_77190.pep

SEQ ID NO: 182773 - protein, 157 aa, Triticum aestivum; identical to SEQ ID NO: 182643
  Clone ID: PAT_TA_77191.pep

SEQ ID NO: 182774 - protein, 111 aa, Triticum aestivum
  unsure (1)..(111): unsure at all Xaa locations
  Clone ID: PAT_TA_77192.pep
SDTIDNVKAKIQDKEGIPPDQQRLIFAGKQLEDGRTLADYNIQKESTLHLVLRLRXGIIXEPSLQALARKYNQEKMICRKCYARLHPRAVNCRKKKCGHSNQLRPKKKIXN

SEQ ID NO: 182775 - protein, 158 aa, Triticum aestivum
  Clone ID: PAT_TA_77193.pep
MAPKRGGKAPVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIE

SEQ ID NO: 182776 - protein, 204 aa, Triticum aestivum; identical to SEQ ID NO: 181581
  Clone ID: PAT_TA_77194.pep

SEQ ID NO: 182777 - protein, 161 aa, Triticum aestivum; identical to SEQ ID NO: 182683
  Clone ID: PAT_TA_77195.pep

SEQ ID NO: 182778 - protein, 96 aa, Triticum aestivum; identical to SEQ ID NO: 117442
  unsure (1)..(96): unsure at all Xaa locations
  Clone ID: PAT_TA_77196.pep

SEQ ID NO: 182779 - protein, 175 aa, Triticum aestivum; identical to SEQ ID NO: 182766
  Clone ID: PAT_TA_77197.pep

SEQ ID NO: 182780 - protein, 150 aa, Triticum aestivum
  Clone ID: PAT_TA_77198.pep
KTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 182781 - protein, 45 aa, Triticum aestivum
  unsure (1)..(45): unsure at all Xaa locations
  Clone ID: PAT_TA_77199.pep
YKQXXIKLKSTMSQNMHHCIVYDTDATDQKYNKTSSPGDMIGTQD

SEQ ID NO: 182782 - protein, 30 aa, Triticum aestivum
  unsure (1)..(30): unsure at all Xaa locations
  Clone ID: PAT_TA_77200.pep
RQTVAVXVIKGVEKKDPTGAKVTKAAIKKX

SEQ ID NO: 182783 - protein, 127 aa, Triticum aestivum
  Clone ID: PAT_TA_77201.pep
PKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182784 - protein, 131 aa, Triticum aestivum
  Clone ID: PAT_TA_77202.pep
IYERRTTAKAFAKDVFINQERKLGARRRSDTVLVSTINDADQGSADVAYRTPPAPYEKSKSLGSGGSMVARLKLKGIDGRAPPAARCQERRGARKAAGRRHHRARWRDPQDQPGAPPQEDRGEGGQGAQVS

SEQ ID NO: 182785 - protein, 135 aa, Triticum aestivum
  Clone ID: PAT_TA_77203.pep
NGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182786 - protein, 145 aa, Triticum aestivum
  unsure (1)..(145): unsure at all Xaa locations
  Clone ID: PAT_TA_77204.pep
EAEGKTVXAXKPIVVKYGLNHVTYLIEQSKAQLVVIAHDVDPIELVVWLPALCRKMEVPYCIVKGKSRLGSIVHKKTASVLCLTTVKNEDKLEFSKILEAIKAXNNDKFDEVRKKWGGGVMGSKSQAKTKARERLIAKEAAQRMN

SEQ ID NO: 182787 - protein, 137 aa, Triticum aestivum
  Clone ID: PAT_TA_77205.pep
VSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182788 - protein, 138 aa, Triticum aestivum
  unsure (1)..(138): unsure at all Xaa locations
  Clone ID: PAT_TA_77206.pep
VDGHWVVQGAVDVDIXPNPSAEGGGDXEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 182789 - protein, 46 aa, Triticum aestivum
  Clone ID: PAT_TA_77207.pep
CNWLDGKHVVFGEVVEGMDVVKNIEKVGSRSGTCSKQVVIADCGQL

SEQ ID NO: 182790 - protein, 168 aa, Triticum aestivum; identical to SEQ ID NO: 124109
  Clone ID: PAT_TA_77208.pep

SEQ ID NO: 182791 - protein, 168 aa, Triticum aestivum; identical to SEQ ID NO: 124110
  Clone ID: PAT_TA_77209.pep

SEQ ID NO: 182792 - protein, 185 aa, Triticum aestivum
  Clone ID: PAT_TA_77210.pep
FMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182793 - protein, 138 aa, Triticum aestivum
  Clone ID: PAT_TA_77211.pep
VDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 182794 - protein, 155 aa, Triticum aestivum
  unsure (1)..(155): unsure at all Xaa locations
  Clone ID: PAT_TA_77212.pep
PSSMMAKCDPRHGKXYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182795 - protein, 48 aa, Triticum aestivum
  Clone ID: PAT_TA_77213.pep
GKIACRCLKSLATSIKSINMGKVSGVPGKCGVSVPFPISMSTNCDTVN

SEQ ID NO: 182796 - protein, 110 aa, Triticum aestivum
  Clone ID: PAT_TA_77214.pep
GKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 182797 - protein, 181 aa, Triticum aestivum
  Clone ID: PAT_TA_77215.pep
SRKTAEAIDILKLMSSTFLVALCQAIDLRHLEENVKNAVKNCVTRVARKTLITNDMGGLHNTRFCEKDLLQTIDREAVFAYADDPCSANYPLMKKMRAVLVEHALANGEAECTVETSVFAKVAKFEQELCATLPQEVEAARGAVENGTAAEPNRIVDCRSYPLYRFVREELGTNGEPLPIC

SEQ ID NO: 182798 - protein, 168 aa, Triticum aestivum; identical to SEQ ID NO: 182763
  Clone ID: PAT_TA_77216.pep

SEQ ID NO: 182799 - protein, 113 aa, Triticum aestivum; identical to SEQ ID NO: 129529
  Clone ID: PAT_TA_77217.pep

SEQ ID NO: 182800 - protein, 141 aa, Triticum aestivum; identical to SEQ ID NO: 182624
  Clone ID: PAT_TA_77218.pep

SEQ ID NO: 182801 - protein, 85 aa, Triticum aestivum
  Clone ID: PAT_TA_77219.pep
MKGAKSKGAAKADTKLAVKSKGAEKPAAKGKKGKAGKDPNKPKRAPSAFFVFMGEFREEFKQKNPKNKSVAAVGKAAGERWKSLS

SEQ ID NO: 182802 - protein, 100 aa, Triticum aestivum
  Clone ID: PAT_TA_77220.pep
PPTPSPIRFSKFFQANMRILVTGGAGFIGSHLVDKLMENEKNEVIVADNFFTGSKDNLKKWIGHPRFELIRHDVTEPLLVEVDQIYHLACPASPIFYKHN

SEQ ID NO: 182803 - protein, 105 aa, Triticum aestivum
  unsure (1)..(105): unsure at all Xaa locations
  Clone ID: PAT_TA_77221.pep
MESKGGKKSSSSSSLMYEAPLGYSIEDVRPAGGAKKFSAAYSNCAKKPSXISFSLCSSLLCSLTRTATMAAPTSAIGFEGYEKRLEITFSEASIFADPHGRGLRA

SEQ ID NO: 182804 - protein, 241 aa, Triticum aestivum
  unsure (1)..(241): unsure at all Xaa locations
  Clone ID: PAT_TA_77222.pep
TRATARNGNNQVQGQPGYYPTSPLQPGQGQPGYDPTSPQQPGQGQQPGQLQQPAQGQQGQXLAQGQQGXQPAXVQQGQQPXQGQQGXQLGQGXQGQQPGQGQQPAQGQQGQQPGQGQQGHSARTRXXNLGQGQPWYYPTSPHEXGQGQQPGQWQQXRTMATXGQGQPGYYLTSPLQLGQGQQGYYPTFXQQPGQGQQPGXWQQSGQGQHGYYPXFPQLSGQGQRPGTIGLPRTRGKGTNPT

SEQ ID NO: 182805 - protein, 295 aa, Triticum aestivum
  unsure (1)..(295): unsure at all Xaa locations
  Clone ID: PAT_TA_77223.pep
VRTRNNQXQGQQGYYPTSPQQSGQGQQPGQGQSGYFPTSRQQSGQGQQPGQGQQSGQGQQGXQPGQGXQAYYPTYSQQSRQRXQXGQWQRPGQGQPGYYPTSPXXXGQEXQSGQAHXSGQWQLVYYPTSPQQPGQLXQPAQGQQPAQGQQSAQEQQPGQAQXSGQWQLXVYYPTSPQQPGQLQQPAQGQQGYYPTSPQQSGQGQQGYYPTSXQQSGQGQQGYYPTSPQQSGQGQQPGQGQQPRQGQXQGYYPIFSQQSGQXATTRTRGNKGTYPTXSQQSGQGQQPGHXEQQPGX

SEQ ID NO: 182806 - protein, 181 aa, Triticum aestivum
  Clone ID: PAT_TA_77224.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSV

SEQ ID NO: 182807 - protein, 89 aa, Triticum aestivum; identical to SEQ ID NO: 173274
  unsure (1)..(89): unsure at all Xaa locations
  Clone ID: PAT_TA_77225.pep

SEQ ID NO: 182808 - protein, 46 aa, Triticum aestivum
  Clone ID: PAT_TA_77226.pep
FGTRQPQQLPQFEEIRNLALQTLPAICNVYIPPYCTIAPFGIFGTN

SEQ ID NO: 182809 - protein, 127 aa, Triticum aestivum
  Clone ID: PAT_TA_77227.pep
GTRVLQQSTYQLLQELCCQHLWQIPEQSQCQAIHNVVHAIILRQQQKQQQQPSSQVSFQQPQQQYPLGQGSFRPSQQNPQAQGSVQPQQLPQFEEIRNLALQTLPAMCNVYIPPYCTIAPFGIFGTN

SEQ ID NO: 182810 - protein, 193 aa, Triticum aestivum
  Clone ID: PAT_TA_77228.pep
MKTFLIFVLLAMAMKIATAARELNPSNKELQSPQQSFSHQQQPFPQQPYPQQPYPSQQPYPSQQPFPTPQQQFPQQSQQPFTQPQQPTPLQPQQPFPLRPQQPFPQQPQQSQQSFPQPQPQQPQQPSILQPQQPLPQQPQQPFQQPQQQLSQQPEQTISQQPQQPFPQQPHQPQQPYPQQQPYGSSLTSIGGQ

SEQ ID NO: 182811 - protein, 301 aa, Triticum aestivum
  unsure (1)..(301): unsure at all Xaa locations
  Clone ID: PAT_TA_77229.pep
QIRHETSPQQSXXQGQQLGQGQPGYYPTSPQQSGQGQQSGQGQQGYYPTSPQQSGQGQQPGQGQXGYFRTYXQQSGQGQQPGQGQQXXQGQQGLQPGQGXQAYYPXSSQQXRQXXXXGQXXRPXQGXXGYYPTSPXQXGXEXQSGQAHQXGQWXXVXYPTSXQQPGQLXQPAQGXQPAQGQQSAQEXQPGQAQQSGQWQLVYYPTSPQQPGQLQQPAQGQQGYYPTSPQQSGQGQQGYYPXXPQQXGQGQQGYYPTXPXQXGQGXXPGQGXQXXQGQQGYYPXXRTXRXXXXTXXGXQGFY

SEQ ID NO: 182812 - protein, 38 aa, Triticum aestivum
  Clone ID: PAT_TA_77230.pep
EQNKMTSLLPCVSFIMDLVWQLFCAHQLVHRLHLLKKK

SEQ ID NO: 182813 - protein, 206 aa, Triticum aestivum
  unsure (1)..(206): unsure at all Xaa locations
  Clone ID: PAT_TA_77231.pep
ARGLSSSSCPDPEPGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVXDSNDRERVVEARDELHRMLNEDELRDAVLLVFANKQDLPNAMNAAEITDKLGLHSLRQRHWYIQST

SEQ ID NO: 182814 - protein, 203 aa, Triticum aestivum
  unsure (1)..(203): unsure at all Xaa locations
  Clone ID: PAT_TA_77232.pep
QQIPQQQQIPQQPKQFPQQQFPQQQFPQQQLPQQEFPQQQXXPQQXIAQXPQRLXXQQQXXQQPXLFPQXQXLXASXQSPXQQXFXQQQMYPNNXXXXXQXLPQPXGXXXQQQIXQQPXQFPQQXFPXQQQFPQQQELPQQQFPQQXLHQQQLPQQQXPQQXXPQQQXPQQQQFXXXQQLTQQXFPRPQQSPEQQQFXPTTIP

SEQ ID NO: 182815 - protein, 289 aa, Triticum aestivum
  unsure (1)..(289): unsure at all Xaa locations
  Clone ID: PAT_TA_77233.pep
AGYYPTSQQPXXQKQQAGQGQQSGQGQQGYYPTSPQQSGQGQQPGQGQPGYYPTSPQQXGQWQQPGQGQQPGQGQQSGQGQQXHXPGQGQQPXQXQQGXYXIXAHQXXXGXXXRQGQXGYXXXYXXQXGXXHXPXXGHXXXQGXHXHQAGQXHQXXQXHXGYXXXXXXQAGQGXQXGQGXPGYYPTXXXXAQXXHPGXXXXPGQGXHGXXXXXPXHSGQXQHXGQXXPXXYPTFXQXXXQXXQSGQXXQXXXPXFXXIXXTXXHPGQGXSGXFXXXXXXXGXGXHXGXX

SEQ ID NO: 182816 - protein, 179 aa, Triticum aestivum
  Clone ID: PAT_TA_77234.pep
MATETETFAFQAEINQLLSLIINTFYSNKEIFLRELISNSSDALDKIRFESLTDKSKLDAQPELFIHIIPDKATNTLTIVDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMVLYL

SEQ ID NO: 182817 - protein, 263 aa, Triticum aestivum
  unsure (1)..(263): unsure at all Xaa locations
  Clone ID: PAT_TA_77235.pep
TSLHQSAQGQQGHYPASQQQPGQGQQGHYPASQQQPGQGQQGHYPASQQEPGQGQQGQIPASQQQPGQGQQGHYPASLQQPGQQGHYPTSLQQLGQGQQIGQPGQKQQPGQGQQTGQGQQPEQEQQPGQGQQGYYPTSLQQPGQGQQQGQGQQGYYPTSLQQPGQGQQGHYPASLQQPGQGQPGQRQQPGQGQHPEQGQQPGQGQQGYYPTSPQQPGQGQQLGQGQQGYYPTXPQQPGQGQQPGQGQQGHXPMSPQQTGQAQQ

SEQ ID NO: 182818 - protein, 201 aa, Triticum aestivum
  Clone ID: PAT_TA_77236.pep
PEPGGTRREEGKGREEETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGE

SEQ ID NO: 182819 - protein, 154 aa, Triticum aestivum
  Clone ID: PAT_TA_77237.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPC

SEQ ID NO: 182820 - protein, 206 aa, Triticum aestivum
  Clone ID: PAT_TA_77238.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIW

SEQ ID NO: 182821 - protein, 141 aa, Triticum aestivum
  unsure (1)..(141): unsure at all Xaa locations
  Clone ID: PAT_TA_77239.pep
MYTARKKIQKDKGVEPXEFEDTVAQAXFDLENGNQELKSDLKDLYINTAIQMDVVGNRKAVVIHVPYRLRKPFRKIHVRLVRELEKKFSGKDVVFVAXRRIVRPPKKGSAVXRPRTRTLTXXHDGILEDVVYPAEIVGKRV

SEQ ID NO: 182822 - protein, 292 aa, Triticum aestivum
  unsure (1)..(292): unsure at all Xaa locations
  Clone ID: PAT_TA_77240.pep
QXXTRATTQXXGQXGYYPISPXQPGQGQQSGQGQPGYYPTSLRQPGQWQQPGQGQQPGQGQQGQQPGQGQQSGQGQQGYYPTSLXQPXQGQQLGQGQPGYYXTXQHSEQGQQPGQGKXPGQGXQXXYPTFPXQSGQXXXLGQXQXGXYYPTXPQXSGQGQHSGQGXXGYYPTFPXQSGQGQXPXQGQXXYLXTFRXXXGHGQEPGXGLQXGQGQXGQQPGQGQQAYYPTXSQQSRQRQXAGQWQRPGQGQPGYYPXFPXXPXXKEHNXGQAXHSGXWALGYYPTFSAQPGQL

SEQ ID NO: 182823 - protein, 200 aa, Triticum aestivum
  Clone ID: PAT_TA_77241.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPFPQTQQPQQPFPQFQQPHQPFPQPQQQFPQPQQPQQSFPQQQRPFIQ

SEQ ID NO: 182824 - protein, 197 aa, Triticum aestivum
  Clone ID: PAT_TA_77242.pep
KKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIQTIPAMCDVHVPPYCYTTISPSIDVTTGMG

SEQ ID NO: 182825 - protein, 153 aa, Triticum aestivum; identical to SEQ ID NO: 106678
  Clone ID: PAT_TA_77243.pep

SEQ ID NO: 182826 - protein, 155 aa, Triticum aestivum
  Clone ID: PAT_TA_77244.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLE

SEQ ID NO: 182827 - protein, 183 aa, Triticum aestivum
  Clone ID: PAT_TA_77245.pep
LTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLVSMILPRSDCQVMQQQCC

SEQ ID NO: 182828 - protein, 175 aa, Triticum aestivum
  unsure (1)..(175): unsure at all Xaa locations
  Clone ID: PAT_TA_77246.pep
QIPQQPQQFLQQQQFPQQQPPQQHQFPQQQLPQQQQIPQQQQIPQQPQQXPNNNKXPXXHNNSXNNNCXNNNFPNSNCRNRNSHNNNNCRNKKSPSNHNNSPQQQQXSPSNHXXFPNNNNXXSXNHPNNSNFPNNNXXNNNXXHXNNXGXHNKXPXNNKXXRNHXXXPSSNXPXN

SEQ ID NO: 182829 - protein, 166 aa, Triticum aestivum
  unsure (1)..(166): unsure at all Xaa locations
  Clone ID: PAT_TA_77247.pep
FPQFQQPHQPFPQPQQQFPQPQQPQQSFXLQPQQPFPQQPQQPFPQQPQXSFPEXPQQPXPQQPQQPFPQXXQQPFPXXQPQQPFXLRPEQPFAQQPQQSQQSFXQXQPQQPXQPCXLQPQXTIXXQPQQXISXAXNEQLSQQPEQTIXQXPQQPLXPSHTNLQPY

SEQ ID NO: 182830 - protein, 300 aa, Triticum aestivum
  unsure (1)..(300): unsure at all Xaa locations
  Clone ID: PAT_TA_77248.pep
EQLGQGQPGYYPTSQQPGQKQQAGQGQQSGQGQQGYYPTSPQQSGQGQQPGQGQPGYYPTSPQQSGQWQQPGQGQQPGQGQQSGQGQQGQQPGQGQRPGQGQQGYYPISPQQPGQGQQSGQGQPGYYPTSLRQPGQWQQPGQGQQPGQGQQGQQPGQGQQSGQGQQGYYPTSLQQPGQGQQLGQGQPGYYPTXQQSEQGQQPGQGKQPGQGQQGYYPTXSXQQXGQGQQLGXQGNQXYYXTSSQQSXXGQQXGQGQQGYYPNFSGTXGQGXNRDKGXPGYFSNXXAXXRXGQQPGXXTFG

SEQ ID NO: 182831 - protein, 196 aa, Triticum aestivum
  Clone ID: PAT_TA_77249.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSK

SEQ ID NO: 182832 - protein, 232 aa, Triticum aestivum
  unsure (1)..(232): unsure at all Xaa locations
  Clone ID: PAT_TA_77250.pep
VDPGYQVHWPXQQPFPQPQQPFCQQPQQTIPQPHQTFHHQPQQTFPQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLFQLVQGQGII

SEQ ID NO: 182833 - protein, 149 aa, Triticum aestivum; identical to SEQ ID NO: 141252
  Clone ID: PAT_TA_77251.pep

SEQ ID NO: 182834 - protein, 51 aa, Triticum aestivum
  unsure (1)..(51): unsure at all Xaa locations
  Clone ID: PAT_TA_77252.pep
MEAETAAKRARENEGAAAADGAGEQAGISAVIPGWFSEISPMWPGEAHXLK

SEQ ID NO: 182835 - protein, 205 aa, Triticum aestivum
  unsure (1)..(205): unsure at all Xaa locations
  Clone ID: PAT_TA_77253.pep
YVVTQIDLKTLLILTILAMAITXSTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPFPQTQQPQQPFPQFQQPHQPFPQPQQQFPQPQQPQQSFPQQQRPF

SEQ ID NO: 182836 - protein, 57 aa, Triticum aestivum
  unsure (1)..(57): unsure at all Xaa locations
  Clone ID: PAT_TA_77254.pep
GDLDRTIXCYTXECFGMKLXLRKRDXPXEXYTNAFLGYGPEDTNFALELTYNYGVDK

SEQ ID NO: 182837 - protein, 99 aa, Triticum aestivum
  Clone ID: PAT_TA_77255.pep
QPLLQFESESRAERNRGRKTRELVDYREAASQRDWWEKRVRIKLHKNPKLREGDAKNDIRMASSRSSSMQQRTSWRLQQVERLQCCSRGVLRTSGNYYC

SEQ ID NO: 182838 - protein, 183 aa, Triticum aestivum
  Clone ID: PAT_TA_77256.pep
KTFLILALLAIVATTTTTAVRVPVPQLQPQNPSQQQPQEQVPLVQQQQFLGQQQQQFPGQQQPFPPQQPYPQPQPFLPQLPYPQPQPFPPQQSYPQPQPQYPQPQQPISQQQAQLQQQQQQQQQQQQQILQQILQQQLIPCRDVVLQQPNIAHASSKVSQQSYQLLQQLCCLQLWQTPEQSRC

SEQ ID NO: 182839 - protein, 188 aa, Triticum aestivum
  Clone ID: PAT_TA_77257.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLVSMILPRSDCQVMQQQC

SEQ ID NO: 182840 - protein, 140 aa, Triticum aestivum
  unsure (1)..(140): unsure at all Xaa locations
  Clone ID: PAT_TA_77258.pep
PQQSQQSQQPFAQPQQLFPELQQPIPQQPQQPFPLQPQQPFPQQPQQPFPQQPQQSFPQQPQQPFPQQPQQPFPQQPQQPFPQQPQQPFRLRPQQXFXQXPXQSQQXFPQPXPEQPQQPSIXEXXQRLXPTTTTINSPNY

SEQ ID NO: 182841 - protein, 219 aa, Triticum aestivum
  Clone ID: PAT_TA_77259.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCC

SEQ ID NO: 182842 - protein, 195 aa, Triticum aestivum
  unsure (1)..(195): unsure at all Xaa locations
  Clone ID: PAT_TA_77260.pep
IFALLAXAATSAIAQMETSRVPGLEKPWQQQPLPPQQQPPCSQQQQPFPQQQQPIIILQQSPFSQQQQPVLPQQQPVIILQQPPFSQQQQPVLPQQPPFSQQQQQQQQQQPPFSQQQQPVLPQQPPFSQQQQPQQSGQGVSQHQQQSQQQQQLGQCSFQQPQQLQQLGQQPXQQQQIPQGIFLQPHQISQLEVMT

SEQ ID NO: 182843 - protein, 191 aa, Triticum aestivum
  unsure (1)..(191): unsure at all Xaa locations
  Clone ID: PAT_TA_77261.pep
VLQFTVKHEQKLDCGGGYVKLLGGDVDQKKCCXGRVTTKVHTILTKDGKNHLIKKDVPCETDQLSHVYTLIIRPDATYSILIDNEEKQTGSIYEHWDILPPKEIKDPEAKKPEDWDDKEYIPDPEDVKPEGYDDIPREVTDPDAKKPEDWDDEEDGEWTAPTIPNPEYKGPWKQKKIKNPNYQGKWKAPMI

SEQ ID NO: 182844 - protein, 109 aa, Triticum aestivum
  unsure (1)..(109): unsure at all Xaa locations
  Clone ID: PAT_TA_77262.pep
LQQQVNPCKNFLLQQCKPVSLVSSLWSMIWPQSDCQVMRXQCCQQLAQIPQQLQCAAIHTVIHSIIMXXEQQQGMHILLPLYQQQQVGQGTLXQXQGIIQPQQPAQLEA

SEQ ID NO: 182845 - protein, 235 aa, Triticum aestivum
  unsure (1)..(235): unsure at all Xaa locations
  Clone ID: PAT_TA_77263.pep
FSAATQXQGQQPGQLQQPAQGQQPEQGQQGQQPGQGQQGQQPGQGQQPGQGQPGYYPTSPQQSGQGQPGYYPTXSXQPTQSQQPGQGQQGQQVGQGQQAQXPGQGQQPGQGQPGYYPTYXLQSGQGQPGYYLTSPQQXGQGQQPGQLXQSVQGQKGXQPGQGQQXGQGQQGQQXGQGXQGXQPXQGHXGFYXTFXXQSGQGXXPGQWXQXXQGXPGXXXTSSXHXGQGXXGXXXT

SEQ ID NO: 182846 - protein, 124 aa, Triticum aestivum
  Clone ID: PAT_TA_77264.pep
VLQQSTYQLLQELCCQHLWQIPEQSQCQAIHNVVHAIILRQQQKQQQQPSSQVSFQQPQQQYPLGQGSFRPSQQNPQAQGSVQPQQLPQFEEIRNLALQTLPAMCNVYIPPYCTIAPFGIFGTN

SEQ ID NO: 182847 - protein, 197 aa, Triticum aestivum; identical to SEQ ID NO: 182824
  Clone ID: PAT_TA_77265.pep

SEQ ID NO: 182848 - protein, 168 aa, Triticum aestivum; identical to SEQ ID NO: 182654
  Clone ID: PAT_TA_77266.pep

SEQ ID NO: 182849 - protein, 161 aa, Triticum aestivum; identical to SEQ ID NO: 157638
  Clone ID: PAT_TA_77267.pep

SEQ ID NO: 182850 - protein, 199 aa, Triticum aestivum
  unsure (1)..(199): unsure at all Xaa locations
  Clone ID: PAT_TA_77268.pep
NNSRNNNFPNSNSRNSNSHNNNNSRNKKSPGNHNNSPNNNKSPSNHNXFPNNNNSPSNNHPNNSNFPNNNCPQXQQLXQQQLXQPXQIPEQQQFXQQXXPQQQXISPTXXSPNXXXYRNIXSGQPQKXXQQQXIPQXXXXXPSNNFRNNSNFXNNKNFPNSNSRXNNXTNNNYHNXNFPNNNXPNSNSPNNNSSPNNNN

SEQ ID NO: 182851 - protein, 186 aa, Triticum aestivum
  Clone ID: PAT_TA_77269.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPFPQTQQPQQPFPQFQQPHQPFPQPQQQFPQPQQ

SEQ ID NO: 182852 - protein, 184 aa, Triticum aestivum
  Clone ID: PAT_TA_77270.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATEEAKKSNNVQRKLEKRQQGRTLDSHIEEQFSGGRL

SEQ ID NO: 182853 - protein, 115 aa, Triticum aestivum
  unsure (1)..(115): unsure at all Xaa locations
  Clone ID: PAT_TA_77271.pep
PQQQQFPATKNRPATTTTPPTTTNPPATTTISPTTTIPPATITPTTXIXPTTISPTTTITXTTIXPTTTNTXATTXXXXTXTPTTAIXPTTISPTTXISATTISPTTKIXXTTTN

SEQ ID NO: 182854 - protein, 141 aa, Triticum aestivum
  unsure (1)..(141): unsure at all Xaa locations
  Clone ID: PAT_TA_77272.pep
NNHFPLQPQQPFPQQPQQPFPQPQQPIPVXPQQLFPQXSQQXNNLLPSARQLFAELQQPIXQQPQQPFPLXAXQPFPQQPQQPFPQQPQQXFXQQPQQPFXQQPXQPFXXXPQQPFXQQPXQPXPLRPXQPFXQXPQQLQQ

SEQ ID NO: 182855 - protein, 161 aa, Triticum aestivum
  Clone ID: PAT_TA_77273.pep
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQ

SEQ ID NO: 182856 - protein, 198 aa, Triticum aestivum
  Clone ID: PAT_TA_77274.pep
KKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIQTIPAMCDVHVPPYCYTTISPSIDVTTGMGG

SEQ ID NO: 182857 - protein, 285 aa, Triticum aestivum
  unsure (1)..(285): unsure at all Xaa locations
  Clone ID: PAT_TA_77275.pep
MQIFVKTLTGKTITLEVESSDTIDNVKAKIQDKEGIPPDQQRLIFAGKQLEDGRTLADYNIQKESTLHLVLRLRGGMXIFVKTLTGKTITLEVESSDTIDNXKAKIQDKEGIPPDQQRXIFAGKQLEDGRTLADYNIQKESTXHLVLRLRGGMQIFVKTLXGKTITLEVESXDTIDNVKAKIQDKEGIPPDQQRLIFAGKQXEDGRTLADYNIQXESTLHLGAQAXRXGMQIFGKTLXGKXITLEXVVXXDPIXKGKGKIQDKEGIPPDQXXFIFCCKHXXEGPP

SEQ ID NO: 182858 - protein, 147 aa, Triticum aestivum
  unsure (1)..(147): unsure at all Xaa locations
  Clone ID: PAT_TA_77276.pep
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWXAVL

SEQ ID NO: 182859 - protein, 183 aa, Triticum aestivum
  unsure (1)..(183): unsure at all Xaa locations
  Clone ID: PAT_TA_77277.pep
RRATTRYKGQQGYYPISPQQPGXQGQQSGQGQPGYYPTSLRQPGQWQQPGQGQQPGQGQQGQQPGQXQQSGQGQQGYYPTXLXXXGQGHQLGQGQPGYYPTXXYSVKXXXXVQXKXXGQXQQXXXSXXFPXHXGQGQHLGQGQPGXXIPXXXXHSGQGXXSGQXXXXFXXTFCFQDKGIPGQG

SEQ ID NO: 182860 - protein, 135 aa, Triticum aestivum
  unsure (1)..(135): unsure at all Xaa locations
  Clone ID: PAT_TA_77278.pep
SAYCGKYXDELIKNAAYIGTPGXGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEA

SEQ ID NO: 182861 - protein, 196 aa, Triticum aestivum
  Clone ID: PAT_TA_77279.pep
RNSSSLPSLLSRRPPRPPNPLLHSVLLGSRTIHHLQSSNQLHSHKNNVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIQTIPAMCDVHVPPYCYTTISPSIDVTTGMG

SEQ ID NO: 182862 - protein, 88 aa, Triticum aestivum
  unsure (1)..(88): unsure at all Xaa locations
  Clone ID: PAT_TA_77280.pep
MARLNSKAVVSAVVLAAVVLMMAGREATALSCGQVDSKLAPCVSYVTGKAPSISKECCSGVQGLNGLARSSPDRKIACRCLXSLATSI

SEQ ID NO: 182863 - protein, 293 aa, Triticum aestivum
  unsure (1)..(293): unsure at all Xaa locations
  Clone ID: PAT_TA_77281.pep
QLQQPAQGQQPEQGQQGQQPGQGQQGQQPGQGQQPGQGQPGYYPTSPQQSGQGQPGYYPTSSQQPTQSQQPGQGQQGQQVGQGQQAQQPGQGQQPGQGQPGYYPTXPLQSGQGQPGYYLTSPQQSGQGHQPGQLQQSAQGQKGQQPGQGQQPGQGQQGQQXGQGQQGQQPGQGQPGYYPTSAQQSGQGQQPGQWQQPGQGQPGYYPTXPLQPGQGQPGYHPTYXQQXGQGQXPGQLQQPAQGQQGQQLAQGQQGQQPAQXQQGXXXAQGQQGQQXGQGXXGQXPGQGQXPAQX

SEQ ID NO: 182864 - protein, 261 aa, Triticum aestivum
  unsure (1)..(261): unsure at all Xaa locations
  Clone ID: PAT_TA_77282.pep
ARGSNQXQGQQPXXQGQQGQQPGQGQQSGQGQQGYYPTSLQQPGQGQQLGQGQPGYYPTSQQSEQXQXPGQGKQPGQGQQXXYPTSPXXSGQGQXLGQGQPXYYPXSXXXXGQGQQSGQGQQXXYPTXPEHSGQGXXXXQGQXGXYFPTSXQXSGQGHXPGQGXXXXQGQQGXQPGQGHQAYYPXSSQQSRQRQQAGQWQRPGQGQPGYYPTSPQXPGXEQQSGQAHQSGQWXLVYYPTXXQQPXQLXQPXQGQQPXQGQQ

SEQ ID NO: 182865 - protein, 179 aa, Triticum aestivum
  Clone ID: PAT_TA_77283.pep
FPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPLFQLVQGQGII

SEQ ID NO: 182866 - protein, 200 aa, Triticum aestivum
  Clone ID: PAT_TA_77284.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLSSSQPQQQTQLDQGWIAVIGTWVIQTIPAMCDVHVPPYCYTTISPSSDVTTDMGG

SEQ ID NO: 182867 - protein, 161 aa, Triticum aestivum; identical to SEQ ID NO: 129051
  Clone ID: PAT_TA_77285.pep

SEQ ID NO: 182868 - protein, 131 aa, Triticum aestivum
  unsure (1)..(131): unsure at all Xaa locations
  Clone ID: PAT_TA_77286.pep
ANSARGTTTTIPATTNRPATTTTPPTTTNPPTTTTISPTTTIPPATITPTTAIXPTTIPPTXXITXTTIXPXTXNXRTAXXIPGTXXAXTTITTTXXXXXAIPPTAXXPTTTVXPTTXINATTIPPXTTIP

SEQ ID NO: 182869 - protein, 150 aa, Triticum aestivum
  Clone ID: PAT_TA_77287.pep
MVKAVAVLTGSEGVKGTIFFTQEGEGPTTVTGSVTGLKEGLHGFHVHALGDTTNGCMSTGPHFNPAGHVHGAPEDEIRHAGDLGNVTAGVDGVASINITDCHIPLTGPNSIVGRAVVVHGDADDLGKGGHELSKSTGNAGARVACGIIGL

SEQ ID NO: 182870 - protein, 184 aa, Triticum aestivum
  Clone ID: PAT_TA_77288.pep
RHEAFPQHSTTPNNHFPQLQQPQQPFPQPQQQLPQPQQPQQSFPQQQRSFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPSMCNVYV

SEQ ID NO: 182871 - protein, 205 aa, Triticum aestivum
  Clone ID: PAT_TA_77289.pep
SPPPPAPIPNRGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCAT

SEQ ID NO: 182872 - protein, 185 aa, Triticum aestivum
  Clone ID: PAT_TA_77290.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRLL

SEQ ID NO: 182873 - protein, 209 aa, Triticum aestivum
  Clone ID: PAT_TA_77291.pep
LSSFLSSSCPDPEPGGTRREEGKGREEETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCAT

SEQ ID NO: 182874 - protein, 149 aa, Triticum aestivum
  Clone ID: PAT_TA_77292.pep
AKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182875 - protein, 42 aa, Triticum aestivum
  Clone ID: PAT_TA_77293.pep
QPQQLPQFEEIRNLALQTLPAICNVYIPPYCTIAPFGIFGTN

SEQ ID NO: 182876 - protein, 99 aa, Triticum aestivum
  unsure (1)..(99): unsure at all Xaa locations
  Clone ID: PAT_TA_77294.pep
XXXXXXXXXXXAFXXXQFISHXKXYIXXXSAKLEGDDXDAFKKNVESATKYLLSKLKDLQFFVGESMHDDGGVVFAYXKEGAADPTFLYFAHGLKEVKC

SEQ ID NO: 182877 - protein, 76 aa, Triticum aestivum
  unsure (1)..(76): unsure at all Xaa locations
  Clone ID: PAT_TA_77295.pep
XXXXXXXKHGXAXCXFVAIXIFNXXKLEXIVPSSXXCDVPHVDRQDYQLIDITDDGYVSLLPQSXHPXHHLQLXHH

SEQ ID NO: 182878 - protein, 56 aa, Triticum aestivum
  Clone ID: PAT_TA_77296.pep
WLDENQTAEKEDYEEKLKEVEAVCNPIVSAVYQRSGGAPGGEGADGGVDDEDHDEL

SEQ ID NO: 182879 - protein, 53 aa, Triticum aestivum
  unsure (1)..(53): unsure at all Xaa locations
  Clone ID: PAT_TA_77297.pep
APTADGXXEWVAIAPSASGSENCEEEQPKVDSCSDYVMDRXXMKDMPLXWFFP

SEQ ID NO: 182880 - protein, 173 aa, Triticum aestivum
  unsure (1)..(173): unsure at all Xaa locations
  Clone ID: PAT_TA_77298.pep
TAGPNNRQQSFPQQQRXFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPSMCNVYVPPECSIMRAPFASIVAGIGGQ

SEQ ID NO: 182881 - protein, 180 aa, Triticum aestivum
  unsure (1)..(180): unsure at all Xaa locations
  Clone ID: PAT_TA_77299.pep
PQPQQQLPQPQQPXQQSFPQQQRSFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPSMCNVYVPPECSIMRAPFASIVAGIGGQ

SEQ ID NO: 182882 - protein, 42 aa, Triticum aestivum
  unsure (1)..(42): unsure at all Xaa locations
  Clone ID: PAT_TA_77300.pep
SSGHHLKXSGHHQGTICQHSRGDWWPMKKARSILIDRWIIVT

SEQ ID NO: 182883 - protein, 94 aa, Triticum aestivum
  unsure (1)..(94): unsure at all Xaa locations
  Clone ID: PAT_TA_77301.pep
IXXVVHSIIXQQQQQQQQQQGMHIFLPLSQQQQVGQGSLVQGQGIIQPQQPAQLEAIRSLVLQTLPSMCNVYVPPECSIMRAPFASIVAGIGGQ

SEQ ID NO: 182884 - protein, 70 aa, Triticum aestivum
  unsure (1)..(70): unsure at all Xaa locations
  Clone ID: PAT_TA_77302.pep
XSPXXPSPXVPXRPPLSSSXXSPSCVTICMSMFFFISKXNKNFXTXAIPPSVRNNWSRFLQXFVPFWCPV

SEQ ID NO: 182885 - protein, 177 aa, Triticum aestivum
  Clone ID: PAT_TA_77303.pep
PQQQLPQPQQPQQSFPQQQRSFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPSMCNVYVPPECSIMRAPFASIVAGIGGQ

SEQ ID NO: 182886 - protein, 68 aa, Triticum aestivum
  unsure (1)..(68): unsure at all Xaa locations
  Clone ID: PAT_TA_77304.pep
XDDRYWTMWXLPMFGCTDATQVINEVEEVKKEYPDAYVRIIGFDNMRQVQCVSFIAFKPPGCEESGKA

SEQ ID NO: 182887 - protein, 113 aa, Triticum aestivum
  Clone ID: PAT_TA_77305.pep
SYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182888 - protein, 61 aa, Triticum aestivum; identical to SEQ ID NO: 174015
  Clone ID: PAT_TA_77306.pep

SEQ ID NO: 182889 - protein, 304 aa, Triticum aestivum
  unsure (1)..(304): unsure at all Xaa locations
  Clone ID: PAT_TA_77307.pep
LIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVXRLRGGMQIFVXTLTGKTITLEVESSDTIDNVXKAKIQDKEGIPPDXQRLIFCRKQLEDGRPXVDYNIQXESTLXHLGLXLKGGXAKSLGKXLTRKTLTAXXRXXXPIPXXKXKIPXXGXXXRD

SEQ ID NO: 182890 - protein, 125 aa, Triticum aestivum; identical to SEQ ID NO: 150717
  Clone ID: PAT_TA_77308.pep

SEQ ID NO: 182891 - protein, 78 aa, Triticum aestivum
  unsure (1)..(78): unsure at all Xaa locations
  Clone ID: PAT_TA_77309.pep
EARRGRDLDCTHSNYQTLMRPXIVIYCHYLPVSGLGNLRACCLXLDVVAVSQAPSPESNPNSPSPVTTMVGPYPTIES

SEQ ID NO: 182892 - protein, 34 aa, Triticum aestivum
  Clone ID: PAT_TA_77310.pep
MSRTGPIAQDWEPVVVRKKLPNAAAKKDEKAVNA

SEQ ID NO: 182893 - protein, 174 aa, Triticum aestivum; identical to SEQ ID NO: 133469
  Clone ID: PAT_TA_77311.pep

SEQ ID NO: 182894 - protein, 173 aa, Triticum aestivum; identical to SEQ ID NO: 182615
  Clone ID: PAT_TA_77312.pep

SEQ ID NO: 182895 - protein, 154 aa, Triticum aestivum
  Clone ID: PAT_TA_77313.pep
GAAKADAKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 182896 - protein, 161 aa, Triticum aestivum; identical to SEQ ID NO: 129051
  Clone ID: PAT_TA_77314.pep

SEQ ID NO: 182897 - protein, 107 aa, Triticum aestivum
  unsure (1)..(107): unsure at all Xaa locations
  Clone ID: PAT_TA_77315.pep
MESKGGKKSSSSSSLMYEAPLGYSIEDVRPAGGAKKFSAAYSNCAKKPSXISFSLCSSLLCSLTRTATMAAPTSAIGFEGYEKRLEITFSEASIFADPHGRGLRALS

SEQ ID NO: 182898 - protein, 102 aa, Triticum aestivum
  unsure (1)..(102): unsure at all Xaa locations
  Clone ID: PAT_TA_77316.pep
VHQNCPLLCKELELPRAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 182899 - protein, 161 aa, Triticum aestivum
  unsure (1)..(161): unsure at all Xaa locations
  Clone ID: PAT_TA_77317.pep
MKGAKXKGAAKADTKLAVKSKGAEKPAAKGKKGXAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 182900 - protein, 191 aa, Triticum aestivum
  Clone ID: PAT_TA_77318.pep
AAAAPWTRLVSEKTSGAYSANAFPWSNAMLQWQRTGFHFQPDKYYQNDPNGPVYYGGWYHFFYQYNPSGSVWEPQIVWGHAVSKDLIHWRHLPPALVPDQWYDIKGVLTGSITVLPDGKVILLYTGNTETFAQVTCLAEPADPSDPLLREWVKHPANPVVFPPPGIGMKDFRDPTTAWYDESDGTWRTIIG

SEQ ID NO: 182901 - protein, 114 aa, Triticum aestivum
  unsure (1)..(114): unsure at all Xaa locations
  Clone ID: PAT_TA_77319.pep
LSYLPRSARXALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182902 - protein, 165 aa, Triticum aestivum
  Clone ID: PAT_TA_77320.pep
VDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKK

SEQ ID NO: 182903 - protein, 273 aa, Triticum aestivum
  unsure (1)..(273): unsure at all Xaa locations
  Clone ID: PAT_TA_77321.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDXNXKAKIQDKEGIPPXDQQRLIFAGKQLEDGXRTLADYNXQKESTLYLXLRXRGGMQIFXXKPSPGKXITLEVESXDTLXXXXRARIQDKXGXFXPD

SEQ ID NO: 182904 - protein, 96 aa, Triticum aestivum; identical to SEQ ID NO: 117442
  unsure (1)..(96): unsure at all Xaa locations
  Clone ID: PAT_TA_77322.pep

SEQ ID NO: 182905 - protein, 164 aa, Triticum aestivum; identical to SEQ ID NO: 182770
  Clone ID: PAT_TA_77323.pep

SEQ ID NO: 182906 - protein, 96 aa, Triticum aestivum; identical to SEQ ID NO: 117442
  unsure (1)..(96): unsure at all Xaa locations
  Clone ID: PAT_TA_77324.pep

SEQ ID NO: 182907 - protein, 302 aa, Triticum aestivum
  unsure (1)..(302): unsure at all Xaa locations
  Clone ID: PAT_TA_77325.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIXAGKQLEDGRTLADYNIQKESTLHLVLRLRGGMQIXVKTLTGKXTITXEVESSDTIDNXKAKIQDKEGIPPDQQRLIFAGKQLEDGRTLADYNIQXESTLHLXLRLRXGMXXFXKTLXXXKQKAGGXRPRDTIXNXKGXXQDKXGXSPRXXRGPYFXSGKXLXGXXRTFGWIQXQKPSPGAP

SEQ ID NO: 182908 - protein, 99 aa, Triticum aestivum; identical to SEQ ID NO: 182837
  Clone ID: PAT_TA_77326.pep

SEQ ID NO: 182909 - protein, 188 aa, Triticum aestivum
  Clone ID: PAT_TA_77327.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKF

SEQ ID NO: 182910 - protein, 156 aa, Triticum aestivum
  Clone ID: PAT_TA_77328.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTT

SEQ ID NO: 182911 - protein, 69 aa, Triticum aestivum
  unsure (1)..(69): unsure at all Xaa locations
  Clone ID: PAT_TA_77329.pep
MENPKGPSRCXTCRKRVGLTGFNCRCGNLYCATHRYSDKHECKFDYRAAAMDAIAKANPVVKAEKLDKI

SEQ ID NO: 182912 - protein, 185 aa, Triticum aestivum
  Clone ID: PAT_TA_77330.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTA

SEQ ID NO: 182913 - protein, 197 aa, Triticum aestivum
  Clone ID: PAT_TA_77331.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKD

SEQ ID NO: 182914 - protein, 126 aa, Triticum aestivum
  Clone ID: PAT_TA_77332.pep
EFGTRGSSNSKAVVAAVVLAAVVLMMAGREASAALSCGQVDSKLAPCVAYVTGRASSISKECCSGVQGLNGMARSSSDRKIACRCLKSLATSIKSINMGKVSGVPGKCGVSVPFPISMSTNCDTVN

SEQ ID NO: 182915 - protein, 196 aa, Triticum aestivum; identical to SEQ ID NO: 182831
  Clone ID: PAT_TA_77333.pep

SEQ ID NO: 182916 - protein, 208 aa, Triticum aestivum
  Clone ID: PAT_TA_77334.pep
VAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVS

SEQ ID NO: 182917 - protein, 144 aa, Triticum aestivum
  unsure (1)..(144): unsure at all Xaa locations
  Clone ID: PAT_TA_77335.pep
LEPWLPTKGEGPAIGIDLGTTYSCVGVWQHDRVEIIANDQGNRTTPSYVAFTDSERLIGDAAKNQVAMNPINTVFDAKRLIGRRFADAPVQSDIKMWPYKVIPGPADKPMIVVQYKGEDKQFSXEEISSMXLIKMXEIAEAYLX

SEQ ID NO: 182918 - protein, 106 aa, Triticum aestivum; identical to SEQ ID NO: 177569
  unsure (1)..(106): unsure at all Xaa locations
  Clone ID: PAT_TA_77336.pep

SEQ ID NO: 182919 - protein, 78 aa, Triticum aestivum; identical to SEQ ID NO: 106966
  Clone ID: PAT_TA_77337.pep

SEQ ID NO: 182920 - protein, 75 aa, Triticum aestivum; identical to SEQ ID NO: 117166
  Clone ID: PAT_TA_77338.pep

SEQ ID NO: 182921 - protein, 196 aa, Triticum aestivum
  Clone ID: PAT_TA_77339.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKE

SEQ ID NO: 182922 - protein, 175 aa, Triticum aestivum
  Clone ID: PAT_TA_77340.pep
AGEPTASSDSPDQERRAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLDLHS

SEQ ID NO: 182923 - protein, 225 aa, Triticum aestivum
  unsure (1)..(225): unsure at all Xaa locations
  Clone ID: PAT_TA_77341.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTXLADYNIQKESTLHLVLRLRGGMQIFVKTLTGKTITLEVESSDTIXDNVKAXIXGHRRAFPPDQQRXLIFAGKQGGMVTLAGLHSQGVHPFLVL

SEQ ID NO: 182924 - protein, 63 aa, Triticum aestivum
  unsure (1)..(63): unsure at all Xaa locations
  Clone ID: PAT_TA_77342.pep
XRGASYIRXLLLLDFLPPFDSISTFTKGSWXKLYGNXDPERARLFRFRSQEFPLSRHRSRALP

SEQ ID NO: 182925 - protein, 158 aa, Triticum aestivum
  Clone ID: PAT_TA_77343.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNC

SEQ ID NO: 182926 - protein, 106 aa, Triticum aestivum
  Clone ID: PAT_TA_77344.pep
MARRSGGGRSSRPAPRAAPVRNPPAPARPAPPPATTQSSGGGIMSGIGSTIAQGMAFGTGSAMAHRAVDAVMGPRTIQHETVVGEAAASMTPMDNAADDKCGNPSK

SEQ ID NO: 182927 - protein, 54 aa, Triticum aestivum
  unsure (1)..(54): unsure at all Xaa locations
  Clone ID: PAT_TA_77345.pep
MAFMRTSSNASXGMGVAPDIRETFLELQMKKAFRYVIFKIEEKQKQVVVEKTGA

SEQ ID NO: 182928 - protein, 203 aa, Triticum aestivum
  Clone ID: PAT_TA_77346.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIE

SEQ ID NO: 182929 - protein, 156 aa, Triticum aestivum
  unsure (1)..(156): unsure at all Xaa locations
  Clone ID: PAT_TA_77347.pep
EPSSMMAKCDPRHGKXYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182930 - protein, 104 aa, Triticum aestivum
  unsure (1)..(104): unsure at all Xaa locations
  Clone ID: PAT_TA_77348.pep
XKQVDYLXIRSKWVPCLEFSKVGFIFREHNASPGYYDGXRYWTMWKLPMFGCTDATQVINEVEEVKKEYPDAYVRIIGFDNMRQVQCVSFIAFKPPGCEESGKA

SEQ ID NO: 182931 - protein, 168 aa, Triticum aestivum; identical to SEQ ID NO: 124109
  Clone ID: PAT_TA_77349.pep

SEQ ID NO: 182932 - protein, 40 aa, Triticum aestivum
  Clone ID: PAT_TA_77350.pep
VKKEYPDAYVRIIGFDNMRQVQCVSFIAFKPPGCEESGKA

SEQ ID NO: 182933 - protein, 99 aa, Triticum aestivum
  Clone ID: PAT_TA_77351.pep
VDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182934 - protein, 71 aa, Triticum aestivum
  Clone ID: PAT_TA_77352.pep
KTFLSSIATALHQGRTLDSHIEEQFSGGRLLACISSRPGQCGRADGYILEGKELEFYMRKLQKKKGKGATA

SEQ ID NO: 182935 - protein, 54 aa, Triticum aestivum
  unsure (1)..(54): unsure at all Xaa locations
  Clone ID: PAT_TA_77353.pep
NMXXHIFLXXNXKDKWGRXTQSNXRXDKTXMALYIWXVVSELFRPCRTPRSPVA

SEQ ID NO: 182936 - protein, 157 aa, Triticum aestivum
  unsure (1)..(157): unsure at all Xaa locations
  Clone ID: PAT_TA_77354.pep
FEPSSMMAKCDPRHGKXYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182937 - protein, 168 aa, Triticum aestivum; identical to SEQ ID NO: 124110
  Clone ID: PAT_TA_77355.pep

SEQ ID NO: 182938 - protein, 93 aa, Triticum aestivum
  Clone ID: PAT_TA_77356.pep
SKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182939 - protein, 40 aa, Triticum aestivum
  unsure (1)..(40): unsure at all Xaa locations
  Clone ID: PAT_TA_77357.pep
EKXKVSYDRRKXLAKXRVKAXKAAXEKLGTQLEILAPIKY

SEQ ID NO: 182940 - protein, 71 aa, Triticum aestivum
  unsure (1)..(71): unsure at all Xaa locations
  Clone ID: PAT_TA_77358.pep
GYYDGRYWTMWXLPMFGCTDXATQXINEVEEVKKEYPDAYVRIIGFDNMRQVQCVSFIAFKPPGCEESGKA

SEQ ID NO: 182941 - protein, 151 aa, Triticum aestivum
  Clone ID: PAT_TA_77359.pep
FPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 182942 - protein, 41 aa, Triticum aestivum
  unsure (1)..(41): unsure at all Xaa locations
  Clone ID: PAT_TA_77360.pep
XKKPTIXSREIQXSVRLVLPGELAKHAVSEGTKAVTKFTSS

SEQ ID NO: 182943 - protein, 70 aa, Triticum aestivum
  unsure (1)..(70): unsure at all Xaa locations
  Clone ID: PAT_TA_77361.pep
RKITMAAGHRSSGQMSPPKTLLNQPRRSHRTDKGKTRHDTRLSRFRSTTRDTGRRRQATXGRTDLELAAV

SEQ ID NO: 182944 - protein, 87 aa, Triticum aestivum
  Clone ID: PAT_TA_77362.pep
MINRDSRGHSYFIVRGEILGFMKDEQTAKAFAKDVFINQERKLGARRRSDTVTSREIQTAVRLVLPGELAKHAVSEGTKAVTKFTSS

SEQ ID NO: 182945 - protein, 98 aa, Triticum aestivum
  unsure (1)..(98): unsure at all Xaa locations
  Clone ID: PAT_TA_77363.pep
MDRSPRFGSISSDNRPIKTRFRYGSGFRSLNQATAYESPAHSSTGTRSEXLSPPTAWELSTVSRSISLPTXGFFSPFPNGTTSLSVTQEYLALQGGPC

SEQ ID NO: 182946 - protein, 147 aa, Triticum aestivum
  unsure (1)..(147): unsure at all Xaa locations
  Clone ID: PAT_TA_77364.pep
CDPRHGKYMAXCXMXXGXVVPKNVNAXVATIKTKRTIQFVDWCPTGFKCGINYQPPGVVPXGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182947 - protein, 150 aa, Triticum aestivum
  unsure (1)..(150): unsure at all Xaa locations
  Clone ID: PAT_TA_77365.pep
VSRRSNGASLGSVSNGGRIRCMQVWPIEGIKKFETLSYLPPLSTEXALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 182948 - protein, 87 aa, Triticum aestivum
  unsure (1)..(87): unsure at all Xaa locations
  Clone ID: PAT_TA_77366.pep
SVSNGXRIRCMQXVWPIEGIKKFETLSYLPPLSTEALLKQVDYXIRSKWVPCLEFSKVGFIFREHNASPGYYDGRYWTMWKLPMFGC

SEQ ID NO: 182949 - protein, 127 aa, Triticum aestivum
  Clone ID: PAT_TA_77367.pep
DGRVYDDEVRKWVTSTGIENIGKKLVNSRDGPVTFEQPKMTVEKLLEYGHMLVQEQDNVKRVQLADTYMSQAALGDANQDAMKTGTFYGGKGAQQGTLPVPAGCTDQTAKNFDPTARSDDGSCLYTF

SEQ ID NO: 182950 - protein, 172 aa, Triticum aestivum
  Clone ID: PAT_TA_77368.pep
KAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 182951 - protein, 85 aa, Triticum aestivum
  Clone ID: PAT_TA_77369.pep
WQTPHDALQGTLATEVVTLLPAVASRQKKEMDLVGFHWERQPTLLAGYVGCPIKTRFRYGSGGFRSLNQATAYESPAHSSTGTRS

SEQ ID NO: 182952 - protein, 151 aa, Triticum aestivum
  Clone ID: PAT_TA_77370.pep
LRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEEVAVSAGSPRSVFHCFEAETVESHPLVKEGKLANLLAWRAEDSLEEGVVLCE

SEQ ID NO: 182953 - protein, 191 aa, Triticum aestivum
  unsure (1)..(191): unsure at all Xaa locations
  Clone ID: PAT_TA_77371.pep
REGKGREEETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANXQDLPNAMNAAEITDKLGLHSLRQRHWYIQSTCATS

SEQ ID NO: 182954 - protein, 139 aa, Triticum aestivum
  unsure (1)..(139): unsure at all Xaa locations
  Clone ID: PAT_TA_77372.pep
SVSNGGRIRCMQVWPIEGIKKFETLSYLPPLSTEALLKQVDYLIRSKWVPCLEFSKVGFIFREHNASPGYYDGXRYWTMWKLPMFGCTDATQVINEVEEVKKEYPDAYVRIIGFDNMRQVQCVSFIAFKPPGCEESGKA

SEQ ID NO: 182955 - protein, 113 aa, Triticum aestivum
  unsure (1)..(113): unsure at all Xaa locations
  Clone ID: PAT_TA_77373.pep
GMQILVKTLTGKXIXLEVEXSXDXIDNVKXKIQDKEGIPPDQQRVIFAXKXLEDGRTLADCNIQKESTLHLVLRLRGGMQIFVKTLTXKXITMEVESSDTIDNVKAKXQDKEG

SEQ ID NO: 182956 - protein, 58 aa, Triticum aestivum
  Clone ID: PAT_TA_77374.pep
LNGMARSSSDRKIACRCLKSLATSIKSINMGKVSGVPGKCGVSVPFPISMSTNCDTVN

SEQ ID NO: 182957 - protein, 134 aa, Triticum aestivum
  Clone ID: PAT_TA_77375.pep
NSWIYERRTTAKAFAKDVFINQERKLGARRRSDTVLVSTINDADQGSADVAYRTPPAPYEKSKSLGSGGSMVARLKLKGIDGRASHRRQTTQKQFAVISEYLIEHHPLLFLSLFYSPNFVCYYIWHGLVKTVEE

SEQ ID NO: 182958 - protein, 65 aa, Triticum aestivum
  unsure (1)..(65): unsure at all Xaa locations
  Clone ID: PAT_TA_77376.pep
IYAIGAGITAAAGTRLALQWILVKXLDCTHSNYQTLMRPXIVIYCHYLPVSGLGNLRACCLPWMW

SEQ ID NO: 182959 - protein, 171 aa, Triticum aestivum
  Clone ID: PAT_TA_77377.pep
ETKSIYSPVYRRQTRGLLSRAGWMERDFLGTIGHEQLQQRQRAAAEDAAARKESAYFGGGGVPPMDWSFAGRAGAAPAVMSFRSAPREELMFLASRGSLPTAPTTVTRSPDATFFTPAKLAAPEASPAKQMLAQIPQRVSPPLPAISKPMSIMSQAACLPKSTSSSNTDSA

SEQ ID NO: 182960 - protein, 118 aa, Triticum aestivum
  Clone ID: PAT_TA_77378.pep
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAK

SEQ ID NO: 182961 - protein, 164 aa, Triticum aestivum; identical to SEQ ID NO: 182739
  Clone ID: PAT_TA_77379.pep

SEQ ID NO: 182962 - protein, 176 aa, Triticum aestivum
  Clone ID: PAT_TA_77380.pep
MEGKEEDVRLGANKYSERQPIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAGVVKGFQQGLYMGNGGGANVVAPGYTK

SEQ ID NO: 182963 - protein, 173 aa, Triticum aestivum; identical to SEQ ID NO: 182615
  Clone ID: PAT_TA_77381.pep

SEQ ID NO: 182964 - protein, 41 aa, Triticum aestivum; identical to SEQ ID NO: 133945
  Clone ID: PAT_TA_77382.pep

SEQ ID NO: 182965 - protein, 291 aa, Triticum aestivum
  unsure (1)..(291): unsure at all Xaa locations
  Clone ID: PAT_TA_77383.pep
SLAXTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGXPPDQQRLIFAGKQLXEDGRTLADYNIQKESTLHLVLRLRGGXMQIFVKTLTGKTITLEVESLKXIDNVKAKIQDKEGXFPPDQQRFXFAGSXLEXDXXTLXDFNIQKGIS

SEQ ID NO: 182966 - protein, 158 aa, Triticum aestivum
  unsure (1)..(158): unsure at all Xaa locations
  Clone ID: PAT_TA_77384.pep
LSSSYLQVCRIFVKTLTGKTITLEVESSDTIDNVKAKIQDKEGIPPDQQRLIFAGKQLEDGRTLADYNIQKESTLHLVLRLRGGMQIFXKTLTGKTITLEVESSDTIDNXKAKIQDXEGIPPDQXRXILXRQSSLRMGAPLADYNXPXRESTPSWLGK

SEQ ID NO: 182967 - protein, 105 aa, Triticum aestivum
  Clone ID: PAT_TA_77385.pep
MAQKDAANGNGATTRPPPTPSPIRFSKFFQANMRILVTGGAGFIGSHLVDKLMENEKNEVIVADNFFTGSKDNLKKWIGHPRFELIRHDVTEPLLVEVDQIYHLA

SEQ ID NO: 182968 - protein, 203 aa, Triticum aestivum
  Clone ID: PAT_TA_77386.pep
GGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGVVRG

SEQ ID NO: 182969 - protein, 188 aa, Triticum aestivum
  unsure (1)..(188): unsure at all Xaa locations
  Clone ID: PAT_TA_77387.pep
MRECISIHIGXAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKXSKLGFTVYPSPQVSTSVVEPYNSV

SEQ ID NO: 182970 - protein, 197 aa, Triticum aestivum
  Clone ID: PAT_TA_77388.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEI

SEQ ID NO: 182971 - protein, 208 aa, Triticum aestivum
  Clone ID: PAT_TA_77389.pep
HFSPPPPAPIPNQGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCAT

SEQ ID NO: 182972 - protein, 267 aa, Triticum aestivum
  unsure (1)..(267): unsure at all Xaa locations
  Clone ID: PAT_TA_77390.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIXAGKQLEDGRTLADYNIQKESTLHLVLRLRGGMQIXVKTLTGKTITXEVESSDTIDNXKAKIQDKEGIXXPDQQRLIFAGKQLEDGRTLADYNIQKESTXHLVLRLRXGMQIXVKTLXGKTITXEXEXSDTIDNVXAKXQDKEGIPP

SEQ ID NO: 182973 - protein, 212 aa, Triticum aestivum
  Clone ID: PAT_TA_77391.pep
FVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVE

SEQ ID NO: 182974 - protein, 168 aa, Triticum aestivum; identical to SEQ ID NO: 124110
  Clone ID: PAT_TA_77392.pep

SEQ ID NO: 182975 - protein, 203 aa, Triticum aestivum
  unsure (1)..(203): unsure at all Xaa locations
  Clone ID: PAT_TA_77393.pep
DLLRLRRRRTHRGSSDSSDXERPAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATXGEGLYE

SEQ ID NO: 182976 - protein, 189 aa, Triticum aestivum
  unsure (1)..(189): unsure at all Xaa locations
  Clone ID: PAT_TA_77394.pep
DFDNTMGGFYIAPXFMDKLVVHLSKNFMTLPNIKMGINPIMMSAGELESGNAGEPAKLIRQRYREAADMIKKGKMCCLFINDLDAGAGRMGGTTQYTVNNQMVNATLMNIADAPTNVQLPGMYNKEENPRVPIVVTGNDFSTLYAPLIRDGRMEKFYWAPTRDDRIGVCKGIFQTDNVSDESVVKIVDT

SEQ ID NO: 182977 - protein, 163 aa, Triticum aestivum
  Clone ID: PAT_TA_77395.pep
NETPTRNYPVYFSISQKRRLKSRYCPKYREYRRSDDQYTAAHASQPGNKPEQQKAPQNKKNNKYVPEGVDWSTILHLPPSKPPSEEGAARASGRRPAARGRRDTSHCGTSSGGHPLPNEPQIRSPRSTTSRRNTGAACRRLINPCAASTARSGGRGTEGGREA

SEQ ID NO: 182978 - protein, 161 aa, Triticum aestivum; identical to SEQ ID NO: 157638
  Clone ID: PAT_TA_77396.pep

SEQ ID NO: 182979 - protein, 161 aa, Triticum aestivum; identical to SEQ ID NO: 129051
  Clone ID: PAT_TA_77397.pep

SEQ ID NO: 182980 - protein, 174 aa, Triticum aestivum; identical to SEQ ID NO: 133429
  Clone ID: PAT_TA_77398.pep

SEQ ID NO: 182981 - protein, 203 aa, Triticum aestivum
  unsure (1)..(203): unsure at all Xaa locations
  Clone ID: PAT_TA_77399.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAAAAXAXAAAA

SEQ ID NO: 182982 - protein, 129 aa, Triticum aestivum
  unsure (1)..(129): unsure at all Xaa locations
  Clone ID: PAT_TA_77400.pep
TIPWRPAVMASXATTVAPFQGLKSTAXGLPVSRRSSGSLGRVSNGGRIRCMQVWPIEGIKKFETLSYLPPLCTEALLXQVDYLIRSKWVPXXEFSKVGFVFREHNSSPGYYDGRYWTMWKLXMFGCTDA

SEQ ID NO: 182983 - protein, 175 aa, Triticum aestivum
  unsure (1)..(175): unsure at all Xaa locations
  Clone ID: PAT_TA_77401.pep
MAPTVMASSAXSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 182984 - protein, 198 aa, Triticum aestivum
  Clone ID: PAT_TA_77402.pep
RNSARGSTAAANWCYATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPA

SEQ ID NO: 182985 - protein, 107 aa, Triticum aestivum
  unsure (1)..(107): unsure at all Xaa locations
  Clone ID: PAT_TA_77403.pep
DVAAAAVVALVHAGGAGITAXAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 182986 - protein, 168 aa, Triticum aestivum; identical to SEQ ID NO: 124110
  Clone ID: PAT_TA_77404.pep

SEQ ID NO: 182987 - protein, 229 aa, Triticum aestivum
  unsure (1)..(229): unsure at all Xaa locations
  Clone ID: PAT_TA_77405.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEXESSDTIDNVKAKXQDXGGHFPPDQQRLIFAGKQLEGXXAPLAXDYNIQKESTLHLGAPP

SEQ ID NO: 182988 - protein, 285 aa, Triticum aestivum
  unsure (1)..(285): unsure at all Xaa locations
  Clone ID: PAT_TA_77406.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDTWKAKIQDKEGIPXDQQRLIFAGKQLEDGRTLADYNXQKESTLHLGAQXLRGGMQIFXKTLTGKTXTLEVESSDTXXXXKXXIQDRGGISPDXQXLXFXGXXXEDXXPW

SEQ ID NO: 182989 - protein, 161 aa, Triticum aestivum; identical to SEQ ID NO: 129051
  Clone ID: PAT_TA_77407.pep

SEQ ID NO: 182990 - protein, 303 aa, Triticum aestivum
  unsure (1)..(303): unsure at all Xaa locations
  Clone ID: PAT_TA_77408.pep
RLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLXLRGGMQIFVKTLTGKTITLEVESSDTIDNVKAKIXDKEGIPPDQQRLIXAGKQLEDGRTLADYNXQKESTLHLVXXLRGGMQIFXKTLTGKTITLEVESXSDTXDNVKAKXQDKEAXPGNQKXLIFAGKQXEDXGRTLXXLXIXXGXPLX

SEQ ID NO: 182991 - protein, 201 aa, Triticum aestivum
  Clone ID: PAT_TA_77409.pep
PIPNRGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSG

SEQ ID NO: 182992 - protein, 161 aa, Triticum aestivum; identical to SEQ ID NO: 129051
  Clone ID: PAT_TA_77410.pep

SEQ ID NO: 182993 - protein, 185 aa, Triticum aestivum
  unsure (1)..(185): unsure at all Xaa locations
  Clone ID: PAT_TA_77411.pep
ANWCYATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVXIG

SEQ ID NO: 182994 - protein, 154 aa, Triticum aestivum
  Clone ID: PAT_TA_77412.pep
ANWCYATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIG

SEQ ID NO: 182995 - protein, 185 aa, Triticum aestivum; identical to SEQ ID NO: 182872
  Clone ID: PAT_TA_77413.pep

SEQ ID NO: 182996 - protein, 229 aa, Triticum aestivum
  unsure (1)..(229): unsure at all Xaa locations
  Clone ID: PAT_TA_77414.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEVESSDTIDNVKXKIQDKEGIPPDQQRLIFAGKQLEDXXTLXDYNIQKESTLHLXLXXXXG

SEQ ID NO: 182997 - protein, 162 aa, Triticum aestivum; identical to SEQ ID NO: 182629
  Clone ID: PAT_TA_77415.pep

SEQ ID NO: 182998 - protein, 41 aa, Triticum aestivum; identical to SEQ ID NO: 133945
  Clone ID: PAT_TA_77416.pep

SEQ ID NO: 182999 - protein, 91 aa, Triticum aestivum
  unsure (1)..(91): unsure at all Xaa locations
  Clone ID: PAT_TA_77417.pep
LACHGQWVTRLALQWILVKXLDCTHSNYQTLMRPXIVIYCHYLPVSGLGNLRACCLXLDVVAVSQAPSPESNPNSPSPVTTMVGPYPTIES

SEQ ID NO: 183000 - protein, 138 aa, Triticum aestivum; identical to SEQ ID NO: 157451
  Clone ID: PAT_TA_77418.pep

SEQ ID NO: 183001 - protein, 83 aa, Triticum aestivum
  Clone ID: PAT_TA_77419.pep
AKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183002 - protein, 137 aa, Triticum aestivum; identical to SEQ ID NO: 182787
  Clone ID: PAT_TA_77420.pep

SEQ ID NO: 183003 - protein, 48 aa, Triticum aestivum
  unsure (1)..(48): unsure at all Xaa locations
  Clone ID: PAT_TA_77421.pep
IYAIGAGITAAAGTRLALQWIXVXXLDCTYXNYXTLMXPXXVIYCXYX

SEQ ID NO: 183004 - protein, 71 aa, Triticum aestivum
  Clone ID: PAT_TA_77422.pep
DPLGLADDPDTAAELKVKELKNGRLAMFSMFGFFVQAIVTGKGPVENLFDHVADPVNNNAWAFATNFAPGS

SEQ ID NO: 183005 - protein, 36 aa, Triticum aestivum
  unsure (1)..(36): unsure at all Xaa locations
  Clone ID: PAT_TA_77423.pep
SRPGQCGRXDGYILXGKELEFYMRKLQKKKGKGATA

SEQ ID NO: 183006 - protein, 38 aa, Triticum aestivum
  unsure (1)..(38): unsure at all Xaa locations
  Clone ID: PAT_TA_77424.pep
KXYPDAYVRIIXFXNMXQVQCVSFIAFKPPGCEESGKA

SEQ ID NO: 183007 - protein, 96 aa, Triticum aestivum; identical to SEQ ID NO: 117442
  unsure (1)..(96): unsure at all Xaa locations
  Clone ID: PAT_TA_77425.pep

SEQ ID NO: 183008 - protein, 113 aa, Triticum aestivum
  unsure (1)..(113): unsure at all Xaa locations
  Clone ID: PAT_TA_77426.pep
KXXXXXSXXALLKQVXYXIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 183009 - protein, 90 aa, Triticum aestivum
  unsure (1)..(90): unsure at all Xaa locations
  Clone ID: PAT_TA_77427.pep
XXXXXXXXXXXXXXXXXAXXGXXXXRYXTMXXLXMFGCTDATQVINEVXEVKKEYPDAYVRIXGFDNMRQVQCVSFIAFKPPXCEESXXX

SEQ ID NO: 183010 - protein, 135 aa, Triticum aestivum
  unsure (1)..(135): unsure at all Xaa locations
  Clone ID: PAT_TA_77428.pep
HWVVQGAVXVDIXANXXXEGGGXDEGVXXQXVKVVDIVXTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 183011 - protein, 139 aa, Triticum aestivum
  unsure (1)..(139): unsure at all Xaa locations
  Clone ID: PAT_TA_77429.pep
SVSNGGRIRCMQVWPIEGIKKFETLSYLPPLSTEXALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 183012 - protein, 139 aa, Triticum aestivum; identical to SEQ ID NO: 183011
  unsure (1)..(139): unsure at all Xaa locations
  Clone ID: PAT_TA_77430.pep

SEQ ID NO: 183013 - protein, 104 aa, Triticum aestivum
  Clone ID: PAT_TA_77431.pep
ALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 183014 - protein, 168 aa, Triticum aestivum
  unsure (1)..(168): unsure at all Xaa locations
  Clone ID: PAT_TA_77432.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGXSMHDDGGVVFAYYKEGAADPTFLYFAHGLKEVKC

SEQ ID NO: 183015 - protein, 168 aa, Triticum aestivum; identical to SEQ ID NO: 124110
  Clone ID: PAT_TA_77433.pep

SEQ ID NO: 183016 - protein, 138 aa, Triticum aestivum; identical to SEQ ID NO: 182712
  unsure (1)..(138): unsure at all Xaa locations
  Clone ID: PAT_TA_77434.pep

SEQ ID NO: 183017 - protein, 124 aa, Triticum aestivum
  unsure (1)..(124): unsure at all Xaa locations
  Clone ID: PAT_TA_77435.pep
PIXGIKKFETLSYLPPLSTEALLKQVDYXIRSKWVPCXEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 183018 - protein, 66 aa, Triticum aestivum
  unsure (1)..(66): unsure at all Xaa locations
  Clone ID: PAT_TA_77436.pep
AATEEAXKSNNVQRKLEKRQQGRTLDSHIEXQFSGXRLLACISSRPXQCGRXDGYILXGKXLXFYM

SEQ ID NO: 183019 - protein, 117 aa, Triticum aestivum
  unsure (1)..(117): unsure at all Xaa locations
  Clone ID: PAT_TA_77437.pep
MAPKAEKKPAAAXKTPAAEKTTVGKKPKAEKRXXKSKEGGADXKKKKAKKSVETYKIYIFKVLKQVHPDIGISSKAMSIMNSFINDIFEKLAGESAKLARYNKKPTITSREMXTSVR

SEQ ID NO: 183020 - protein, 139 aa, Triticum aestivum; identical to SEQ ID NO: 183011
  unsure (1)..(139): unsure at all Xaa locations
  Clone ID: PAT_TA_77438.pep

SEQ ID NO: 183021 - protein, 174 aa, Triticum aestivum
  Clone ID: PAT_TA_77439.pep
KVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 183022 - protein, 138 aa, Triticum aestivum; identical to SEQ ID NO: 157451
  Clone ID: PAT_TA_77440.pep

SEQ ID NO: 183023 - protein, 139 aa, Triticum aestivum
  Clone ID: PAT_TA_77441.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAEGQEAEVAAA

SEQ ID NO: 183024 - protein, 70 aa, Triticum aestivum
  Clone ID: PAT_TA_77442.pep
MREILHIQGGQCGNQIGAKFWEVVCDEHGIDPTGRYTGTSDLQLERVNVYYNEASCGRFVPRAVLMDLEP

SEQ ID NO: 183025 - protein, 134 aa, Triticum aestivum
  unsure (1)..(134): unsure at all Xaa locations
  Clone ID: PAT_TA_77443.pep
GKAGKXPQQXPXGAXPPSSXFMGEFRXGVQAXRTPXNKSVAAVGKAAGEXVXRAWSESEKAPYVAKANKLKXGEYNKAIAAYNKGESAAAAAPKKAAAKXGRXEEDEEESDKSKSEINDDDDDEGSDEDEDDDE

SEQ ID NO: 183026 - protein, 61 aa, Triticum aestivum
  unsure (1)..(61): unsure at all Xaa locations
  Clone ID: PAT_TA_77444.pep
GYPPGGQGGYPPAGYPPQQXRLPSTARRLPSTARDTRLHLGAYPPAPGAYPPAPGAYPPAP

SEQ ID NO: 183027 - protein, 151 aa, Triticum aestivum
  unsure (1)..(151): unsure at all Xaa locations
  Clone ID: PAT_TA_77445.pep
ALPGDNVGFNVKNVAVKXLKRGFVASNSKDDPAKEAANFTSQVIIMNHPGQXIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKV

SEQ ID NO: 183028 - protein, 95 aa, Triticum aestivum
  Clone ID: PAT_TA_77446.pep
PDHVLATNGAKQCTTHAVLDVLSCGDEVNLKPKVPTKVVCAEHLELQNEILTLLNIQWWLRISGFACLSVTSLLSKADSPFHDRAARRIKYVHAI

SEQ ID NO: 183029 - protein, 142 aa, Triticum aestivum
  Clone ID: PAT_TA_77447.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVG

SEQ ID NO: 183030 - protein, 79 aa, Triticum aestivum
  Clone ID: PAT_TA_77448.pep
RLPPLDFDWNRSQLRCLISRPAPAPSPSPWRPSGSSRSSRTCRGIPPPPAAPVIFAARSTYLLPASSTYLLPLSWKIPR

SEQ ID NO: 183031 - protein, 161 aa, Triticum aestivum; identical to SEQ ID NO: 157638
  Clone ID: PAT_TA_77449.pep

SEQ ID NO: 183032 - protein, 86 aa, Triticum aestivum
  unsure (1)..(86): unsure at all Xaa locations
  Clone ID: PAT_TA_77450.pep
GINGFGRIGRLVVRVALQSDDVELVAVNDPFITTEYMXYMFKXDTXHGHWKHSDXKLKDDKTLLFGEKPXTXFGVRNPEEXPWGEA

SEQ ID NO: 183033 - protein, 186 aa, Triticum aestivum
  unsure (1)..(186): unsure at all Xaa locations
  Clone ID: PAT_TA_77451.pep
MAPIKIGINGFGRIGRLVAXVALQSPDVELVAVNDPFITTDYMTYMFKYDTVHGQWKHHEVKVKDSKTLLFGEKEVAVFGCRNPEEIPWAAAGAEYVVESTGVXTDKDKAAAHIKGGAKKVIISAPSKDAPMFVCGVNEKEYKSDIDIVSNASCTTNCLAPLAKVINDRFGIVEGLMTTVHAMTAT

SEQ ID NO: 183034 - protein, 273 aa, Triticum aestivum
  unsure (1)..(273): unsure at all Xaa locations
  Clone ID: PAT_TA_77452.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVEXSDTIDNVKAKIQDKEGIPPDQQRLIFAGKQLEDGRTLADYNIQKESTLHLVXRLRGGMQIFVKTXTGKTITLEXEXFDTIDNVKXAKIQDKXEGIPPDQQRLXFXGKQLGGRQEPFADYNIQKEXXLPXLGLRLXREACRSLXRTFTGKNIXXXXXXXXXIXNVKGXNPXKXGIXPXQ

SEQ ID NO: 183035 - protein, 161 aa, Triticum aestivum; identical to SEQ ID NO: 109588
  Clone ID: PAT_TA_77453.pep

SEQ ID NO: 183036 - protein, 132 aa, Triticum aestivum
  unsure (1)..(132): unsure at all Xaa locations
  Clone ID: PAT_TA_77454.pep
MSTAEATREENVYMAKLAEQAERYEEMVEFMEKVAKTADVGELTVEERNLLSVAYKNVIGARRASWRIISSIEQKEESRGNEAYVASIKEYRTRIETXLXKICDGILKLXDSHLXPXXTAAXSXVXYXKMXX

SEQ ID NO: 183037 - protein, 168 aa, Triticum aestivum; identical to SEQ ID NO: 124110
  Clone ID: PAT_TA_77455.pep

SEQ ID NO: 183038 - protein, 185 aa, Triticum aestivum
  Clone ID: PAT_TA_77456.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTA

SEQ ID NO: 183039 - protein, 162 aa, Triticum aestivum
  unsure (1)..(162): unsure at all Xaa locations
  Clone ID: PAT_TA_77457.pep
GXSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAK

SEQ ID NO: 183040 - protein, 168 aa, Triticum aestivum
  Clone ID: PAT_TA_77458.pep
SARGTGEPGARRAKEEKRRSPSPARAQDSRRRDLGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLP

SEQ ID NO: 183041 - protein, 168 aa, Triticum aestivum; identical to SEQ ID NO: 124110
  Clone ID: PAT_TA_77459.pep

SEQ ID NO: 183042 - protein, 154 aa, Triticum aestivum
  unsure (1)..(154): unsure at all Xaa locations
  Clone ID: PAT_TA_77460.pep
RLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDXNIVSNASCTTNCLAPLAKIINDX

SEQ ID NO: 183043 - protein, 143 aa, Triticum aestivum
  unsure (1)..(143): unsure at all Xaa locations
  Clone ID: PAT_TA_77461.pep
PTVIDEVRTGAYRQLFHPEQLISGKEDAXANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDXEAIYDIC

SEQ ID NO: 183044 - protein, 108 aa, Triticum aestivum
  unsure (1)..(108): unsure at all Xaa locations
  Clone ID: PAT_TA_77462.pep
MASEQTFIMIKPDGVQRGLIGEVISRFEKKGFYLKGLKLQNVEKSFAEQHYADLSSKPFFAGLVEYIVSGPVXAMVWEGKSVVSTGRKIIGATNPLASEPGTIXGDFA

SEQ ID NO: 183045 - protein, 121 aa, Triticum aestivum
  unsure (1)..(121): unsure at all Xaa locations
  Clone ID: PAT_TA_77463.pep
VKNAIVQVDAAPFKQWYLXTHYGVEIGRKKKAAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 183046 - protein, 191 aa, Triticum aestivum
  Clone ID: PAT_TA_77464.pep
PTRRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183047 - protein, 169 aa, Triticum aestivum
  unsure (1)..(169): unsure at all Xaa locations
  Clone ID: PAT_TA_77465.pep
HEQLSVAEITNSAFEPSSMMAXCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGXFSEAREDLAALEKDYEEVGAEFDEGEDGDEGDEY

SEQ ID NO: 183048 - protein, 139 aa, Triticum aestivum; identical to SEQ ID NO: 183011
  unsure (1)..(139): unsure at all Xaa locations
  Clone ID: PAT_TA_77466.pep

SEQ ID NO: 183049 - protein, 108 aa, Triticum aestivum
  Clone ID: PAT_TA_77467.pep
KKKLGRWVAKEDDDAVYLKVPMPGLTKEHVEVRADKNILVIKGEGEKQPWDGDDDSAVPRYNRRIEVPAADAYKMDKIKAEMKNGVLWVTLLKVKEEERKDVFHVKVE

SEQ ID NO: 183050 - protein, 70 aa, Triticum aestivum
  unsure (1)..(70): unsure at all Xaa locations
  Clone ID: PAT_TA_77468.pep
VYLSTXLGLVRFXEVLSFESXLGPVGLVSSSRQVSLSRVSPWVASSVXQLGQWXVFKVXRSDHLGSAXXE

SEQ ID NO: 183051 - protein, 35 aa, Triticum aestivum
  Clone ID: PAT_TA_77469.pep
KQHGHYVDPSSLAWRGHRREQSWSRRSTSRPRWGS

SEQ ID NO: 183052 - protein, 137 aa, Triticum aestivum
  unsure (1)..(137): unsure at all Xaa locations
  Clone ID: PAT_TA_77470.pep
NXXXXXXXLVXXXXVQXXXAPFXQWXXXHYGVXIGXXXKXAAAAKKDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 183053 - protein, 76 aa, Triticum aestivum
  unsure (1)..(76): unsure at all Xaa locations
  Clone ID: PAT_TA_77471.pep
TPMIENVLRTLPPTYDNLWSSMPPPKTNVGKIHPLQKLLPSNVKKIKVRQILEGQDWXQTXLVXFYFFPXRHRLSR

SEQ ID NO: 183054 - protein, 50 aa, Triticum aestivum
  unsure (1)..(50): unsure at all Xaa locations
  Clone ID: PAT_TA_77472.pep
GESAKXARYNXKPTITSRXIQTSVRLVLPGELAKHXVSEGTKXVXKFTSS

SEQ ID NO: 183055 - protein, 148 aa, Triticum aestivum
  unsure (1)..(148): unsure at all Xaa locations
  Clone ID: PAT_TA_77473.pep
KCDPRHGKYMACCLMYRGDVVPKXVNAAVATIKTKRTIQFVDWCPTGFKCGINYQPPGVVPDGDLAKVQRAVCMISNSTSVVEVFXRIDHKFDXMYAKRAFVHWYVGXGMEEGEFSEXRKDLAALEKDYEEVGAEFDXGXXGXEGXEY

SEQ ID NO: 183056 - protein, 96 aa, Triticum aestivum; identical to SEQ ID NO: 117442
  unsure (1)..(96): unsure at all Xaa locations
  Clone ID: PAT_TA_77474.pep

SEQ ID NO: 183057 - protein, 200 aa, Triticum aestivum
  unsure (1)..(200): unsure at all Xaa locations
  Clone ID: PAT_TA_77475.pep
QSPDIAQGVTDXLTKRPEEIGAGDXGIMFGYXHMLATKLGARLTEVRKNGTCAWLRPDGKTQVTIEYLNEGGAMVPVRVHTVLISTQHDETVTNDEIAADLKEHVIKPVIPGKYLDENTIFHLNPSGRFVIGGPHGDAGLTGRKIIIDTYGGWGAHGGGAFSGKDPTKVDRSGAYIARQAAKSIIASGLARRCIVQISYA

SEQ ID NO: 183058 - protein, 171 aa, Triticum aestivum
  Clone ID: PAT_TA_77476.pep
MEGKEEDVRLGANKYSERQPIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAGVVKGFQQGLYMGNGGGANVVA

SEQ ID NO: 183059 - protein, 191 aa, Triticum aestivum
  Clone ID: PAT_TA_77477.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAQGPRDHAPA

SEQ ID NO: 183060 - protein, 130 aa, Triticum aestivum
  Clone ID: PAT_TA_77478.pep
AKPKPKNPLDLLPPSKMVLDDWKRLYSNTKSNFHDVAVKGFWEMYDPEGYSLWFCDYKYQEENTVSYVTLNKVGGFLQRMDLCRKYAFGKMLVIGSEAPFKVKGLWLFRGQDIPEFVMNEVYDMELYEWT

SEQ ID NO: 183061 - protein, 156 aa, Triticum aestivum; identical to SEQ ID NO: 182910
  Clone ID: PAT_TA_77479.pep

SEQ ID NO: 183062 - protein, 75 aa, Triticum aestivum; identical to SEQ ID NO: 117166
  Clone ID: PAT_TA_77480.pep

SEQ ID NO: 183063 - protein, 168 aa, Triticum aestivum; identical to SEQ ID NO: 182654
  Clone ID: PAT_TA_77481.pep

SEQ ID NO: 183064 - protein, 155 aa, Triticum aestivum
  Clone ID: PAT_TA_77482.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCY

SEQ ID NO: 183065 - protein, 121 aa, Triticum aestivum
  unsure (1)..(121): unsure at all Xaa locations
  Clone ID: PAT_TA_77483.pep
MSTAEATREENVYMAKLAEQAERYEEMVEFMEKXAKTADVGELTVEERNLLSVAYKNVIGARRASWRIISSIEQKEESRGNEAYXASIKEYRTRIETELSKICDGILKLLDSHLVPSATAA

SEQ ID NO: 183066 - protein, 92 aa, Triticum aestivum; identical to SEQ ID NO: 108506
  Clone ID: PAT_TA_77484.pep

SEQ ID NO: 183067 - protein, 102 aa, Triticum aestivum
  Clone ID: PAT_TA_77485.pep
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCT

SEQ ID NO: 183068 - protein, 187 aa, Triticum aestivum
  unsure (1)..(187): unsure at all Xaa locations
  Clone ID: PAT_TA_77486.pep
MAPIKIGINGFGRIGRLVARVALQSPDVELVAVNDPFITTDYMTYMFKYDTVHGQWKHHEVKVKDSKXTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTAT

SEQ ID NO: 183069 - protein, 285 aa, Triticum aestivum
  unsure (1)..(285): unsure at all Xaa locations
  Clone ID: PAT_TA_77487.pep
AISPKSLRSKRGEGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFXGKQLEDGRTLXADYNIQKESTXHLXLPXSXGHAKXLXKTFTGKXITLGLGLPLTMKGQNRKGGPRQ

SEQ ID NO: 183070 - protein, 179 aa, Triticum aestivum
  Clone ID: PAT_TA_77488.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKRKEKAKVSYDRRKQL

SEQ ID NO: 183071 - protein, 170 aa, Triticum aestivum
  unsure (1)..(170): unsure at all Xaa locations
  Clone ID: PAT_TA_77489.pep
MATETETFAFQAEINQLLSLIINTFYSNKEIFLRELISNSSDALDKIRFESLTDKSKLDAQPELFIHIIPDKATSTLTIVSDRVVDSPCCLVTGEYGWTANMERIMKAQALRDSSMAGYMSSKKTMEINPENAIMDELRKRADADKNDKSVKDLVMLLFETSLLTXGFSL

SEQ ID NO: 183072 - protein, 285 aa, Triticum aestivum
  unsure (1)..(285): unsure at all Xaa locations
  Clone ID: PAT_TA_77490.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRXIFAGKQLEDGRTLADYNIQKESTLHLVLRLRGGMQIFVKTLTGKTITLEVESXDTIDNVKAKIQDKEGIPXPDQQRLIFAGXSSLRMAGPLADYNXQKESTLHXXLRXRGGLQXFGKTLTGEXIXLEVXXXXTIXNGKAXXXQGGXSPGPXXFIFXGXXLXKGXPL

SEQ ID NO: 183073 - protein, 187 aa, Triticum aestivum
  Clone ID: PAT_TA_77491.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQ

SEQ ID NO: 183074 - protein, 68 aa, Triticum aestivum
  Clone ID: PAT_TA_77492.pep
MATKRSVGTLGEADLKGKKVFVRADLNVPLDDAQKITDDTRIRASIPTIKYLLEKGAKVILASHLGRP

SEQ ID NO: 183075 - protein, 304 aa, Triticum aestivum
  unsure (1)..(304): unsure at all Xaa locations
  Clone ID: PAT_TA_77493.pep
TLEVESSDTIDNVKAKIQDKEGIPPDQQRLIFAGKQLEDGRTLADYNIQKESTLHLVLRLRGGMQIXVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIATXKGEDXGQXRAFPXDQQXXIFXGKQLXEDXXTLADYNIQKESTLXLGXRLRXGMXIXGXTLTXR

SEQ ID NO: 183076 - protein, 73 aa, Triticum aestivum
  unsure (1)..(73): unsure at all Xaa locations
  Clone ID: PAT_TA_77494.pep
MSDLDVTLPSAFDPXAEANAEDAGAGPGAKDYVHVRIQQRNGRKSLTTVQGLKKEFXYNKILKDLKKEFCCNG

SEQ ID NO: 183077 - protein, 161 aa, Triticum aestivum; identical to SEQ ID NO: 129051
  Clone ID: PAT_TA_77495.pep

SEQ ID NO: 183078 - protein, 161 aa, Triticum aestivum
  Clone ID: PAT_TA_77496.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSG

SEQ ID NO: 183079 - protein, 165 aa, Triticum aestivum; identical to SEQ ID NO: 182672
  Clone ID: PAT_TA_77497.pep

SEQ ID NO: 183080 - protein, 96 aa, Triticum aestivum; identical to SEQ ID NO: 117442
  unsure (1)..(96): unsure at all Xaa locations
  Clone ID: PAT_TA_77498.pep

SEQ ID NO: 183081 - protein, 162 aa, Triticum aestivum
  Clone ID: PAT_TA_77499.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIR

SEQ ID NO: 183082 - protein, 105 aa, Triticum aestivum
  Clone ID: PAT_TA_77500.pep
HQHNMVMVFGEITTKATVDYEKIVRDTCRNIGFISDDVGLDADHCKVLVNIEQQSPDIAQGVHGHFTKRPEEIGAGDQGIMFGYATDETPELMPLTHMLATKLGA

SEQ ID NO: 183083 - protein, 90 aa, Triticum aestivum; identical to SEQ ID NO: 173870
  unsure (1)..(90): unsure at all Xaa locations
  Clone ID: PAT_TA_77501.pep

SEQ ID NO: 183084 - protein, 75 aa, Triticum aestivum
  unsure (1)..(75): unsure at all Xaa locations
  Clone ID: PAT_TA_77502.pep
MARRSGGGRSSRPAPRAAPVRNPPAPARQAPPPATTQSSGGXXMSGIGSTIAQGMAFGTGSAMAHRAADAVMGPR

SEQ ID NO: 183085 - protein, 156 aa, Triticum aestivum
  Clone ID: PAT_TA_77503.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTT

SEQ ID NO: 183086 - protein, 161 aa, Triticum aestivum; identical to SEQ ID NO: 129051
  Clone ID: PAT_TA_77504.pep

SEQ ID NO: 183087 - protein, 96 aa, Triticum aestivum; identical to SEQ ID NO: 117442
  unsure (1)..(96): unsure at all Xaa locations
  Clone ID: PAT_TA_77505.pep

SEQ ID NO: 183088 - protein, 111 aa, Triticum aestivum
  Clone ID: PAT_TA_77506.pep
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGA

SEQ ID NO: 183089 - protein, 183 aa, Triticum aestivum
  unsure (1)..(183): unsure at all Xaa locations
  Clone ID: PAT_TA_77507.pep
GIRHEDRGHSVDIVFSXWLLMYLNDEEVEKLIGRIVKWLKPGGHIFIRESCFHQSGDSKRKVNPTHYREPRFYTKVFKECHSYDQEGNSFELSLVTSKCIGAYVKSKKNQNQICWLWEKVKCTEDKGFQRFLDNVQYKSTGILRYERVFGEGYVSTGGFETTKEFVDKLDLKPMMSMSSASIF

SEQ ID NO: 183090 - protein, 161 aa, Triticum aestivum; identical to SEQ ID NO: 129051
  Clone ID: PAT_TA_77508.pep

SEQ ID NO: 183091 - protein, 41 aa, Triticum aestivum; identical to SEQ ID NO: 133945
  Clone ID: PAT_TA_77509.pep

SEQ ID NO: 183092 - protein, 153 aa, Triticum aestivum; identical to SEQ ID NO: 106678
  Clone ID: PAT_TA_77510.pep

SEQ ID NO: 183093 - protein, 177 aa, Triticum aestivum
  Clone ID: PAT_TA_77511.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEE

SEQ ID NO: 183094 - protein, 65 aa, Triticum aestivum
  unsure (1)..(65): unsure at all Xaa locations
  Clone ID: PAT_TA_77512.pep
MSAYCGKYKDELIKNAAYIGTPGKGILAADESTGTIGKRFASINVENVEDNRRALRELLFCTPXA

SEQ ID NO: 183095 - protein, 174 aa, Triticum aestivum; identical to SEQ ID NO: 181876
  Clone ID: PAT_TA_77513.pep

SEQ ID NO: 183096 - protein, 31 aa, Triticum aestivum
  Clone ID: PAT_TA_77514.pep
NKHICWVAGLLQPLTQYVLIKKQVTYNYQWQ

SEQ ID NO: 183097 - protein, 87 aa, Triticum aestivum
  unsure (1)..(87): unsure at all Xaa locations
  Clone ID: PAT_TA_77515.pep
RLLAPRLALQWILVKXLDCTHSNYQTLMRPXIVIYCHYLPVSGLGNLRACCLXLDVVAVSQAPSPESNPNSPSPVTTMVGPYPTIES

SEQ ID NO: 183098 - protein, 83 aa, Triticum aestivum
  unsure (1)..(83): unsure at all Xaa locations
  Clone ID: PAT_TA_77516.pep
RFDDSFSLASFKAYXAEFISTLIFVFAGVGSAIAYSKVSGGAPLDPSGLIAVAICHGFGLFVAVAVGANISXGHVNPAVTFGX

SEQ ID NO: 183099 - protein, 209 aa, Triticum aestivum; identical to SEQ ID NO: 179608
  Clone ID: PAT_TA_77517.pep

SEQ ID NO: 183100 - protein, 75 aa, Triticum aestivum; identical to SEQ ID NO: 106874
  Clone ID: PAT_TA_77518.pep

SEQ ID NO: 183101 - protein, 159 aa, Triticum aestivum
  Clone ID: PAT_TA_77519.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSV

SEQ ID NO: 183102 - protein, 187 aa, Triticum aestivum
  Clone ID: PAT_TA_77520.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNK

SEQ ID NO: 183103 - protein, 87 aa, Triticum aestivum; identical to SEQ ID NO: 112653
  Clone ID: PAT_TA_77521.pep

SEQ ID NO: 183104 - protein, 285 aa, Triticum aestivum
  unsure (1)..(285): unsure at all Xaa locations
  Clone ID: PAT_TA_77522.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTXHLVLRLRGGMQIFVKTLTGKXITLXEXESSDTIDXXKXKIQDKXEGIPPDXQRLILLVSSFEDXRX

SEQ ID NO: 183105 - protein, 90 aa, Triticum aestivum; identical to SEQ ID NO: 173870
  unsure (1)..(90): unsure at all Xaa locations
  Clone ID: PAT_TA_77523.pep

SEQ ID NO: 183106 - protein, 123 aa, Triticum aestivum
  Clone ID: PAT_TA_77524.pep
MSWQTYVDDHLCCEIDGQHLTSAAILGHDGSVWAESPNFPKFKPEEIAGIVKDFEEPGHLAPTGLFLGGTKYMVIQGEPGVVIRGKKGTGGITIKKTGMALILGIYDEPMTPGQCNLVVERLG

SEQ ID NO: 183107 - protein, 47 aa, Triticum aestivum
  unsure (1)..(47): unsure at all Xaa locations
  Clone ID: PAT_TA_77525.pep
QNAQGLARYAIICQENGLXPIXEPXILXDGPHDIDXXAYXTXIXLAX

SEQ ID NO: 183108 - protein, 90 aa, Triticum aestivum; identical to SEQ ID NO: 173870
  unsure (1)..(90): unsure at all Xaa locations
  Clone ID: PAT_TA_77526.pep

SEQ ID NO: 183109 - protein, 90 aa, Triticum aestivum; identical to SEQ ID NO: 173870
  unsure (1)..(90): unsure at all Xaa locations
  Clone ID: PAT_TA_77527.pep

SEQ ID NO: 183110 - protein, 112 aa, Triticum aestivum
  unsure (1)..(112): unsure at all Xaa locations
  Clone ID: PAT_TA_77528.pep
DQQRLIFAGKQLEDGRTLADYNIQKESTLHLVLRLRGGAKKRKKKTYTKPKKQKHKHKKVKLAVLQFYKVDDATGKVTRLRKECPNAECGAGTFMANHFDRHYCXKCXLTYV

SEQ ID NO: 183111 - protein, 195 aa, Triticum aestivum
  unsure (1)..(195): unsure at all Xaa locations
  Clone ID: PAT_TA_77529.pep
MGKIKIGXNGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSS

SEQ ID NO: 183112 - protein, 209 aa, Triticum aestivum
  Clone ID: PAT_TA_77530.pep
RNSEVSSSSCPDPEPGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCA

SEQ ID NO: 183113 - protein, 89 aa, Triticum aestivum
  unsure (1)..(89): unsure at all Xaa locations
  Clone ID: PAT_TA_77531.pep
ELPAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 183114 - protein, 155 aa, Triticum aestivum
  unsure (1)..(155): unsure at all Xaa locations
  Clone ID: PAT_TA_77532.pep
MVSLKLQKRLASSVLKCGKGKVWLDPNEVNEISMAXSRQNIRKLVKDGFIIRKPQKIHXSRSRARRAHEAKQKGRHXSGYGKRRGTREARLPTKILWMRRMRVLRRLLRKYREAKKIDKHMYHDMYXKVKGNMFXXKRVLMEXIHKSKAEKAREK

SEQ ID NO: 183115 - protein, 43 aa, Triticum aestivum
  unsure (1)..(43): unsure at all Xaa locations
  Clone ID: PAT_TA_77533.pep
AAAAXVFSCMGAAYGTAKSGVGVASMGVMRPELVMKSIVPVVM

SEQ ID NO: 183116 - protein, 85 aa, Triticum aestivum
  Clone ID: PAT_TA_77534.pep
VVAVKKLVVGPWAGSAGPPHGEHRPTRPFGRHRAPSLNWPGRVSGIVTLKKLECSKQAIALDTLAWDNIIGFRSYCVGLRDRSND

SEQ ID NO: 183117 - protein, 137 aa, Triticum aestivum
  Clone ID: PAT_TA_77535.pep
VDMVALSGAHTIGKAQCSNFRTRIYGGDTNINTAFATSLKANCPQSGGNTNLANLDTTTPNAFDNAYYTNLLSQKGLLHSDQVLFNNDTTDNTVRNFASNAAAFSSAFTTAMIKMGNIAPLTGTQGQIRLSCSKVNS

SEQ ID NO: 183118 - protein, 142 aa, Triticum aestivum
  Clone ID: PAT_TA_77536.pep
NKQLSMTDMVALSGAHTIGQSQCRFFRDRIYNETNINTTFATSLRANCPQSGGDSSLAPLDTQTPNGFDNAYYTNLMSQKGLLHSDQVLFNGGGADNTVRSFSSSAATFNSAFTTAMVNMGNIAPKTGTQGQIRLVCSKVNS

SEQ ID NO: 183119 - protein, 144 aa, Triticum aestivum
  Clone ID: PAT_TA_77537.pep
LKKNLNTVDMVALSGAHTIGKAQCSNFRTRIYGGDTNINTAFATSLKANCPQSGGNTNLANLDTTTPNAFDNAYYTNLLSQKGLLHSDQVLFNNDTTDNTVRNFASNAAAFSSAFTTAMIKMGNIAPLTGTQGQIRLSCSKVNS

SEQ ID NO: 183120 - protein, 54 aa, Triticum aestivum
  unsure (1)..(54): unsure at all Xaa locations
  Clone ID: PAT_TA_77538.pep
DSXIEEQFSGXRLLXCMSSRPGQCGRADGYILEGKELEXDMRKLQKKKGKGATA

SEQ ID NO: 183121 - protein, 145 aa, Triticum aestivum
  Clone ID: PAT_TA_77539.pep
FLKKNLNTVDMVALSGAHTIGKAQCSNFRTRIYGGDTNINTAFATSLKANCPQSGGNTNLANLDTTTPNAFDNAYYTNLLSQKGLLHSDQVLFNNDTTDNTVRNFASNAAAFSSAFTTAMIKMGNIAPLTGTQGQIRLSCSKVNS

SEQ ID NO: 183122 - protein, 188 aa, Triticum aestivum
  Clone ID: PAT_TA_77540.pep
SNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 183123 - protein, 171 aa, Triticum aestivum
  unsure (1)..(171): unsure at all Xaa locations
  Clone ID: PAT_TA_77541.pep
YHEQLSVAEITNXSAFEPSSMMAKCDXXHGKYMXCCLMYRGDVVPKXVXAAVATIKTKRTIQFVDWCPTGFKCGINYQPPGVVPGGDLAKVXRAVCMISNSTSVVEVFSRIDHKFDLMYAKRAFVHWYVGEGMEEGEFSEAREXLAALXKDYEEVGAEFDEGEDGDEGDEY

SEQ ID NO: 183124 - protein, 85 aa, Triticum aestivum
  Clone ID: PAT_TA_77542.pep
DLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183125 - protein, 52 aa, Triticum aestivum
  unsure (1)..(52): unsure at all Xaa locations
  Clone ID: PAT_TA_77543.pep
IEFEXKMKELXGLCXPIIAKMYQGAGADMPGGMDEDAPAASGGAGPKIEEVD

SEQ ID NO: 183126 - protein, 90 aa, Triticum aestivum
  unsure (1)..(90): unsure at all Xaa locations
  Clone ID: PAT_TA_77544.pep
QVPXDHLLPRRGLVLSQLAPAVQSPARGRFLLGLYTIVTAEAQIGGNNYYTIICGVISVKQGCMVYHLLAIDNHGAMHMSCFITVVVLYY

SEQ ID NO: 183127 - protein, 186 aa, Triticum aestivum
  Clone ID: PAT_TA_77545.pep
HFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183128 - protein, 120 aa, Triticum aestivum
  unsure (1)..(120): unsure at all Xaa locations
  Clone ID: PAT_TA_77546.pep
YQANGGGANMVASGFSRGTALGAEIVGTFVLVYTVFXPLPIGFAVFMVHLATIPITGTGINPARSLGAAVIYNKKAAWDNHWIFWVGPFVGALAAAAYHQYILRAAAIKALGSFRSSRSN

SEQ ID NO: 183129 - protein, 174 aa, Triticum aestivum
  Clone ID: PAT_TA_77547.pep
AEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183130 - protein, 107 aa, Triticum aestivum
  Clone ID: PAT_TA_77548.pep
GVEIGRKKKAAAAAKKDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 183131 - protein, 159 aa, Triticum aestivum
  Clone ID: PAT_TA_77549.pep
TVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 183132 - protein, 33 aa, Triticum aestivum
  unsure (1)..(33): unsure at all Xaa locations
  Clone ID: PAT_TA_77550.pep
XAPRGVPQITVCFDIDANGILNVSAEDKTTGQK

SEQ ID NO: 183133 - protein, 172 aa, Triticum aestivum
  unsure (1)..(172): unsure at all Xaa locations
  Clone ID: PAT_TA_77551.pep
XSTTASASLANSDLPGPSSSRSQLEAAFLKKNLNTVDMVALSGAHTIGKAQCSNFRTRIYGGXTNINTAFATSLKANCPQSGGNTNLANLDTTTPNAFDNAYYTNLLSQKGLLHSDQVLFNNDTTDNTVRNFASNAAAFSSAFTTAMIKMGNIAPLTGTQGQIRLSCSKVNS

SEQ ID NO: 183134 - protein, 111 aa, Triticum aestivum
  Clone ID: PAT_TA_77552.pep
GDTNINTAFATSLKANCPQSGGNTNLANLDTTTPNAFDNAYYTNLLSQKGLLHSDQVLFNNDTTDNTVRNFASNAAAFSSAFTTAMIKMGNIAPLTGTQGQIRLSCSKVNS

SEQ ID NO: 183135 - protein, 130 aa, Triticum aestivum
  Clone ID: PAT_TA_77553.pep
GAHTIGKAQCSNFRTRIYGGDTNINTAFATSLKANCPQSGGNTNLANLDTTTPNAFDNAYYTNLLSQKGLLHSDQVLFNNDTTDNTVRNFASNAAAFSSAFTTAMIKMGNIAPLTGTQGQIRLSCSKVNS

SEQ ID NO: 183136 - protein, 136 aa, Triticum aestivum; identical to SEQ ID NO: 117722
  Clone ID: PAT_TA_77554.pep

SEQ ID NO: 183137 - protein, 93 aa, Triticum aestivum
  unsure (1)..(93): unsure at all Xaa locations
  Clone ID: PAT_TA_77555.pep
CGXNLNNITEISTNWRSNRSQETQFYNLKFQAEMGDLSVNRTEPSPSSYATTAGGKKFSDLALMGGAPLTDQRLKPSAEEELVEVLEEGVVLD

SEQ ID NO: 183138 - protein, 144 aa, Triticum aestivum
  Clone ID: PAT_TA_77556.pep
NGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 183139 - protein, 144 aa, Triticum aestivum
  unsure (1)..(144): unsure at all Xaa locations
  Clone ID: PAT_TA_77557.pep
NGVLWEVDGHWVVQGAVDVDIGANPSAEGGGDDEGVDDQXVKVVDIVDTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 183140 - protein, 116 aa, Triticum aestivum; identical to SEQ ID NO: 134375
  Clone ID: PAT_TA_77558.pep

SEQ ID NO: 183141 - protein, 213 aa, Triticum aestivum
  unsure (1)..(213): unsure at all Xaa locations
  Clone ID: PAT_TA_77559.pep
HSPXTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPXMCN

SEQ ID NO: 183142 - protein, 91 aa, Triticum aestivum
  unsure (1)..(91): unsure at all Xaa locations
  Clone ID: PAT_TA_77560.pep
QYGQPGTRSSYHAGEXTKARTXEKTGQVMGATKDKAVQTTEATKQKAGQTTEATKQKXGEXXDATKXKAVQATEATXXXXVXTXXATXQKA

SEQ ID NO: 183143 - protein, 161 aa, Triticum aestivum; identical to SEQ ID NO: 157638
  Clone ID: PAT_TA_77561.pep

SEQ ID NO: 183144 - protein, 153 aa, Triticum aestivum
  Clone ID: PAT_TA_77562.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAK

SEQ ID NO: 183145 - protein, 188 aa, Triticum aestivum
  Clone ID: PAT_TA_77563.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACI

SEQ ID NO: 183146 - protein, 115 aa, Triticum aestivum
  Clone ID: PAT_TA_77564.pep
ARAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 183147 - protein, 116 aa, Triticum aestivum; identical to SEQ ID NO: 134375
  Clone ID: PAT_TA_77565.pep

SEQ ID NO: 183148 - protein, 101 aa, Triticum aestivum
  Clone ID: PAT_TA_77566.pep
VDIVDTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 183149 - protein, 291 aa, Triticum aestivum
  unsure (1)..(291): unsure at all Xaa locations
  Clone ID: PAT_TA_77567.pep
QGQQGXQPGQGQQGQQPGQGQPGYYPTSPQQSGQGQQPGQWQQPGQGQPGYYPTSPLQPGQGQPGYDPTSPQQPGQGQQPGQLQQPAQGQQGQQLAQGQQGQQPAQVQQGQQPAQGQQGQQLGQGQQGQQPGQGQQPAQGQQGQQPGQGQQGQQPGQGQQPGXQGQPWYYPTSPQESGQGXQPXQWQQPXGQWQQPGQGQPGYYLTSXLQLGQGQQGYYPTXCNNQGQGQQPGQWXQXGXQGNIGYYPTFPXLSGXGQRPGQWXLNQDKGQQGYYPTFSEXVGQGQQLGKW

SEQ ID NO: 183150 - protein, 184 aa, Triticum aestivum; identical to SEQ ID NO: 182669
  Clone ID: PAT_TA_77568.pep

SEQ ID NO: 183151 - protein, 92 aa, Triticum aestivum; identical to SEQ ID NO: 108506
  Clone ID: PAT_TA_77569.pep

SEQ ID NO: 183152 - protein, 218 aa, Triticum aestivum
  unsure (1)..(218): unsure at all Xaa locations
  Clone ID: PAT_TA_77570.pep
RNSARGGQGQPXYYPTSPLQSGQGQPGYYLTSPQQSGQGQQPGQLQQSAQGQKGQQPGQGQQPGQGQQGQQPGQGQQGQQPGQGQPGYYPTSPQQSGQGQQPGQWQQPGQGQPGYYPTSPLQPGQGQPGYDPTSPQQPGQGQQPGQLQQPAQGQQGQQLAQGQQGQQPXQVQQGQQPAQGQQGQXLGXKGXXGQQPGXGXQXXQGXXGXXPXQGQXXQ

SEQ ID NO: 183153 - protein, 184 aa, Triticum aestivum
  unsure (1)..(184): unsure at all Xaa locations
  Clone ID: PAT_TA_77571.pep
AVGKNXRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELV

SEQ ID NO: 183154 - protein, 264 aa, Triticum aestivum
  unsure (1)..(264): unsure at all Xaa locations
  Clone ID: PAT_TA_77572.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVEXSDTIDNXVKAKIQDKEGIPPGPAAPXLXFGKQLEDGRTLADYNIXEGSXPLHPGCSXLRGGXXXILRSLRQEHFCKFGRAPCLQSRRSPLPGL

SEQ ID NO: 183155 - protein, 116 aa, Triticum aestivum; identical to SEQ ID NO: 134375
  Clone ID: PAT_TA_77573.pep

SEQ ID NO: 183156 - protein, 159 aa, Triticum aestivum
  Clone ID: PAT_TA_77574.pep
GLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKL

SEQ ID NO: 183157 - protein, 161 aa, Triticum aestivum; identical to SEQ ID NO: 129051
  Clone ID: PAT_TA_77575.pep

SEQ ID NO: 183158 - protein, 116 aa, Triticum aestivum
  Clone ID: PAT_TA_77576.pep
MARAQVMLMAVALVLMLAAVPRAAVAIDCGHVDSLVRPCLSYVQGAPGPSGQCCDGVKNLHNQARSQSDRQSACNCLKGIARGIHNLNEDNARSIPPKCGVNLPYTISLNIDCSRV

SEQ ID NO: 183159 - protein, 126 aa, Triticum aestivum
  Clone ID: PAT_TA_77577.pep
PEQPMVTLEMCMTGLDKKKASVFFKTQADSHVSCAKEMTKLSGISDIIPEMEVCDFDFEPCGYSMNAINGSAVSTIHVTPEDGFSYASYEVMGMDASALAYGDIVKRVLRCFGPSEFSAAVTIFGG

SEQ ID NO: 183160 - protein, 111 aa, Triticum aestivum; identical to SEQ ID NO: 183088
  Clone ID: PAT_TA_77578.pep

SEQ ID NO: 183161 - protein, 45 aa, Triticum aestivum
  unsure (1)..(45): unsure at all Xaa locations
  Clone ID: PAT_TA_77579.pep
GLCXPQQLPQFEEIRNLALQTLPAMCNVYIPPYCTIVPFGIFGTN

SEQ ID NO: 183162 - protein, 206 aa, Triticum aestivum
  Clone ID: PAT_TA_77580.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAAAAPAPAPAAAAP

SEQ ID NO: 183163 - protein, 148 aa, Triticum aestivum
  Clone ID: PAT_TA_77581.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIR

SEQ ID NO: 183164 - protein, 116 aa, Triticum aestivum; identical to SEQ ID NO: 134375
  Clone ID: PAT_TA_77582.pep

SEQ ID NO: 183165 - protein, 226 aa, Triticum aestivum
  unsure (1)..(226): unsure at all Xaa locations
  Clone ID: PAT_TA_77583.pep
RPARYKVGYPRXQQRLIFAGKQLEDGRTLAXYNIQXKESTLHLVLRLRGGMQIFVKXTLTGKTITLEVESSDTIDNVKAKIQDKEGIPPDQQRLIFAGKQLEDGXTLADYNIQKESTLHLVXRLXGGMQIFVKTLTGKTITLEVESSDTIDNVKAKIQDKEGMPPDQQXRLIFAGKQLEDXXTLADYNIQKEXTLHLMXKXXXXHANFEDPYQDHPLKSLTDRKGM

SEQ ID NO: 183166 - protein, 168 aa, Triticum aestivum
  unsure (1)..(168): unsure at all Xaa locations
  Clone ID: PAT_TA_77584.pep
MLVYQXKLSGDELLSDSFPYRXLENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 183167 - protein, 106 aa, Triticum aestivum
  Clone ID: PAT_TA_77585.pep
VALVLMLAAVPRAAVAIDCGHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 183168 - protein, 169 aa, Triticum aestivum
  unsure (1)..(169): unsure at all Xaa locations
  Clone ID: PAT_TA_77586.pep
CSVPAQASDHLPARAVGSSDRARXEDVRLGANKYSERQPIGTAAQGSEDKDYKXPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAG

SEQ ID NO: 183169 - protein, 161 aa, Triticum aestivum; identical to SEQ ID NO: 129051
  Clone ID: PAT_TA_77587.pep

SEQ ID NO: 183170 - protein, 116 aa, Triticum aestivum; identical to SEQ ID NO: 134375
  Clone ID: PAT_TA_77588.pep

SEQ ID NO: 183171 - protein, 55 aa, Triticum aestivum
  unsure (1)..(55): unsure at all Xaa locations
  Clone ID: PAT_TA_77589.pep
GPRPTVDTAFKXLRQXTRRXTGGVXKPKRAPTPFFAFLAEFRPQYMEKHPEAKGV

SEQ ID NO: 183172 - protein, 196 aa, Triticum aestivum; identical to SEQ ID NO: 182921
  Clone ID: PAT_TA_77590.pep

SEQ ID NO: 183173 - protein, 195 aa, Triticum aestivum
  Clone ID: PAT_TA_77591.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGK

SEQ ID NO: 183174 - protein, 182 aa, Triticum aestivum
  unsure (1)..(182): unsure at all Xaa locations
  Clone ID: PAT_TA_77592.pep
IFAGKHXGDXRTLADYNIQKESTLHLVXRLRGGMXIFVKTLTXKTITLEVESSXTIDNVKAKIQDKEGIPPDXQRLIFAGKQLEDGRTLADYNIQKESTLHLVLRLRGGMXIXXKTLTGKTITXXVXSSXTXXNXKXXIXDKXXXPXXXXXLXXXXXXXXDXXXXXDYNXXXXXTXHXXXXX

SEQ ID NO: 183175 - protein, 44 aa, Triticum aestivum
  unsure (1)..(44): unsure at all Xaa locations
  Clone ID: PAT_TA_77593.pep
DARKLLGAKGKRFAKKRYAEKAQMKKTLKMHXXSSSRQKVDDDV

SEQ ID NO: 183176 - protein, 90 aa, Triticum aestivum; identical to SEQ ID NO: 173870
  unsure (1)..(90): unsure at all Xaa locations
  Clone ID: PAT_TA_77594.pep

SEQ ID NO: 183177 - protein, 85 aa, Triticum aestivum
  unsure (1)..(85): unsure at all Xaa locations
  Clone ID: PAT_TA_77595.pep
SGYARSHGRRTEYLRLPGPRINQLLSLIINTFYSNKEIFXRELISNSSDALDKIRXXSLTDKSKLDAQPELFIHIIPDKATSTLT

SEQ ID NO: 183178 - protein, 157 aa, Triticum aestivum
  unsure (1)..(157): unsure at all Xaa locations
  Clone ID: PAT_TA_77596.pep
ELLSDSFPYRELENGVLWEVDGHWVVQGAVDVDIGANPSAEGGGDDEGVDDQAVKVVDIVDTFRLQEQPAFDKKQFIXHMKRYIKNLTAKLEGDDLXVFKKNVESATKYLLSKLKDLQFFVGESMHDDGGVVFAYYKEGAADPTFLYFAHGLKEVKC

SEQ ID NO: 183179 - protein, 212 aa, Triticum aestivum
  Clone ID: PAT_TA_77597.pep
RNSARGGSLSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAA

SEQ ID NO: 183180 - protein, 161 aa, Triticum aestivum; identical to SEQ ID NO: 129051
  Clone ID: PAT_TA_77598.pep

SEQ ID NO: 183181 - protein, 83 aa, Triticum aestivum
  Clone ID: PAT_TA_77599.pep
SLVRPCLSYVQGGPGPSGQCCDGVKNLHNQARSQSDRQSACNCLKGIARGIHNLNEDNARSIPPKCGVNLPYTISLNIDCSRV

SEQ ID NO: 183182 - protein, 116 aa, Triticum aestivum
  Clone ID: PAT_TA_77600.pep
MARAQVMLMAVALVLMLAAVPRAAVAIDCGHVDSLVRPCLSYVQGGPSPSGQCCGGVQSLHNQAQSKSDRQAACNCLKGIARGIYNLNEDNARSLAPKCGVNLPYHISLDIDCNSV

SEQ ID NO: 183183 - protein, 124 aa, Triticum aestivum
  Clone ID: PAT_TA_77601.pep
MEHKETGCQSREGPILCVNNCGFFGSAATMNMCSKCHKEMAMKQEQAKLAASSFDSIVNGGDAAKEHLAAGNTAVAVAHVEAKTLITAQPADIAGPSEAAMENPKGPSRCSTCRKRVGLTGFNC

SEQ ID NO: 183184 - protein, 116 aa, Triticum aestivum; identical to SEQ ID NO: 134378
  Clone ID: PAT_TA_77602.pep

SEQ ID NO: 183185 - protein, 183 aa, Triticum aestivum
  unsure (1)..(183): unsure at all Xaa locations
  Clone ID: PAT_TA_77603.pep
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRXFNFKKDKDGYWK

SEQ ID NO: 183186 - protein, 164 aa, Triticum aestivum; identical to SEQ ID NO: 182770
  Clone ID: PAT_TA_77604.pep

SEQ ID NO: 183187 - protein, 128 aa, Triticum aestivum
  unsure (1)..(128): unsure at all Xaa locations
  Clone ID: PAT_TA_77605.pep
YGALLATDQEVIXARAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 183188 - protein, 199 aa, Triticum aestivum
  Clone ID: PAT_TA_77606.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKESNNVQRKLEKRQQGRTLDSHIEEQFSGGRLLACISSRPGQCGRAD

SEQ ID NO: 183189 - protein, 175 aa, Triticum aestivum
  unsure (1)..(175): unsure at all Xaa locations
  Clone ID: PAT_TA_77607.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNADCGAGTFMANHFDRHYCGKCXLTYVYNQKARWLAFALLFYLPTYRENSFR

SEQ ID NO: 183190 - protein, 109 aa, Triticum aestivum
  unsure (1)..(109): unsure at all Xaa locations
  Clone ID: PAT_TA_77608.pep
MARAQVMLMAVALVLMLAAVPRAAVAXDCGHVDSLVRPCLSYVQGGPSPSGQXCXGVQSLHNQAQSKSDRQAACNCLKGIARGXHNLNEDNXARSLAPKCGVNLPYHIR

SEQ ID NO: 183191 - protein, 107 aa, Triticum aestivum
  unsure (1)..(107): unsure at all Xaa locations
  Clone ID: PAT_TA_77609.pep
MVKAVAXLTXSEGVKGTIFFTQEGDXPTTVTGSVTGLKEGLHGFHVHALGDTTNGCMSTGPHFNPAGHVHGAPEDEIRHAGDLGNVTVGADGVANXNVTDCHIPLTG

SEQ ID NO: 183192 - protein, 168 aa, Triticum aestivum; identical to SEQ ID NO: 124110
  Clone ID: PAT_TA_77610.pep

SEQ ID NO: 183193 - protein, 116 aa, Triticum aestivum; identical to SEQ ID NO: 134375
  Clone ID: PAT_TA_77611.pep

SEQ ID NO: 183194 - protein, 184 aa, Triticum aestivum
  Clone ID: PAT_TA_77612.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRL

SEQ ID NO: 183195 - protein, 76 aa, Triticum aestivum; identical to SEQ ID NO: 106983
  Clone ID: PAT_TA_77613.pep

SEQ ID NO: 183196 - protein, 164 aa, Triticum aestivum; identical to SEQ ID NO: 182739
  Clone ID: PAT_TA_77614.pep

SEQ ID NO: 183197 - protein, 116 aa, Triticum aestivum; identical to SEQ ID NO: 134375
  Clone ID: PAT_TA_77615.pep

SEQ ID NO: 183198 - protein, 143 aa, Triticum aestivum
  unsure (1)..(143): unsure at all Xaa locations
  Clone ID: PAT_TA_77616.pep
PQQTFPQPXQQTXPHEPQQQVPQXXEQPQQPFLQPQQPFPQQPQQPFXQXXQPHQXFPQXPQQPFPAEXEQXQQPFXQQPQQPFPQTQQLXXKPFXQLQQPQQPFPQPQQQLPQPQXPQQSFPQQQRSFIQPSVXQQLNPCKN

SEQ ID NO: 183199 - protein, 161 aa, Triticum aestivum
  unsure (1)..(161): unsure at all Xaa locations
  Clone ID: PAT_TA_77617.pep
MPAGHGLRSRTRDLFARPFRKKGYIPLTTYLRTYKVGEHVDVKVNGAVHKGMPHKFYHGRTGRVCNVTKRAIGVEINKQVGNRIIKKRIHVRVEHVQPSRCNEEFLQRKLNNDKLKXEAKARGEVISTKRQPAGPKPGFMVEGTTIETVTPIPYDVVNDSQ

SEQ ID NO: 183200 - protein, 116 aa, Triticum aestivum; identical to SEQ ID NO: 134375
  Clone ID: PAT_TA_77618.pep

SEQ ID NO: 183201 - protein, 140 aa, Triticum aestivum
  unsure (1)..(140): unsure at all Xaa locations
  Clone ID: PAT_TA_77619.pep
RLASSVLKCGKGKVWLDPNEVNEXISMANSXQNIRXKLVKDGFIIRKPQKIHSRXRARRAHEAKQKGRHSGYGKRRGTREARLPTKILWMRRMRVLRRLLRKYREAKKIDKHMYHDMYLKVKGNMFKNKRVLMESIHKSK

SEQ ID NO: 183202 - protein, 115 aa, Triticum aestivum
  Clone ID: PAT_TA_77620.pep
WRAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 183203 - protein, 69 aa, Triticum aestivum
  Clone ID: PAT_TA_77621.pep
THTNTSMHIPYTEHRLSSPLLHARSTVVGSAVRASYLFPSHVHSCMQLHELHTARSRSSLTCRRRGAAA

SEQ ID NO: 183204 - protein, 286 aa, Triticum aestivum
  unsure (1)..(286): unsure at all Xaa locations
  Clone ID: PAT_TA_77622.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIXAGKQLEDGRTLADYNIQKESTLHLVLRLRGGMQIXVKTLTGKTITXEVESSDTIDNXKAKIQDKEGIXPDQQRLIFAGKQLEDGRTLADYNXQXESTXHLVLXLRGGMQIXVKTLXGRHXXPGGGSXWDTIXQRXGQXSRTREGIPPGPAGALFFAGKXXEDGPP

SEQ ID NO: 183205 - protein, 74 aa, Triticum aestivum
  unsure (1)..(74): unsure at all Xaa locations
  Clone ID: PAT_TA_77623.pep
QQXXQPFRQXXQXQXPFRXXPXQPXPQQSQQXVXQPQQPQQPFLQPQQAFPQQPQQPFPQTQQPQQPFPQQPQH

SEQ ID NO: 183206 - protein, 88 aa, Triticum aestivum
  unsure (1)..(88): unsure at all Xaa locations
  Clone ID: PAT_TA_77624.pep
CSKKPKWPPTQNQASYHAXETKAXTEEKTGQVMGATKDKAGQTTEATKQKAGETTEATKQKAAETTEAAKQKAXETAEATKQKAVEAK

SEQ ID NO: 183207 - protein, 286 aa, Triticum aestivum
  unsure (1)..(286): unsure at all Xaa locations
  Clone ID: PAT_TA_77625.pep
LIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIXVKTLTGKTIXLEVESSDTXDNVKXAKXQDKEGIXPDQQRXIFAGKQLEDGRXLADYNXQKESTLHLVXRLRXGXQIFXQTLXGXXITLXVESXPST

SEQ ID NO: 183208 - protein, 105 aa, Triticum aestivum
  Clone ID: PAT_TA_77626.pep
ALVLMLAAVPRAAVAIDCGHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 183209 - protein, 139 aa, Triticum aestivum
  Clone ID: PAT_TA_77627.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVS

SEQ ID NO: 183210 - protein, 293 aa, Triticum aestivum
  unsure (1)..(293): unsure at all Xaa locations
  Clone ID: PAT_TA_77628.pep
KGNKXQQPXXQGQQPGQGQPGYYPTSPLQSGQGQPGYYLTSPXQSGQGQQPGQLQQSAQGQKGQQPGQGQQPGQGQQGQQPGQGQXQGXQPGQGQPGYYPTSPXQXGQGQQPGQWQQPGQGQPGYYPTSPLXXGQGQPGYXPTXPXXPGQGHQPGQLXQPXQGQQGQQLAQGXQGXQPAQVQQGHQPAXGQQGXQLXQGXQGQXPGQGQQPAQGQQGXQXGQGQQGQQXGQGHQPGQGQXWDYPTSXXESGQGQQPGQWXQPGQWXQPGQGQPGYXLTXPLQXGQGQQGXYPT

SEQ ID NO: 183211 - protein, 161 aa, Triticum aestivum; identical to SEQ ID NO: 129051
  Clone ID: PAT_TA_77629.pep

SEQ ID NO: 183212 - protein, 116 aa, Triticum aestivum; identical to SEQ ID NO: 134375
  Clone ID: PAT_TA_77630.pep

SEQ ID NO: 183213 - protein, 103 aa, Triticum aestivum
  unsure (1)..(103): unsure at all Xaa locations
  Clone ID: PAT_TA_77631.pep
MAVALVLMLAAVPRAAVAIDCGHVDSLVRPCLSYVQGGPGPSGQCXYGVKNLHNQARSQSDRQSACNCLKGIARGIHNXNEDNARXIPPKCGVXLPYTISLNI

SEQ ID NO: 183214 - protein, 147 aa, Triticum aestivum
  Clone ID: PAT_TA_77632.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAA

SEQ ID NO: 183215 - protein, 155 aa, Triticum aestivum
  Clone ID: PAT_TA_77633.pep
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYF

SEQ ID NO: 183216 - protein, 292 aa, Triticum aestivum
  unsure (1)..(292): unsure at all Xaa locations
  Clone ID: PAT_TA_77634.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIXDKEGIPPDQQRLIXAGKQLEXGRTLADYNIXKESTLHLVLXLRGGMQIFVKTLTGKTITLEVESSDTIDNVKAKIXDKEGIPPDQQRLIFAGKQLEDGRTXADYNIXKESTLHLVXRLXGGMXIFVXTLTGETITLEVESFDTIDNVXQIPXQXGIPPDXQXXXFAGSNLRRHPCYKFKRLHWSG

SEQ ID NO: 183217 - protein, 116 aa, Triticum aestivum; identical to SEQ ID NO: 134375
  Clone ID: PAT_TA_77635.pep

SEQ ID NO: 183218 - protein, 116 aa, Triticum aestivum; identical to SEQ ID NO: 134375
  Clone ID: PAT_TA_77636.pep

SEQ ID NO: 183219 - protein, 116 aa, Triticum aestivum; identical to SEQ ID NO: 134378
  Clone ID: PAT_TA_77637.pep

SEQ ID NO: 183220 - protein, 116 aa, Triticum aestivum; identical to SEQ ID NO: 134375
  Clone ID: PAT_TA_77638.pep

SEQ ID NO: 183221 - protein, 116 aa, Triticum aestivum; identical to SEQ ID NO: 134378
  Clone ID: PAT_TA_77639.pep

SEQ ID NO: 183222 - protein, 116 aa, Triticum aestivum; identical to SEQ ID NO: 134378
  Clone ID: PAT_TA_77640.pep

SEQ ID NO: 183223 - protein, 98 aa, Triticum aestivum
  Clone ID: PAT_TA_77641.pep
AVPRAAVAIDCGHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 183224 - protein, 58 aa, Triticum aestivum
  Clone ID: PAT_TA_77642.pep
HEQNKIAERWLGMSTQVLKKSAIKTDYKVHDTKWHIYHLLDMKQQNSDFYSLLSSSNP

SEQ ID NO: 183225 - protein, 116 aa, Triticum aestivum
  unsure (1)..(116): unsure at all Xaa locations
  Clone ID: PAT_TA_77643.pep
MARAQVMLMAVALVLMLAAVPRAAVAIDCGHVDSLVRPCLSXVQGGPSPSGQCCGGVQSLHNQAQSKSDRQAACNCLKGIARGIHNLNEDNARSLAPKCGVNLPYHISLDIDCNSV

SEQ ID NO: 183226 - protein, 116 aa, Triticum aestivum; identical to SEQ ID NO: 134375
  Clone ID: PAT_TA_77644.pep

SEQ ID NO: 183227 - protein, 105 aa, Triticum aestivum
  unsure (1)..(105): unsure at all Xaa locations
  Clone ID: PAT_TA_77645.pep
XLVLMLASVPRAAVXIDCGHVDSLVRPCLSYVQGGPXPSGQCCDGVKNLHNQXRXQXDXQSACXCLKGIARGIXNLNEDNARSIPXKXGVNLPYTISLNIDCSRV

SEQ ID NO: 183228 - protein, 116 aa, Triticum aestivum; identical to SEQ ID NO: 134375
  Clone ID: PAT_TA_77646.pep

SEQ ID NO: 183229 - protein, 116 aa, Triticum aestivum; identical to SEQ ID NO: 134378
  Clone ID: PAT_TA_77647.pep

SEQ ID NO: 183230 - protein, 137 aa, Triticum aestivum
  unsure (1)..(137): unsure at all Xaa locations
  Clone ID: PAT_TA_77648.pep
GHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTXXLYFAHGLKEVKC

SEQ ID NO: 183231 - protein, 104 aa, Triticum aestivum
  unsure (1)..(104): unsure at all Xaa locations
  Clone ID: PAT_TA_77649.pep
LVLMLAAVPRAAVAIDCGHVDSLVRPCXSYVQGGPSPXGQCXGGVQSLHNQAQSKSDRQAACNCLKGIARGIHNLNXDNARSLAPKCGVNLPYHISLDIDCNSV

SEQ ID NO: 183232 - protein, 116 aa, Triticum aestivum; identical to SEQ ID NO: 134378
  Clone ID: PAT_TA_77650.pep

SEQ ID NO: 183233 - protein, 114 aa, Triticum aestivum
  Clone ID: PAT_TA_77651.pep
RAQVMLMAVALVLMLAAVPRAAVAIDCGHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 183234 - protein, 117 aa, Triticum aestivum
  unsure (1)..(117): unsure at all Xaa locations
  Clone ID: PAT_TA_77652.pep
PFKQWYLTHYGVEIGRKKKAAAAAKKDAAEGQESEVAAAATEEAKKSNNVQXKLEKRQQGRTLDSHIEEQFSGGRLLACISSRPGQCGRADGYILEGKELEFYMRKLQKKKGKGATA

SEQ ID NO: 183235 - protein, 70 aa, Triticum aestivum
  Clone ID: PAT_TA_77653.pep
NNVQRKLEKRQQGRTLDSHIEEQFSGGRLLACISSRPGQCGRADGYILEGKELEFYMRKLQKKKGKGATA

SEQ ID NO: 183236 - protein, 116 aa, Triticum aestivum; identical to SEQ ID NO: 134375
  Clone ID: PAT_TA_77654.pep

SEQ ID NO: 183237 - protein, 116 aa, Triticum aestivum; identical to SEQ ID NO: 134378
  Clone ID: PAT_TA_77655.pep

SEQ ID NO: 183238 - protein, 137 aa, Triticum aestivum
  Clone ID: PAT_TA_77656.pep
NELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 183239 - protein, 116 aa, Triticum aestivum; identical to SEQ ID NO: 134375
  Clone ID: PAT_TA_77657.pep

SEQ ID NO: 183240 - protein, 116 aa, Triticum aestivum; identical to SEQ ID NO: 134375
  Clone ID: PAT_TA_77658.pep

SEQ ID NO: 183241 - protein, 116 aa, Triticum aestivum; identical to SEQ ID NO: 134378
  Clone ID: PAT_TA_77659.pep

SEQ ID NO: 183242 - protein, 116 aa, Triticum aestivum
  unsure (1)..(116): unsure at all Xaa locations
  Clone ID: PAT_TA_77660.pep
MXRAQVMLMAVXLVLMLAAVPRAAVAIDCGHVDSLVRPCLSYVQGGPGPSGQCXDGVKNLHNQARSQSDRQSACNCLKGIARGIHNLNEDNARSIPPKCGVNLPYTISLNIDXSRV

SEQ ID NO: 183243 - protein, 115 aa, Triticum aestivum
  Clone ID: PAT_TA_77661.pep
MARAQVMLAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 183244 - protein, 116 aa, Triticum aestivum; identical to SEQ ID NO: 134378
  Clone ID: PAT_TA_77662.pep

SEQ ID NO: 183245 - protein, 116 aa, Triticum aestivum; identical to SEQ ID NO: 134375
  Clone ID: PAT_TA_77663.pep

SEQ ID NO: 183246 - protein, 116 aa, Triticum aestivum; identical to SEQ ID NO: 134375
  Clone ID: PAT_TA_77664.pep

SEQ ID NO: 183247 - protein, 116 aa, Triticum aestivum; identical to SEQ ID NO: 134375
  Clone ID: PAT_TA_77665.pep

SEQ ID NO: 183248 - protein, 117 aa, Triticum aestivum
  unsure (1)..(117): unsure at all Xaa locations
  Clone ID: PAT_TA_77666.pep
MARAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLXPYTISLNIDCSRV

SEQ ID NO: 183249 - protein, 116 aa, Triticum aestivum; identical to SEQ ID NO: 134375
  Clone ID: PAT_TA_77667.pep

SEQ ID NO: 183250 - protein, 168 aa, Triticum aestivum; identical to SEQ ID NO: 124109
  Clone ID: PAT_TA_77668.pep

SEQ ID NO: 183251 - protein, 116 aa, Triticum aestivum; identical to SEQ ID NO: 134375
  Clone ID: PAT_TA_77669.pep

SEQ ID NO: 183252 - protein, 102 aa, Triticum aestivum
  Clone ID: PAT_TA_77670.pep
LMLAAVPRAAVAIDCGHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 183253 - protein, 116 aa, Triticum aestivum; identical to SEQ ID NO: 134375
  Clone ID: PAT_TA_77671.pep

SEQ ID NO: 183254 - protein, 116 aa, Triticum aestivum; identical to SEQ ID NO: 134375
  Clone ID: PAT_TA_77672.pep

SEQ ID NO: 183255 - protein, 116 aa, Triticum aestivum; identical to SEQ ID NO: 134378
  Clone ID: PAT_TA_77673.pep

SEQ ID NO: 183256 - protein, 116 aa, Triticum aestivum; identical to SEQ ID NO: 134378
  Clone ID: PAT_TA_77674.pep

SEQ ID NO: 183257 - protein, 116 aa, Triticum aestivum; identical to SEQ ID NO: 134378
  Clone ID: PAT_TA_77675.pep

SEQ ID NO: 183258 - protein, 117 aa, Triticum aestivum; identical to SEQ ID NO: 124363
  unsure (1)..(117): unsure at all Xaa locations
  Clone ID: PAT_TA_77676.pep

SEQ ID NO: 183259 - protein, 117 aa, Triticum aestivum; identical to SEQ ID NO: 124363
  unsure (1)..(117): unsure at all Xaa locations
  Clone ID: PAT_TA_77677.pep

SEQ ID NO: 183260 - protein, 117 aa, Triticum aestivum; identical to SEQ ID NO: 124363
  unsure (1)..(117): unsure at all Xaa locations
  Clone ID: PAT_TA_77678.pep

SEQ ID NO: 183261 - protein, 117 aa, Triticum aestivum; identical to SEQ ID NO: 124363
  unsure (1)..(117): unsure at all Xaa locations
  Clone ID: PAT_TA_77679.pep

SEQ ID NO: 183262 - protein, 117 aa, Triticum aestivum; identical to SEQ ID NO: 175462
  unsure (1)..(117): unsure at all Xaa locations
  Clone ID: PAT_TA_77680.pep

SEQ ID NO: 183263 - protein, 116 aa, Triticum aestivum
  unsure (1)..(116): unsure at all Xaa locations
  Clone ID: PAT_TA_77681.pep
MARAQVMLMAVALVLMLAXVPRAAVAIDCGHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 183264 - protein, 116 aa, Triticum aestivum; identical to SEQ ID NO: 134375
  Clone ID: PAT_TA_77682.pep

SEQ ID NO: 183265 - protein, 117 aa, Triticum aestivum; identical to SEQ ID NO: 175462
  unsure (1)..(117): unsure at all Xaa locations
  Clone ID: PAT_TA_77683.pep

SEQ ID NO: 183266 - protein, 168 aa, Triticum aestivum; identical to SEQ ID NO: 124110
  Clone ID: PAT_TA_77684.pep

SEQ ID NO: 183267 - protein, 117 aa, Triticum aestivum; identical to SEQ ID NO: 124363
  unsure (1)..(117): unsure at all Xaa locations
  Clone ID: PAT_TA_77685.pep

SEQ ID NO: 183268 - protein, 116 aa, Triticum aestivum; identical to SEQ ID NO: 134375
  Clone ID: PAT_TA_77686.pep

SEQ ID NO: 183269 - protein, 117 aa, Triticum aestivum; identical to SEQ ID NO: 175462
  unsure (1)..(117): unsure at all Xaa locations
  Clone ID: PAT_TA_77687.pep

SEQ ID NO: 183270 - protein, 116 aa, Triticum aestivum; identical to SEQ ID NO: 134378
  Clone ID: PAT_TA_77688.pep

SEQ ID NO: 183271 - protein, 45 aa, Triticum aestivum
  unsure (1)..(45): unsure at all Xaa locations
  Clone ID: PAT_TA_77689.pep
XACXCLKGIARGIPNLNEXXARSLAPKFGVNLPYHISLDIDCNSV

SEQ ID NO: 183272 - protein, 117 aa, Triticum aestivum; identical to SEQ ID NO: 175462
  unsure (1)..(117): unsure at all Xaa locations
  Clone ID: PAT_TA_77690.pep

SEQ ID NO: 183273 - protein, 65 aa, Triticum aestivum
  unsure (1)..(65): unsure at all Xaa locations
  Clone ID: PAT_TA_77691.pep
QCCDGVKNLHNQARSQSDRQSACNCLKGIARGIHNLNXDNARSIPPKYGVNLPYTISLNIDCSRV

SEQ ID NO: 183274 - protein, 92 aa, Triticum aestivum
  unsure (1)..(92): unsure at all Xaa locations
  Clone ID: PAT_TA_77692.pep
PVIXXXHVXSLXRPCXSYVQGGPSPSGQCCXGVQSLHNQAXSKSDRQAACNCLKGIARGIHNLNEDNARSLAPKCGVNLPYHISLDIDCNSV

SEQ ID NO: 183275 - protein, 116 aa, Triticum aestivum; identical to SEQ ID NO: 134378
  Clone ID: PAT_TA_77693.pep

SEQ ID NO: 183276 - protein, 117 aa, Triticum aestivum; identical to SEQ ID NO: 124363
  unsure (1)..(117): unsure at all Xaa locations
  Clone ID: PAT_TA_77694.pep

SEQ ID NO: 183277 - protein, 116 aa, Triticum aestivum; identical to SEQ ID NO: 134375
  Clone ID: PAT_TA_77695.pep

SEQ ID NO: 183278 - protein, 117 aa, Triticum aestivum; identical to SEQ ID NO: 175462
  unsure (1)..(117): unsure at all Xaa locations
  Clone ID: PAT_TA_77696.pep

SEQ ID NO: 183279 - protein, 117 aa, Triticum aestivum; identical to SEQ ID NO: 175462
  unsure (1)..(117): unsure at all Xaa locations
  Clone ID: PAT_TA_77697.pep

SEQ ID NO: 183280 - protein, 116 aa, Triticum aestivum; identical to SEQ ID NO: 134378
  Clone ID: PAT_TA_77698.pep

SEQ ID NO: 183281 - protein, 133 aa, Triticum aestivum
  Clone ID: PAT_TA_77699.pep
VVQGAVDVDIGANPSAEGGGDDEGVDDQAVKVVDIVDTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 183282 - protein, 117 aa, Triticum aestivum; identical to SEQ ID NO: 124363
  unsure (1)..(117): unsure at all Xaa locations
  Clone ID: PAT_TA_77700.pep

SEQ ID NO: 183283 - protein, 117 aa, Triticum aestivum; identical to SEQ ID NO: 175462
  unsure (1)..(117): unsure at all Xaa locations
  Clone ID: PAT_TA_77701.pep

SEQ ID NO: 183284 - protein, 116 aa, Triticum aestivum; identical to SEQ ID NO: 134375
  Clone ID: PAT_TA_77702.pep

SEQ ID NO: 183285 - protein, 189 aa, Triticum aestivum
  Clone ID: PAT_TA_77703.pep
PRHSHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 183286 - protein, 117 aa, Triticum aestivum; identical to SEQ ID NO: 124363
  unsure (1)..(117): unsure at all Xaa locations
  Clone ID: PAT_TA_77704.pep

SEQ ID NO: 183287 - protein, 117 aa, Triticum aestivum
  unsure (1)..(117): unsure at all Xaa locations
  Clone ID: PAT_TA_77705.pep
MARAQVMLMXVALVXMLAAVPRAAVAIDCGXHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 183288 - protein, 116 aa, Triticum aestivum; identical to SEQ ID NO: 134378
  Clone ID: PAT_TA_77706.pep

SEQ ID NO: 183289 - protein, 117 aa, Triticum aestivum; identical to SEQ ID NO: 175462
  unsure (1)..(117): unsure at all Xaa locations
  Clone ID: PAT_TA_77707.pep

SEQ ID NO: 183290 - protein, 116 aa, Triticum aestivum; identical to SEQ ID NO: 134375
  Clone ID: PAT_TA_77708.pep

SEQ ID NO: 183291 - protein, 116 aa, Triticum aestivum; identical to SEQ ID NO: 134378
  Clone ID: PAT_TA_77709.pep

SEQ ID NO: 183292 - protein, 139 aa, Triticum aestivum
  Clone ID: PAT_TA_77710.pep
EVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 183293 - protein, 117 aa, Triticum aestivum; identical to SEQ ID NO: 124363
  unsure (1)..(117): unsure at all Xaa locations
  Clone ID: PAT_TA_77711.pep

SEQ ID NO: 183294 - protein, 116 aa, Triticum aestivum; identical to SEQ ID NO: 134375
  Clone ID: PAT_TA_77712.pep

SEQ ID NO: 183295 - protein, 116 aa, Triticum aestivum; identical to SEQ ID NO: 134375
  Clone ID: PAT_TA_77713.pep

SEQ ID NO: 183296 - protein, 117 aa, Triticum aestivum; identical to SEQ ID NO: 175462
  unsure (1)..(117): unsure at all Xaa locations
  Clone ID: PAT_TA_77714.pep

SEQ ID NO: 183297 - protein, 117 aa, Triticum aestivum; identical to SEQ ID NO: 124363
  unsure (1)..(117): unsure at all Xaa locations
  Clone ID: PAT_TA_77715.pep

SEQ ID NO: 183298 - protein, 34 aa, Triticum aestivum
  unsure (1)..(34): unsure at all Xaa locations
  Clone ID: PAT_TA_77716.pep
CMSNKXCXQVCQQEGWGGDNXDGPFRRCKCIRQC

SEQ ID NO: 183299 - protein, 116 aa, Triticum aestivum; identical to SEQ ID NO: 134375
  Clone ID: PAT_TA_77717.pep

SEQ ID NO: 183300 - protein, 163 aa, Triticum aestivum
  Clone ID: PAT_TA_77718.pep
DKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 183301 - protein, 62 aa, Triticum aestivum
  unsure (1)..(62): unsure at all Xaa locations
  Clone ID: PAT_TA_77719.pep
KSAKECVTTXLPNQLAPKMDGAEARDPHPAIWASAMPXLVGGRGGRCKTRGASPGGAAVGQI

SEQ ID NO: 183302 - protein, 42 aa, Triticum aestivum
  unsure (1)..(42): unsure at all Xaa locations
  Clone ID: PAT_TA_77720.pep
GNGNGIVAFAFWLALCNVLLFPPGVCLSVLQSQPVXYRVSVV

SEQ ID NO: 183303 - protein, 116 aa, Triticum aestivum; identical to SEQ ID NO: 134375
  Clone ID: PAT_TA_77721.pep

SEQ ID NO: 183304 - protein, 117 aa, Triticum aestivum; identical to SEQ ID NO: 175462
  unsure (1)..(117): unsure at all Xaa locations
  Clone ID: PAT_TA_77722.pep

SEQ ID NO: 183305 - protein, 116 aa, Triticum aestivum; identical to SEQ ID NO: 134375
  Clone ID: PAT_TA_77723.pep

SEQ ID NO: 183306 - protein, 117 aa, Triticum aestivum; identical to SEQ ID NO: 175462
  unsure (1)..(117): unsure at all Xaa locations
  Clone ID: PAT_TA_77724.pep

SEQ ID NO: 183307 - protein, 116 aa, Triticum aestivum; identical to SEQ ID NO: 134378
  Clone ID: PAT_TA_77725.pep

SEQ ID NO: 183308 - protein, 116 aa, Triticum aestivum; identical to SEQ ID NO: 134375
  Clone ID: PAT_TA_77726.pep

SEQ ID NO: 183309 - protein, 116 aa, Triticum aestivum; identical to SEQ ID NO: 134375
  Clone ID: PAT_TA_77727.pep

SEQ ID NO: 183310 - protein, 116 aa, Triticum aestivum; identical to SEQ ID NO: 134378
  Clone ID: PAT_TA_77728.pep

SEQ ID NO: 183311 - protein, 37 aa, Triticum aestivum
  unsure (1)..(37): unsure at all Xaa locations
  Clone ID: PAT_TA_77729.pep
ARLFLLKENFVKVVFQTGVIGCYLRTSRXXTFCLHSC

SEQ ID NO: 183312 - protein, 99 aa, Triticum aestivum
  unsure (1)..(99): unsure at all Xaa locations
  Clone ID: PAT_TA_77730.pep
SCRSRLPWPSTAGHVDSLVRPCXXYVQXGPGPSGQCXYGVKNLHNQARSQSDRQSACNCLKGIARGIHNLNEDNARSIPPKCGVNLPYTISLNIDCSRV

SEQ ID NO: 183313 - protein, 117 aa, Triticum aestivum; identical to SEQ ID NO: 124363
  unsure (1)..(117): unsure at all Xaa locations
  Clone ID: PAT_TA_77731.pep

SEQ ID NO: 183314 - protein, 116 aa, Triticum aestivum; identical to SEQ ID NO: 134375
  Clone ID: PAT_TA_77732.pep

SEQ ID NO: 183315 - protein, 117 aa, Triticum aestivum; identical to SEQ ID NO: 175462
  unsure (1)..(117): unsure at all Xaa locations
  Clone ID: PAT_TA_77733.pep

SEQ ID NO: 183316 - protein, 117 aa, Triticum aestivum; identical to SEQ ID NO: 124363
  unsure (1)..(117): unsure at all Xaa locations
  Clone ID: PAT_TA_77734.pep

SEQ ID NO: 183317 - protein, 117 aa, Triticum aestivum; identical to SEQ ID NO: 175462
  unsure (1)..(117): unsure at all Xaa locations
  Clone ID: PAT_TA_77735.pep

SEQ ID NO: 183318 - protein, 117 aa, Triticum aestivum; identical to SEQ ID NO: 175462
  unsure (1)..(117): unsure at all Xaa locations
  Clone ID: PAT_TA_77736.pep

SEQ ID NO: 183319 - protein, 117 aa, Triticum aestivum; identical to SEQ ID NO: 124363
  unsure (1)..(117): unsure at all Xaa locations
  Clone ID: PAT_TA_77737.pep

SEQ ID NO: 183320 - protein, 117 aa, Triticum aestivum; identical to SEQ ID NO: 124363
  unsure (1)..(117): unsure at all Xaa locations
  Clone ID: PAT_TA_77738.pep

SEQ ID NO: 183321 - protein, 117 aa, Triticum aestivum; identical to SEQ ID NO: 124363
  unsure (1)..(117): unsure at all Xaa locations
  Clone ID: PAT_TA_77739.pep

SEQ ID NO: 183322 - protein, 118 aa, Triticum aestivum
  unsure (1)..(118): unsure at all Xaa locations
  Clone ID: PAT_TA_77740.pep
AEGGGDDEGVDDQAVKVVDIVDTFRLQEQPAFXKKQFISHMKRYIKNLSAKLEGDDXDVFKKNVESATKYLLSKLKDLQFFVGESMHDDXGVVFAYYKEGAADPTFLYFAHGLKEVKC

SEQ ID NO: 183323 - protein, 104 aa, Triticum aestivum
  unsure (1)..(104): unsure at all Xaa locations
  Clone ID: PAT_TA_77741.pep
LVLMLAAVPRAAVAIDCGHVDSLVRPCXSYVQGGPSPSGQCCGGVQSLHNQAQSKSDRQAACNCLKGIARGIHNLNEDNARSLAPKCGVNLPYHISLDIDCNSV

SEQ ID NO: 183324 - protein, 117 aa, Triticum aestivum; identical to SEQ ID NO: 124363
  unsure (1)..(117): unsure at all Xaa locations
  Clone ID: PAT_TA_77742.pep

SEQ ID NO: 183325 - protein, 116 aa, Triticum aestivum; identical to SEQ ID NO: 134378
  Clone ID: PAT_TA_77743.pep

SEQ ID NO: 183326 - protein, 117 aa, Triticum aestivum
  unsure (1)..(117): unsure at all Xaa locations
  Clone ID: PAT_TA_77744.pep
MARAQVMLMAVALVXMLAAVPRAAVAIDCGXHVDSLVRPCLSYVQGGPSPSGQCCDGVXSLHNQAQSKSDRQXACNCLKGIARGIHNLNEDNARSXAPKCGVNLPYXISLXIDCXSV

SEQ ID NO: 183327 - protein, 117 aa, Triticum aestivum; identical to SEQ ID NO: 124363
  unsure (1)..(117): unsure at all Xaa locations
  Clone ID: PAT_TA_77745.pep

SEQ ID NO: 183328 - protein, 116 aa, Triticum aestivum; identical to SEQ ID NO: 134378
  Clone ID: PAT_TA_77746.pep

SEQ ID NO: 183329 - protein, 116 aa, Triticum aestivum; identical to SEQ ID NO: 134378
  Clone ID: PAT_TA_77747.pep

SEQ ID NO: 183330 - protein, 116 aa, Triticum aestivum; identical to SEQ ID NO: 134375
  Clone ID: PAT_TA_77748.pep

SEQ ID NO: 183331 - protein, 117 aa, Triticum aestivum; identical to SEQ ID NO: 175462
  unsure (1)..(117): unsure at all Xaa locations
  Clone ID: PAT_TA_77749.pep

SEQ ID NO: 183332 - protein, 116 aa, Triticum aestivum; identical to SEQ ID NO: 134378
  Clone ID: PAT_TA_77750.pep

SEQ ID NO: 183333 - protein, 116 aa, Triticum aestivum; identical to SEQ ID NO: 134375
  Clone ID: PAT_TA_77751.pep

SEQ ID NO: 183334 - protein, 116 aa, Triticum aestivum; identical to SEQ ID NO: 134378
  Clone ID: PAT_TA_77752.pep

SEQ ID NO: 183335 - protein, 165 aa, Triticum aestivum
  Clone ID: PAT_TA_77753.pep
DQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 183336 - protein, 171 aa, Triticum aestivum; identical to SEQ ID NO: 141927
  Clone ID: PAT_TA_77754.pep

SEQ ID NO: 183337 - protein, 67 aa, Triticum aestivum
  Clone ID: PAT_TA_77755.pep
LELMAKSVILAGDVSCSKYNEDPVLSVEKITKDWEGGPLFSLDGNFIGMNLFLVMERAFFLPWGVMV

SEQ ID NO: 183338 - protein, 155 aa, Triticum aestivum
  unsure (1)..(155): unsure at all Xaa locations
  Clone ID: PAT_TA_77756.pep
MDGSKAKKVAAKKFGGPRKKSVTKSIKAGLQFPVGRIGRYLKKGRYAQRVGSGAPVYLAAVLEYLAAEVLELAGNAAKDNKKTRIVPRHLLLAIRNDQEXLGRLLSGVTIAHGGVIPNINPVLLPKKAAEKAEKAGAAPKSPKKTTKSPKKATKA

SEQ ID NO: 183339 - protein, 153 aa, Triticum aestivum
  Clone ID: PAT_TA_77757.pep
KKPAAKKPAEEEPVTEKAAEKAPAAKKPKAEKRLPAGKTASKEAGGEAKTRGRKKGSKAKKGVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 183340 - protein, 215 aa, Triticum aestivum
  unsure (1)..(215): unsure at all Xaa locations
  Clone ID: PAT_TA_77758.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELEFYMRKX

SEQ ID NO: 183341 - protein, 96 aa, Triticum aestivum; identical to SEQ ID NO: 117442
  unsure (1)..(96): unsure at all Xaa locations
  Clone ID: PAT_TA_77759.pep

SEQ ID NO: 183342 - protein, 90 aa, Triticum aestivum; identical to SEQ ID NO: 173870
  unsure (1)..(90): unsure at all Xaa locations
  Clone ID: PAT_TA_77760.pep

SEQ ID NO: 183343 - protein, 96 aa, Triticum aestivum; identical to SEQ ID NO: 117442
  unsure (1)..(96): unsure at all Xaa locations
  Clone ID: PAT_TA_77761.pep

SEQ ID NO: 183344 - protein, 136 aa, Triticum aestivum; identical to SEQ ID NO: 117722
  Clone ID: PAT_TA_77762.pep

SEQ ID NO: 183345 - protein, 161 aa, Triticum aestivum; identical to SEQ ID NO: 129051
  Clone ID: PAT_TA_77763.pep

SEQ ID NO: 183346 - protein, 161 aa, Triticum aestivum; identical to SEQ ID NO: 157638
  Clone ID: PAT_TA_77764.pep

SEQ ID NO: 183347 - protein, 168 aa, Triticum aestivum; identical to SEQ ID NO: 124110
  Clone ID: PAT_TA_77765.pep

SEQ ID NO: 183348 - protein, 110 aa, Triticum aestivum
  Clone ID: PAT_TA_77766.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLL

SEQ ID NO: 183349 - protein, 183 aa, Triticum aestivum
  Clone ID: PAT_TA_77767.pep
RHEGRTHRGSSDSPDQERRAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRH

SEQ ID NO: 183350 - protein, 126 aa, Triticum aestivum
  unsure (1)..(126): unsure at all Xaa locations
  Clone ID: PAT_TA_77768.pep
MAAKCYPTVSDEYLAAVAKAKRKLRGFIAEKNCAPLMLRLAWHSAGTFDVATKTXGPFGTMKCPAELAHGANAGLDIAVRLLEPIKEQFPILSYADFYQLAGVVAVEVTGGPEVPFHPGRQDKPEP

SEQ ID NO: 183351 - protein, 142 aa, Triticum aestivum
  unsure (1)..(142): unsure at all Xaa locations
  Clone ID: PAT_TA_77769.pep
FPGRQPRXAGVIAGLNVMRIINEPTAAAIAYGLDKKATSVGEKNVLIFDLGGGTFDVSLLTIEEGIFEVKATAGDTHLGGEDFDNRMVNHFVQEFKRKHKKDISGNPRSLRRLRTSCERAKRTLSXTAQTTIEIDSLFEGVD

SEQ ID NO: 183352 - protein, 76 aa, Triticum aestivum
  Clone ID: PAT_TA_77770.pep
MSDLDVTLPSAFDPFAEANAEDAGAGPGAKDYVHVRIQQRNGRKSLTTVQGLKKEFSYNKILKDLKKEFCCNGTVV

SEQ ID NO: 183353 - protein, 74 aa, Triticum aestivum
  Clone ID: PAT_TA_77771.pep
MARRSGGGRSSRPAPRAAPVRNPPAPARPAPPPATTQSSGGGIMSGIGSTIAQGMAFGTGSAMAHRAVDAVMGP

SEQ ID NO: 183354 - protein, 160 aa, Triticum aestivum
  Clone ID: PAT_TA_77772.pep
KGAKSKGAAKADAKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 183355 - protein, 161 aa, Triticum aestivum; identical to SEQ ID NO: 126315
  Clone ID: PAT_TA_77773.pep

SEQ ID NO: 183356 - protein, 147 aa, Triticum aestivum
  Clone ID: PAT_TA_77774.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGS

SEQ ID NO: 183357 - protein, 128 aa, Triticum aestivum
  Clone ID: PAT_TA_77775.pep
DIEKMVQDAEKYKSEDEEHKKKVDAKNSLENYAYNMRNTIQDEKIASKLPADDKKKIEDAVDAAIQWLDANQLGEVDEFEDKMKELEGLCNPIIAKMYQGAGADMPGGMDEDAPAASGGAGPKIEEVD

SEQ ID NO: 183358 - protein, 89 aa, Triticum aestivum; identical to SEQ ID NO: 173274
  unsure (1)..(89): unsure at all Xaa locations
  Clone ID: PAT_TA_77776.pep

SEQ ID NO: 183359 - protein, 89 aa, Triticum aestivum; identical to SEQ ID NO: 173274
  unsure (1)..(89): unsure at all Xaa locations
  Clone ID: PAT_TA_77777.pep

SEQ ID NO: 183360 - protein, 79 aa, Triticum aestivum
  unsure (1)..(79): unsure at all Xaa locations
  Clone ID: PAT_TA_77778.pep
MKLIAAYLLAYLGGNSSPSAADVKNILDSVGAEADEEKLEFLLAELKGKDITEVIASGRXEVXAVPSGGGAIAVGAPAA

SEQ ID NO: 183361 - protein, 90 aa, Triticum aestivum; identical to SEQ ID NO: 173870
  unsure (1)..(90): unsure at all Xaa locations
  Clone ID: PAT_TA_77779.pep

SEQ ID NO: 183362 - protein, 188 aa, Triticum aestivum; identical to SEQ ID NO: 182909
  Clone ID: PAT_TA_77780.pep

SEQ ID NO: 183363 - protein, 155 aa, Triticum aestivum; identical to SEQ ID NO: 123772
  Clone ID: PAT_TA_77781.pep

SEQ ID NO: 183364 - protein, 90 aa, Triticum aestivum; identical to SEQ ID NO: 173870
  unsure (1)..(90): unsure at all Xaa locations
  Clone ID: PAT_TA_77782.pep

SEQ ID NO: 183365 - protein, 159 aa, Triticum aestivum
  Clone ID: PAT_TA_77783.pep
MAPKRGGKAPVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIEL

SEQ ID NO: 183366 - protein, 187 aa, Triticum aestivum
  Clone ID: PAT_TA_77784.pep
MAGTVPKLAARSPFIAMASAKEGNGAVTKRTTLHDLYEQQGQSPWYDNLCRPVTDLLPYIANGVRGVTSNPTIFQKAISSSNAYDGQFKELISAGKDAESAYWELVIKDIQDACKLFEPIYDETDGADGYVSVEVSPRLANDTQGTVEAAKWLHKVVNRPNVYIKIPATAECVPSIKEVIANGISVN

SEQ ID NO: 183367 - protein, 168 aa, Triticum aestivum; identical to SEQ ID NO: 124110
  Clone ID: PAT_TA_77785.pep

SEQ ID NO: 183368 - protein, 173 aa, Triticum aestivum
  Clone ID: PAT_TA_77786.pep
MAAKCYPTVSDEYLAAVAKAKRKLRGFIAEKNCAPLMLRLAWHSAGTFDVATKTGGPFGTMKCPAELAHGANAGLDIAVRLLEPIKEQFPILSYADFYQLAGVVAVEVTGGPEVPFHPGRQDKPEPPPEGRLPDATQGSDHLRQVFSTQMGLSDQDIVALSGGHTLGRCHKER

SEQ ID NO: 183369 - protein, 184 aa, Triticum aestivum; identical to SEQ ID NO: 182669
  Clone ID: PAT_TA_77787.pep

SEQ ID NO: 183370 - protein, 201 aa, Triticum aestivum
  Clone ID: PAT_TA_77788.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRLLACISSRPGQCGRADGY

SEQ ID NO: 183371 - protein, 110 aa, Triticum aestivum
  unsure (1)..(110): unsure at all Xaa locations
  Clone ID: PAT_TA_77789.pep
NVYMAKLAEQAERYEXMXEFMXKVAKTADVGELTVEERNLLSVAYKNVIGARRASWRIISSIEQKEESRGNXAYXASIKXYRTRIETELSXICDGILKLLDSHLVPSATA

SEQ ID NO: 183372 - protein, 96 aa, Triticum aestivum; identical to SEQ ID NO: 117442
  unsure (1)..(96): unsure at all Xaa locations
  Clone ID: PAT_TA_77790.pep

SEQ ID NO: 183373 - protein, 232 aa, Triticum aestivum
  unsure (1)..(232): unsure at all Xaa locations
  Clone ID: PAT_TA_77791.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMXIFVKTLTGKTITLXVESSDTIDNVKAXIQDKEGXPPDXQXXXXAXXXXXDGXTXLADYXIXXEXTPXXXXXXXRXGAW

SEQ ID NO: 183374 - protein, 76 aa, Triticum aestivum
  Clone ID: PAT_TA_77792.pep
SPGLRNSDEGDLNVIGFGLIGWLAPSSIPLINGNSLTGLFFSSIGEELAHFPSPPALQSQFWLWLVTWHLGLFIRA

SEQ ID NO: 183375 - protein, 152 aa, Triticum aestivum
  unsure (1)..(152): unsure at all Xaa locations
  Clone ID: PAT_TA_77793.pep
MATETETFAFQAEINQLLSLIINTFYSNKEIFLRELISNSSDALDKIXFESLTDKSKLDAQPELFIHIIPDKATNTLTIVDSGIGMTKSDLVNNLGTIARSGTKEFMEALAAGADVSMIGQFGVGFYSAYLVAERVVVTTKHNDDEQYVWES

SEQ ID NO: 183376 - protein, 106 aa, Triticum aestivum; identical to SEQ ID NO: 177569
  unsure (1)..(106): unsure at all Xaa locations
  Clone ID: PAT_TA_77794.pep

SEQ ID NO: 183377 - protein, 168 aa, Triticum aestivum; identical to SEQ ID NO: 124110
  Clone ID: PAT_TA_77795.pep

SEQ ID NO: 183378 - protein, 141 aa, Triticum aestivum
  unsure (1)..(141): unsure at all Xaa locations
  Clone ID: PAT_TA_77796.pep
MAPKRGGKAPVPAKKKAADKVVNPLFEKRPKQFGIGGALPPKKDLHRFVKWXKVVRIQRQRRILKQRLKVPPALHQFTRTLDKNLATNLFKMLLKYRPEDKVAXKERLLKRAXAEAEGKTVXAXKPIVVKYGLNHVTYLXE

SEQ ID NO: 183379 - protein, 217 aa, Triticum aestivum
  Clone ID: PAT_TA_77797.pep
GTGGSPGCGDSLALRSTADRCFGHHSPLTNVIQSTYSANIGSRLGSLARAFSAKPLGNEVIGIDLGTTNSCVSVMEGKNAKVIENSEGTRTTPSVVAFSQKGERLVGTPAKRQAITNPQNTFFGTKRMIGRRFDDPQTQKEMKMVPYKIVKAPNGDAWVETTDGKQYSPSQIGAFVLTKMKETAESYLGKSISKAVITVPAYFNDAQRQATKDAGRI

SEQ ID NO: 183380 - protein, 168 aa, Triticum aestivum
  Clone ID: PAT_TA_77798.pep
GKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISA

SEQ ID NO: 183381 - protein, 136 aa, Triticum aestivum; identical to SEQ ID NO: 116005
  Clone ID: PAT_TA_77799.pep

SEQ ID NO: 183382 - protein, 142 aa, Triticum aestivum
  unsure (1)..(142): unsure at all Xaa locations
  Clone ID: PAT_TA_77800.pep
MAPKAEKKPAAAEKTPAAEKXTAGKKPKAEKRPPKSKEGGADKKKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 183383 - protein, 155 aa, Triticum aestivum; identical to SEQ ID NO: 182826
  Clone ID: PAT_TA_77801.pep

SEQ ID NO: 183384 - protein, 68 aa, Triticum aestivum
  Clone ID: PAT_TA_77802.pep
KAGASIKKIPLYQHIANLAGNKQLVLPVPAFNVINGGSHAGNKLAMQEFMILPTGAASFKEAMKMGVE

SEQ ID NO: 183385 - protein, 175 aa, Triticum aestivum; identical to SEQ ID NO: 182766
  Clone ID: PAT_TA_77803.pep

SEQ ID NO: 183386 - protein, 193 aa, Triticum aestivum
  Clone ID: PAT_TA_77804.pep
GTSRLTVLFYIDSTTGGFEAGISKDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGF

SEQ ID NO: 183387 - protein, 168 aa, Triticum aestivum; identical to SEQ ID NO: 124110
  Clone ID: PAT_TA_77805.pep

SEQ ID NO: 183388 - protein, 161 aa, Triticum aestivum
  Clone ID: PAT_TA_77806.pep
MPAGHGLRSRTRDLFARPFRKKGYIPLTTYLRTYKVGEHVDVKVNGAVHKGMPHKFYHGRTGRVCNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLK

SEQ ID NO: 183389 - protein, 93 aa, Triticum aestivum
  Clone ID: PAT_TA_77807.pep
KSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 183390 - protein, 136 aa, Triticum aestivum
  unsure (1)..(136): unsure at all Xaa locations
  Clone ID: PAT_TA_77808.pep
LVRTQTLVKNAIVQVDAAPFKQXWYLTHYGVEIGRKKKAAAAAKKEAAEGQEAEVAAAATEEAKKSXNVQRKLEKRQQGRTLDSHIEEQFSGGRLLACISSRPGQCGRADGYILEGKELEFYMRKLQKKKGKGATA

SEQ ID NO: 183391 - protein, 149 aa, Triticum aestivum
  Clone ID: PAT_TA_77809.pep
AKKPAEEEPVTEKAAEKAPAAKKPKAEKRLPAGKTASKEAGGEAKTRGRKKGSKAKKGVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 183392 - protein, 99 aa, Triticum aestivum
  Clone ID: PAT_TA_77810.pep
PKASASRAPNPRRGEARRGEEAARRGRGHGSLPFQQCQHKIDTVDCQPSGPQGGVLVFVSGTITTGPGEHPLKFSQMFHLLPAGGSFYVQNDMFRLNYG

SEQ ID NO: 183393 - protein, 188 aa, Triticum aestivum
  Clone ID: PAT_TA_77811.pep
RIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183394 - protein, 163 aa, Triticum aestivum
  Clone ID: PAT_TA_77812.pep
NMRGICFEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 183395 - protein, 32 aa, Triticum aestivum
  Clone ID: PAT_TA_77813.pep
AWVSLPKGKGIKLTIIEEQRKRDAAAQAAAKA

SEQ ID NO: 183396 - protein, 179 aa, Triticum aestivum
  Clone ID: PAT_TA_77814.pep
LRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEAYDCNNVVEQELPCGGVLIYQSFAANEEVAVSAGSPRSVFHCFEAESVQSHPLVKEGKLANLLAWRAEEDSLEEGAVLCE

SEQ ID NO: 183397 - protein, 155 aa, Triticum aestivum; identical to SEQ ID NO: 182794
  unsure (1)..(155): unsure at all Xaa locations
  Clone ID: PAT_TA_77815.pep

SEQ ID NO: 183398 - protein, 176 aa, Triticum aestivum
  unsure (1)..(176): unsure at all Xaa locations
  Clone ID: PAT_TA_77816.pep
SAEKAYHEQLSVAEITNXSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183399 - protein, 159 aa, Triticum aestivum
  Clone ID: PAT_TA_77817.pep
GDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 183400 - protein, 184 aa, Triticum aestivum
  Clone ID: PAT_TA_77818.pep
MLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183401 - protein, 173 aa, Triticum aestivum
  unsure (1)..(173): unsure at all Xaa locations
  Clone ID: PAT_TA_77819.pep
KAYHEQLSVAEITNSAFEPSSMMAKCDPRHGKXYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183402 - protein, 106 aa, Triticum aestivum
  Clone ID: PAT_TA_77820.pep
WCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 183403 - protein, 120 aa, Triticum aestivum
  Clone ID: PAT_TA_77821.pep
RANPPARSSKEGRKPLTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 183404 - protein, 136 aa, Triticum aestivum; identical to SEQ ID NO: 126835
  Clone ID: PAT_TA_77822.pep

SEQ ID NO: 183405 - protein, 79 aa, Triticum aestivum
  unsure (1)..(79): unsure at all Xaa locations
  Clone ID: PAT_TA_77823.pep
DNIQGITKPXIXRLARRGGXKRISGLXYEETRGVLKIFLENVIXNAVXYTEHARRKTVTAMDVVYALKRQXRTLYGFGG

SEQ ID NO: 183406 - protein, 90 aa, Triticum aestivum; identical to SEQ ID NO: 173870
  unsure (1)..(90): unsure at all Xaa locations
  Clone ID: PAT_TA_77824.pep

SEQ ID NO: 183407 - protein, 96 aa, Triticum aestivum; identical to SEQ ID NO: 117442
  unsure (1)..(96): unsure at all Xaa locations
  Clone ID: PAT_TA_77825.pep

SEQ ID NO: 183408 - protein, 279 aa, Triticum aestivum
  unsure (1)..(279): unsure at all Xaa locations
  Clone ID: PAT_TA_77826.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITXEVESSDTIDNVKAKIQDKEGIPPDQQRLXFAGKQLEDGRTLADYNXQXESTLHLVLRLRXGMQIXVKTLXGKTITLEXSPRDTIDNVKXKIQDKXGIXPGPXAALXFAGKQX

SEQ ID NO: 183409 - protein, 206 aa, Triticum aestivum
  Clone ID: PAT_TA_77827.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEKATSSIFP

SEQ ID NO: 183410 - protein, 153 aa, Triticum aestivum; identical to SEQ ID NO: 135118
  Clone ID: PAT_TA_77828.pep

SEQ ID NO: 183411 - protein, 161 aa, Triticum aestivum; identical to SEQ ID NO: 129051
  Clone ID: PAT_TA_77829.pep

SEQ ID NO: 183412 - protein, 154 aa, Triticum aestivum; identical to SEQ ID NO: 123769
  Clone ID: PAT_TA_77830.pep

SEQ ID NO: 183413 - protein, 161 aa, Triticum aestivum; identical to SEQ ID NO: 126315
  Clone ID: PAT_TA_77831.pep

SEQ ID NO: 183414 - protein, 51 aa, Triticum aestivum
  Clone ID: PAT_TA_77832.pep
RNRRLREQQRIRKEIEEKEAREAAKMIEDLTGRGKNKKKIHIEGDMTKQHA

SEQ ID NO: 183415 - protein, 161 aa, Triticum aestivum; identical to SEQ ID NO: 129051
  Clone ID: PAT_TA_77833.pep

SEQ ID NO: 183416 - protein, 146 aa, Triticum aestivum
  Clone ID: PAT_TA_77834.pep
ADKKPAAESKVEKAAEKAPAGKKPKAEKRLPASKEAAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 183417 - protein, 162 aa, Triticum aestivum
  Clone ID: PAT_TA_77835.pep
MAPKRGGKAPVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVW

SEQ ID NO: 183418 - protein, 166 aa, Triticum aestivum
  Clone ID: PAT_TA_77836.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKD

SEQ ID NO: 183419 - protein, 194 aa, Triticum aestivum
  Clone ID: PAT_TA_77837.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPS

SEQ ID NO: 183420 - protein, 39 aa, Triticum aestivum
  Clone ID: PAT_TA_77838.pep
FFLGKIMLIYKFETAFPQKYAHCGRRSKPPRANSLFREQ

SEQ ID NO: 183421 - protein, 172 aa, Triticum aestivum
  Clone ID: PAT_TA_77839.pep
PFRTDRHSKIRTAQGVRDRRMRLSLDVARDFFALQDQLGFDKASKTVDWLLTQSKPAIDRLSESSRLNAARAGEDGMSSLSSVEREGRRLKETELAAGSGKGEADAEKAMKARGGGTSVLMEHRRENGGLMSASMTGGEYYDLGEMMCINAGECDDDGDYDEDGDFLDGMQY

SEQ ID NO: 183422 - protein, 192 aa, Triticum aestivum
  Clone ID: PAT_TA_77840.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRP

SEQ ID NO: 183423 - protein, 164 aa, Triticum aestivum
  Clone ID: PAT_TA_77841.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRA

SEQ ID NO: 183424 - protein, 161 aa, Triticum aestivum; identical to SEQ ID NO: 157638
  Clone ID: PAT_TA_77842.pep

SEQ ID NO: 183425 - protein, 66 aa, Triticum aestivum
  Clone ID: PAT_TA_77843.pep
MDGARRAKGLGMHVIAHDPYASADRARAIGVDLVSMEEAMTTADFISLHMPLTPSTNKMLNDEAFA

SEQ ID NO: 183426 - protein, 164 aa, Triticum aestivum
  Clone ID: PAT_TA_77844.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKK

SEQ ID NO: 183427 - protein, 160 aa, Triticum aestivum
  unsure (1)..(160): unsure at all Xaa locations
  Clone ID: PAT_TA_77845.pep
GRNKRTKRVAPKXDDVYLKLLVKLLVKLFMSKTNRPPLSMRRLSNFMKGKEEKNIAVVVGTITDDMRIQEVPAMKVTALRFTETARARIVNAGGECLTFDQLALRAPTGENTILLRGPKNAREAVRHFGKAPGVPHSHTKPYVRSKGRKFEKARGRRNSR

SEQ ID NO: 183428 - protein, 168 aa, Triticum aestivum
  Clone ID: PAT_TA_77846.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKRKEK

SEQ ID NO: 183429 - protein, 190 aa, Triticum aestivum
  Clone ID: PAT_TA_77847.pep
GLQIREGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEK

SEQ ID NO: 183430 - protein, 164 aa, Triticum aestivum
  Clone ID: PAT_TA_77848.pep
TRSPGHSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAQGPRDHAPAPAA

SEQ ID NO: 183431 - protein, 153 aa, Triticum aestivum
  Clone ID: PAT_TA_77849.pep
MTPKADKKPAAENKVEKAAEKTPAGKKPKAEKRLPAGKTASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 183432 - protein, 163 aa, Triticum aestivum
  Clone ID: PAT_TA_77850.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLD

SEQ ID NO: 183433 - protein, 183 aa, Triticum aestivum
  Clone ID: PAT_TA_77851.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGR

SEQ ID NO: 183434 - protein, 149 aa, Triticum aestivum; identical to SEQ ID NO: 118137
  Clone ID: PAT_TA_77852.pep

SEQ ID NO: 183435 - protein, 185 aa, Triticum aestivum
  Clone ID: PAT_TA_77853.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLL

SEQ ID NO: 183436 - protein, 48 aa, Triticum aestivum
  unsure (1)..(48): unsure at all Xaa locations
  Clone ID: PAT_TA_77854.pep
MAXGFRVLHLVRPFLAFLPEVXSADRKIPFREKVIYTVISLFIXLVCS

SEQ ID NO: 183437 - protein, 154 aa, Triticum aestivum
  unsure (1)..(154): unsure at all Xaa locations
  Clone ID: PAT_TA_77855.pep
MDGSKAKKVAAKKFGGPRKKSVTKSIKAGLQFPVGRIGRYLKKGXYSQRVGSGAPVYLAAVLEYLAAEVLELAGNAAKDNKKTRIVPRHLLLAIRNDQELGRLLSGVTIAHGGVIPNINPVLLPKKAAEKAEKAGAAPKSPKKTTKSPKKATKA

SEQ ID NO: 183438 - protein, 198 aa, Triticum aestivum
  Clone ID: PAT_TA_77856.pep
IGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIERSTNLDW

SEQ ID NO: 183439 - protein, 204 aa, Triticum aestivum
  Clone ID: PAT_TA_77857.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMIER

SEQ ID NO: 183440 - protein, 109 aa, Triticum aestivum
  Clone ID: PAT_TA_77858.pep
YAQRVGSGAPVYLAAVLEYLAAEVLELAGNAAKDNKKTRIVPRHLLLAIRNDQELGRLLSGVTIAHGGVIPNINPVLLPKKAAEKAEKAGTAAKSPKKATKSPKKATKA

SEQ ID NO: 183441 - protein, 155 aa, Triticum aestivum; identical to SEQ ID NO: 116314
  Clone ID: PAT_TA_77859.pep

SEQ ID NO: 183442 - protein, 198 aa, Triticum aestivum
  Clone ID: PAT_TA_77860.pep
RSRTRGTRREEGKGREEETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCA

SEQ ID NO: 183443 - protein, 177 aa, Triticum aestivum
  Clone ID: PAT_TA_77861.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLM

SEQ ID NO: 183444 - protein, 122 aa, Triticum aestivum
  unsure (1)..(122): unsure at all Xaa locations
  Clone ID: PAT_TA_77862.pep
CISIHIGQAGIQVGNACWELYCLEHGIQPDGQMPGDKTGGGGDDAFNTFFSETGAGKHVPRAVFVDLEPTVIDEVRTGAYRQLXHPEQXIXGKEDAXNXFXXXHYTIXKXIXXXXLXXXXXX

SEQ ID NO: 183445 - protein, 162 aa, Triticum aestivum; identical to SEQ ID NO: 182629
  Clone ID: PAT_TA_77863.pep

SEQ ID NO: 183446 - protein, 119 aa, Triticum aestivum
  unsure (1)..(119): unsure at all Xaa locations
  Clone ID: PAT_TA_77864.pep
VVEVSTSKTGKHGHAKCHFVAIDIFNGKKXEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 183447 - protein, 123 aa, Triticum aestivum
  Clone ID: PAT_TA_77865.pep
RGPPLPPPTRAAAPRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 183448 - protein, 153 aa, Triticum aestivum
  Clone ID: PAT_TA_77866.pep
MAPKAEKKPAPEKTPAGKKPAAEKRPAAGKTASKEGGEKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSAASSSFHELMAAFCV

SEQ ID NO: 183449 - protein, 183 aa, Triticum aestivum
  Clone ID: PAT_TA_77867.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATEEAKKSNNVQRKLEKRQQGRTLDSHIEEQFSGGR

SEQ ID NO: 183450 - protein, 79 aa, Triticum aestivum
  Clone ID: PAT_TA_77868.pep
HEHIRSSHVAKTIDVRKRIRLSSHQKAEYPRYSRNYQASYHQAIIRDLENASYRAIILKSTDASDKPRYPPQQRQFIHA

SEQ ID NO: 183451 - protein, 186 aa, Triticum aestivum; identical to SEQ ID NO: 182656
  Clone ID: PAT_TA_77869.pep

SEQ ID NO: 183452 - protein, 196 aa, Triticum aestivum
  Clone ID: PAT_TA_77870.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRVGVIK

SEQ ID NO: 183453 - protein, 161 aa, Triticum aestivum; identical to SEQ ID NO: 109588
  Clone ID: PAT_TA_77871.pep

SEQ ID NO: 183454 - protein, 173 aa, Triticum aestivum
  unsure (1)..(173): unsure at all Xaa locations
  Clone ID: PAT_TA_77872.pep
GXXTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVS

SEQ ID NO: 183455 - protein, 101 aa, Triticum aestivum
  unsure (1)..(101): unsure at all Xaa locations
  Clone ID: PAT_TA_77873.pep
XXIVXXFRXQXQXAFXXXQFISHXKXYIKNLSAKLEGDDLDAFKKNVESATKYLLSKLKDLQFFVGESMHDDGGVVFAYYKEGAADPTFLYFAHGLKEVKC

SEQ ID NO: 183456 - protein, 161 aa, Triticum aestivum; identical to SEQ ID NO: 157638
  Clone ID: PAT_TA_77874.pep

SEQ ID NO: 183457 - protein, 105 aa, Triticum aestivum
  Clone ID: PAT_TA_77875.pep
RSQRSGQPLLQFESESRAERNRGRKTRELVDYREAASQRDWWEKRVRIKLHKNPKLREGDAKNDIRMASSRSSSMQQRTSWRLQQVERLQCCSRGVLRTSGNYYC

SEQ ID NO: 183458 - protein, 172 aa, Triticum aestivum; identical to SEQ ID NO: 182950
  Clone ID: PAT_TA_77876.pep

SEQ ID NO: 183459 - protein, 155 aa, Triticum aestivum; identical to SEQ ID NO: 182794
  unsure (1)..(155): unsure at all Xaa locations
  Clone ID: PAT_TA_77877.pep

SEQ ID NO: 183460 - protein, 86 aa, Triticum aestivum
  unsure (1)..(86): unsure at all Xaa locations
  Clone ID: PAT_TA_77878.pep
GXXXKXQXXVCXISNSXSXVXVFSRXDHKFDXMYAKRAFVHWYVGEGMEEGEFSEAREDLAALEKDYEEVGXQFDEGEDGDEGDEY

SEQ ID NO: 183461 - protein, 62 aa, Triticum aestivum
  unsure (1)..(62): unsure at all Xaa locations
  Clone ID: PAT_TA_77879.pep
RIDHKFDLMYAKRAFVHWYVGEGMEQGEFSEAREDLXALEKDYXEVGAEFDEGEDGDEGDEY

SEQ ID NO: 183462 - protein, 155 aa, Triticum aestivum; identical to SEQ ID NO: 182794
  unsure (1)..(155): unsure at all Xaa locations
  Clone ID: PAT_TA_77880.pep

SEQ ID NO: 183463 - protein, 65 aa, Triticum aestivum
  unsure (1)..(65): unsure at all Xaa locations
  Clone ID: PAT_TA_77881.pep
KKMRTTXTCRPWRTTLVRARWRRSTKRQVCLSSDVHALHRLVVFIFSVDVGWSLYRFCGFVLAKH

SEQ ID NO: 183464 - protein, 58 aa, Triticum aestivum
  unsure (1)..(58): unsure at all Xaa locations
  Clone ID: PAT_TA_77882.pep
XXXXXXVXXXXXXXVVXXXXXLHXXXNXXXLRDAXLLVFAXNQDLPNAMNAAEITDKL

SEQ ID NO: 183465 - protein, 63 aa, Triticum aestivum
  unsure (1)..(63): unsure at all Xaa locations
  Clone ID: PAT_TA_77883.pep
SSXSTPVGTRKMVNYAXAGRSQRKLWWRLEAILTCKSFVXLGYRGERLIEPSSSWFPPKFPSG

SEQ ID NO: 183466 - protein, 96 aa, Triticum aestivum
  unsure (1)..(96): unsure at all Xaa locations
  Clone ID: PAT_TA_77884.pep
VIRREEGVVIVMPVVLRALALXRVVNARLPPPPPPPPSPYMYADDFPDLRLAIGSSGVAGNLQHPPTHTYSSYNVPVYCSGKNNRKTIPWMGSGPR

SEQ ID NO: 183467 - protein, 93 aa, Triticum aestivum
  unsure (1)..(93): unsure at all Xaa locations
  Clone ID: PAT_TA_77885.pep
CVGHQPMNVVRAISDVNTLYPFYHVGAGLSRNSVSKKKKKKRSAAATAVELQLLFPLVRVNCALGVIMVIAVSCVKLXSGSQFPQHTSRKHKV

SEQ ID NO: 183468 - protein, 170 aa, Triticum aestivum
  unsure (1)..(170): unsure at all Xaa locations
  Clone ID: PAT_TA_77886.pep
SYRIPGANPPNPSASSXAPXRXKKPAAKKPAXGXSRRRXKAEXGPGGEXKPRXEKRLPAGKTAXREGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 183469 - protein, 252 aa, Triticum aestivum
  unsure (1)..(252): unsure at all Xaa locations
  Clone ID: PAT_TA_77887.pep
WGPPPESILSNSRTXSGNFTTXGEAVAAAPNNSDTRYVIHIKAGGYFENVEVGAEKTNIMLVGDGMWRTVIKASRNVIDNYTTFRSATLAVIGTGFLARDLTVENAAGPAXHQAVALRVNADLSAFYRCSFRXYQDTLYAHSLXQFYXDCDVYGTXDFVFXDTXVVLXNCNXYARRPGPXQKNVXTXXGRXGXNQNTXITVXGLQDXXPPXDLXPGAGQPRPLEPTSRVSPRSLGAPPGWLRERDPANALFR

SEQ ID NO: 183470 - protein, 85 aa, Triticum aestivum
  Clone ID: PAT_TA_77888.pep
MSELTHINCVALTARFPVGKPVVPAALMNRPTRGERRFAYWALFRFSLTDSLRSVVRLRRAVSAHSKAVIRLSTESGDNRRKETC

SEQ ID NO: 183471 - protein, 261 aa, Triticum aestivum
  unsure (1)..(261): unsure at all Xaa locations
  Clone ID: PAT_TA_77889.pep
LGTGPPPRYRLSLIEFPGQPXTKQPGYYSTSPQQLGQGQPRYYPTSPQQPGQEQQPRQLQQPXQGQQGQQPEQGQQGQQPGQGEQGQQLGQGQQGQQPGQGQPGYYPTSXQQSGQGQPGYYPTSPQQSGQLQQPAQGQQPGQEQHGQQXPGQGQQGQQPXQGXQPGQGQPGYYPXSPXXSXXXQQLXQWXXXXXGXPGXFPXFFRCXPXQXGQPRVXXPXXXXXIXGXXAAXXEXLEQXXPGAXMXXXXXQGHQGXIXRQG

SEQ ID NO: 183472 - protein, 65 aa, Triticum aestivum
  unsure (1)..(65): unsure at all Xaa locations
  Clone ID: PAT_TA_77890.pep
FRFLRSGTRIVKPKKKKKKTVRGRHRGGAPAFVPFSEGXLRXWRNHGHSWFLXEIVIRSQFXPHT

SEQ ID NO: 183473 - protein, 68 aa, Triticum aestivum
  Clone ID: PAT_TA_77891.pep
MSELTHINCVALTARFPVGKPVVPAALMNRPTPRGEAGLPLGALPLSSLTDSLRSVVRLRAFSSLKGG

SEQ ID NO: 183474 - protein, 92 aa, Triticum aestivum
  Clone ID: PAT_TA_77892.pep
VPGPPSRSTVSISLISNSRAQPQQQLQQQLGQQPQQQQLTHGAFLQPHQIAQLEVMNSIALRNLPRMCSVNVPLYETTTSVPLGVGIGVGVY

SEQ ID NO: 183475 - protein, 216 aa, Triticum aestivum
  unsure (1)..(216): unsure at all Xaa locations
  Clone ID: PAT_TA_77893.pep
YRIPGEREREREREREREREREREREREREREREREEREREREREREREREREREEERERERERERERERERERERERXXRXAXXERERXRSPYISPLIVRPRPLFSSRLALLSVCAHMVSGFTFLVVSGGESHTQSHSSLSRWIPPASSYSLTCAFVLFSRVAVAVGLLSLGARPFIFSPPPLSELSLAPALDIGLFFLVLSWAPLPSFPCSPPF

SEQ ID NO: 183476 - protein, 94 aa, Triticum aestivum
  Clone ID: PAT_TA_77894.pep
ACKDNHELHHKKREYLRLERMASVQWEGSWSSLLGLACTFISAFRGSFHHGSRPSVSRWPRGVAHIALDLRLASYNKILRMPPAKLGTMRGTLF

SEQ ID NO: 183477 - protein, 123 aa, Triticum aestivum
  unsure (1)..(123): unsure at all Xaa locations
  Clone ID: PAT_TA_77895.pep
LRAWRNHGHSCFLCEIVIRSQFHTTYEPEAXSVXLGCLMSELTHINCVXAHCPLSSRETCRASCINESANARGEAVCVLGALPLPRSLTRCARSFGCGXAVSAHSKAVIRLSTESGDNAGKNM

SEQ ID NO: 183478 - protein, 100 aa, Triticum aestivum
  Clone ID: PAT_TA_77896.pep
GPPSESTVSISLISNSRASMLRRVSSERILEYQREIQRVKHYFEYEDLNGPVNQIWRQVSMKAPLIKLLINRNKRLVERGTNETDCSCICSTPSEISTAG

SEQ ID NO: 183479 - protein, 145 aa, Triticum aestivum
  Clone ID: PAT_TA_77897.pep
MNCSSPEVVSTPPPVNDTASEVIATPPAVNGTPPAVNGTPLQVIVMPPAVNDTPPAVNGTPPAVNGTPLQVPNFSDPSWLQDLPAPPQEPVFSFSGSSMDPVSMYVSTGPEASSDSKSLFKKGKGDGVRPSPPSVNRPAVRRGSK

SEQ ID NO: 183480 - protein, 192 aa, Triticum aestivum
  Clone ID: PAT_TA_77898.pep
HTFRQLVEAVAYMHSRGVAHRDLSLENVMLNKGKHGLDAYVIDLGVAAVNPLGPDSPTFPCPGARLASEKPGKAMYISPELWSGQDWEAYSNDVFSLGVILYCMLVGRQPFNSSIDVWAQFITSGKWMKLLQHCASGKISPSSIDPQNYNYWVAAYQHLSPTVLDLVAKLLCPMSKRYTLQQIINHPWMKQH

SEQ ID NO: 183481 - protein, 79 aa, Triticum aestivum
  Clone ID: PAT_TA_77899.pep
GSESTPVSLRLPRLAILRPIPFPRTEPNQTKPNQTAGRQAHAHQPNNTTRLLPTPPRPPRRRHSPPPPQRPSLPPSSAP

SEQ ID NO: 183482 - protein, 164 aa, Triticum aestivum
  Clone ID: PAT_TA_77900.pep
PDHIKWVFGKADERAKKFGINGVTMQLTVGVLKRVIPAVASTNAIIANSCVLETFKLLSNTALQLKNYLNFQDIDGATCNVVEVERSPDCLVCGGEQAQIMRFSTTDTFEKMLDNLKRDFHFRNPSIQAADGLLYKISDLMPQMKEISEENLKKPFAELNIFEG

SEQ ID NO: 183483 - protein, 130 aa, Triticum aestivum
  Clone ID: PAT_TA_77901.pep
MGNSYSNGGSSSGHLQAPELPLHLCFFLLVLFVFLGFSWYMSYESVAETFADQGKLLLMVSPLALLLAVRLLSGGDGDGRRVDQLMSMSMPERDSIHRAGGSPWGVGLLLVLLIVMVSYQSNFRERWFAL

SEQ ID NO: 183484 - protein, 231 aa, Triticum aestivum
  Clone ID: PAT_TA_77902.pep
CGLQPVGGMASRSANILVASAALRPPASEPPTRVFIFCPWAESIRQVHRIGHRARNCTNPLKTPPPPPPQTLRLRPPYNGCLVLLQHACTPLDQSPARILSTESPAIEKDMCRRRVATMTTTIMSVVRLALLRAEGQGTERTTARLTRRPETLLPLPPWILADAHLRHRRAPPLETSRDQDYQLCHGLASAIAAHHRSGHYRDRDYQLCHGLALWNHRRSRCQDPAVLLAG

SEQ ID NO: 183485 - protein, 77 aa, Triticum aestivum
  Clone ID: PAT_TA_77903.pep
FRLVVDVTVWLHLNAMTSPLHSSAVWFFISVGICFFSWMLFCASISCLMSHICERSSLSLILCFLSILTFIQPTWTI

SEQ ID NO: 183486 - protein, 160 aa, Triticum aestivum
  Clone ID: PAT_TA_77904.pep
MVVCVEGLGVPRRSGMFGHALNAVTFVSEEKIAAKLEHLKKTFRWSDAEVRIAISKAPMVLNRAKEFLQRKSEFLISDLGLEPAYIAHRPVMLLYSLEGRLRPRCYVVKFLKANGLLGPDRDLYSAVALSEKLFIEKYICPHKEAAPCLAEDYADACKGL

SEQ ID NO: 183487 - protein, 201 aa, Triticum aestivum
  unsure (1)..(201): unsure at all Xaa locations
  Clone ID: PAT_TA_77905.pep
RALLNPVQIQAVPVGSMSPRRKSLESCRRTFFFQREGAALKRSDDRSPGCVDPQAPRSPGHSARRVNRTGSRVARITPSHCTPARLHVAPRAQPQLLIRIETEGDERLPPVHLRIHDRGRSRKLAPTSPPLISHLSAAGLFVAVGRRLGCVLRGATPRSSLLPLAPXTSFAPVSVECTPCSSRCPASARTPAAAPAARAPR

SEQ ID NO: 183488 - protein, 58 aa, Triticum aestivum
  Clone ID: PAT_TA_77906.pep
MSSSYGGVCSGGTMSGFLGSYYSFPSSSVSVATVPSSSSASSAPGHYYSSPHDSQQQQ

SEQ ID NO: 183489 - protein, 251 aa, Triticum aestivum
  Clone ID: PAT_TA_77907.pep
TLFLSLLLLSLSLSISCRTAEEWRTRSIYQIITDRFARTDKEATPCSDLGNYCGGTFKGIENNLDYIQGMGFDAIWISPVVANTPGGYHGYWVSNLYTINEEFGTEEELHQLIEACHARDIWVMVDVVANHIGYVQNLDFSAIVPFNDIAYFNEDKDCAPFFEIMDQDGIETCWLSGLPDLNQNHPFVKSTLIAWIKEFVQKHKFDALRIDTIAHVPKQFWHEFSKAAGVYTIGEALNHNMHYISQYQGPL

SEQ ID NO: 183490 - protein, 92 aa, Triticum aestivum
  Clone ID: PAT_TA_77908.pep
LMYSFVRSFGLLPLLCVTHLHSILNWIGVMCLDEFCDTFPIWKEIQHKPLVRSTDNLRVLSEPWRWFVKSLNTVGSFHHCYGVTACPSFTKD

SEQ ID NO: 183491 - protein, 162 aa, Triticum aestivum
  Clone ID: PAT_TA_77909.pep
IMGSMQWLSQKGKGLCAEYDGKCGIISIFALQIDHNTDPVDLIIYLFPKFRTNADTDEKHESPARFADTKMCFHDENCCEVTLNDSQKEKKDPSIMEAEDTQLDNTLITHSHFIVKAKGSRSMKHARIDVMMKTQCSPQLIMGAMDWLSQKAQGLCAEYDGQ

SEQ ID NO: 183492 - protein, 53 aa, Triticum aestivum
  Clone ID: PAT_TA_77910.pep
MGNKKGGSSWLTAVKRAFRSPSKEDSPKKSARLREDPDADEDKTKRERRRWLF

SEQ ID NO: 183493 - protein, 173 aa, Triticum aestivum
  Clone ID: PAT_TA_77911.pep
RAALTCRASLRAVRSSPAFRRRFRELHSAPLLGVFLDVFESDTPAFRPLRLHSDPDLAAAVRGGDFHLTRLPDEIEGVAPEWLIQDCHDGRVVLASYKTGHMAVYDPLTRALDLFPRPPGEICEDMYVEYHVLPSDEERGPFRVICVCHEACGAQAAVLSSETGEWQVFPFVE

SEQ ID NO: 183494 - protein, 78 aa, Triticum aestivum
  Clone ID: PAT_TA_77912.pep
WYLPSSIGNLSHLQTLDIKGTHIYELPATITKLRKLQYLRTTGVPIGAEKEDAMFDYELVQRSIGCRLLVFQQAIFLL

SEQ ID NO: 183495 - protein, 57 aa, Triticum aestivum
  Clone ID: PAT_TA_77913.pep
MALEEAAPGGGGGGGIRVLLRRKQVDSDRARAAGGQQLAKELSITQLIVIGVGSTVG

SEQ ID NO: 183496 - protein, 158 aa, Triticum aestivum
  Clone ID: PAT_TA_77914.pep
MASSLLRASPLSLLSRLRPLSRRPPASHLRCLLLLSGSASAPSRSTPTPRTLAAATDAATPPEEAAAPPAAEARLERMQPLQWPQRDALCGELGAGDAGRRVRLCGWVALRRSHAGLTFLTLRDSSGMVQVTTLPEYPEVYAVVNKLRVESVVSVEGV

SEQ ID NO: 183497 - protein, 220 aa, Triticum aestivum
  Clone ID: PAT_TA_77915.pep
LHHVAGALPHRALMQLSRRHGQLMHLMLGEVPAVVVSSPEAAALVMKTNDLAFAGRPRGVMLDIFSSGGRGIAFAPYGNHLRQMRKVCVMELLSSTQVKRMEGIRAEEVGSLLRDIRAATSVGHTINVSEKVRALSNDVVTRAVFGGKFSQQGEYLCELDKAFKLLGGFCLVDLFPSSRLVRWLSNGERQMKKSCGQMQRIISEIIDERKSARAAGVGIS

SEQ ID NO: 183498 - protein, 201 aa, Triticum aestivum
  Clone ID: PAT_TA_77916.pep
LKPRKFDIADSNIANLGSDLEKKVKHAAAETEDAWKGAGQQIGIQIWRIEKFKVVPWPEKQYGKFYTGDSYILLRTYKKTPDSEKLSFDVHFWIGSKSTQDEYGTAAYKTVELDDYLNGDPVQHREIQGYESELFCSYFKAIEFLEGGVDSGFKHVEAKEHKNRLLHLKGKKNIVVREVPMTTDSLNCGDVFVLDAGLDIY

SEQ ID NO: 183499 - protein, 122 aa, Triticum aestivum
  unsure (1)..(122): unsure at all Xaa locations
  Clone ID: PAT_TA_77917.pep
PKLVVPEGISKKQYKKQLKTERYXQKKLVRRAEEKLKRKEKKAKLKAEGRGNELAGRRKHNKMANSTSKQRIAVDMQFDNLMIGRDQNRTIIQLSWCYSINRRADNPLQFYLAHFDGESKKY

SEQ ID NO: 183500 - protein, 217 aa, Triticum aestivum
  Clone ID: PAT_TA_77918.pep
MTEMQRNSAERWVTQMVRKSQKEALGTVTGQDSTDDVGPGGDTTCSAGENRYPDWPGTTVFRMLISATKLGPIIGYKGERVRRLCEETKACIRIIGGHLAGAERAVIIFAKEQPDELIPPAMDALLRVYQHIIYDDGLNMGSDSTVVARILIPSEQAVSLIGEQGLMIYSIEEASKTNIYVLDCDLPPVAIEEDRIVEIWGQPARVRKALELVASHL

SEQ ID NO: 183501 - protein, 68 aa, Triticum aestivum
  Clone ID: PAT_TA_77919.pep
DECTHFSLVAQSPIQNYATLKIHVFFLVISCLSKYRRQEFRSLCRKKIYFGVCLETHISVQKNTYLWS

SEQ ID NO: 183502 - protein, 202 aa, Triticum aestivum
  Clone ID: PAT_TA_77920.pep
MGFLSLVGNSFGCSASGERLVSAARDGDLQEARALLEYNPRLARYSTFGGRNSPLHYAAAQGHHEIVSLLLESGVEINLRNYRGQTALMQACQYGHWEVVQTLMLFNANIHRTDYLNGGTAIHFAALHGHARCLRLVLADYVPSIPNFLNQTNHRSTEEVSDADFDDDGLVKMVNWKADGGLTPLHMAALNGHVECVQLLLD

SEQ ID NO: 183503 - protein, 247 aa, Triticum aestivum
  Clone ID: PAT_TA_77921.pep
SPVISTVGLASNTHPPHKAGERERLSVRCIKTRSCRVREEQEEHRTGERKKERKKRSSRLLCSAQAGLFCAVKPSALKQGSQEHKESPYWEWEIEAARLSAWRSRMEEASSSSGHPRHRGPPPHHVLGYGGFHAAMAMPTNSMPPAAFFSEQDGGGGGGGGAYFGELEEALMHQVATLSSNGRMISHSHSQQQTATATSTDHPHHHHHHHHGHNHAMPFPSTVADTATAAAAAARPPPTLDIFPSWP

SEQ ID NO: 183504 - protein, 193 aa, Triticum aestivum
  Clone ID: PAT_TA_77922.pep
MASVSSLDKDLAKLRLGKYTVQASNEAKSWIESTLGEQLPADDLMDALHDGTVLCRLANKLVPNSTKPKKSEMPFVQMENIAMFLKVCQDVLKLSQHDLFLTVDLYDFKDPAQVLQTIGAFSRIAHSQNPSAFPTAIGPKASVISPSGTGKSKPPVPAKTAVSSWSKPVDELTTAPAWNIHQYGYMGGASQGT

SEQ ID NO: 183505 - protein, 66 aa, Triticum aestivum
  Clone ID: PAT_TA_77923.pep
WAGPDRIASGVASIVLRNKRQIGNSLLSQFAQRRNCCCTETPSASRTYKKTLPHKIKLLTHVSLHY

SEQ ID NO: 183506 - protein, 64 aa, Triticum aestivum
  Clone ID: PAT_TA_77924.pep
LCLMLLSMKLHSTEWILTLADSHRMNKQLDGAQKTEKSGYSMITIVLVHSCSSILLMVVSVVEP

SEQ ID NO: 183507 - protein, 152 aa, Triticum aestivum
  Clone ID: PAT_TA_77925.pep
LLLFNYNWSEFVSLLASFLTGASGAELGSGAHSRRLVGRRLLGEDADAAVLVGRAGLDDHRGNGGREVFGDAPDATDLGGGDVTCHRLGASHPLLCSLLSLSPTDSNGAGEKHSRATQITIGGYLEGKKDPVLFFWKTCRNTPVNEKKTCRF

SEQ ID NO: 183508 - protein, 229 aa, Triticum aestivum
  unsure (1)..(229): unsure at all Xaa locations
  Clone ID: PAT_TA_77926.pep
RRLLSPRGCLLRRLSTAAAASPHPPRRPLADSLYRRVTAVWNPRLPLTPVLEQWAVTEGRAVEKNSLMSIVKQLVRLRRFSHALELSMWMTDRRYMYLSPGDVAYRLELISKVKGLESAVNYWKGLSIQVKNSHCYGSLLKCYAEAKSVDEAEKLFAEMHDLGMMSSYPYNVMMKLYWETGQVERVHAMYRAMEESSIKPDVFXSSILLTVLAAAGNFDGIEEIVKKVD

SEQ ID NO: 183509 - protein, 259 aa, Triticum aestivum
  Clone ID: PAT_TA_77927.pep
SSSSSVQSDLTPVETDEEDVQGSSITGHLVESALAELSSHATEYVEESRPARKETSRFSLEDDVVGSNEVSEPLVSELPVAVELQRSFDNQALKTMLSKPYLEHMQPEKNSADNRASTDEDIRADAAALCQLPKQLTAVQNADVYDSVLAESTSEVEADGVKVNASVESVITESREDMGAHEDLQGPPESCLDCTTGNVAENVEAAEIDDVENINSTSHCQSILEASSDGELTEQSKSVLTDSNLQNDELASVHNNGSF

SEQ ID NO: 183510 - protein, 161 aa, Triticum aestivum
  Clone ID: PAT_TA_77928.pep
RANLTELTLRATELESEEHLKVTSQLPSLLYLRLHHSAYTGRALTFSASEFPSLKLLTIHLAVYQALNLRFEEGTAPKLHRLELSFFENASIRQPSGINFLANLQEVLVHADPCHNSEAMVHYLRNEARRNPNQPTVTFKAKQWKSARTGPAIDYRGNIWF

SEQ ID NO: 183511 - protein, 61 aa, Triticum aestivum
  Clone ID: PAT_TA_77929.pep
TSSVISYALLYYQRKKNCSYILFVSSFILQKKIELTNKTLLMMNNAVYIILGPLFFHLLLS

SEQ ID NO: 183512 - protein, 241 aa, Triticum aestivum
  Clone ID: PAT_TA_77930.pep
IVYFDETDLNNCQGYQGCLSYSSYICTDDGIYNATFTDPIGQSTVINSINVTLKGMTGCDYTGESRTITFYLNNKAIGSWSATNVSYNCYCDDPCDANPPSVLYQNTGSLNYNFGASNTLFMSISCDGCDACYYGYNLTINYGSSSSSMDTCCYYVNQQNATLTRSLCAAPKAQCPSISNFQLVTSTPVSDCSQCTTSPVCCLYESSTDPSDTEAECEGPGTATCPSKQVTQSFLNSMFLT

SEQ ID NO: 183513 - protein, 140 aa, Triticum aestivum
  Clone ID: PAT_TA_77931.pep
SARGEIVLIDDDLTGCIPPQVGMLRKVTVFDVSGNGLQGPLPATVTGLVAVQELNVAGNLLEGAVPASVCGLPSLRNFTYEDNFFSGRPGCAVATADGRWNCILGAPAQRPPAQCAAAAARPFDCSRAQCQAAPPPGRRG

SEQ ID NO: 183514 - protein, 71 aa, Triticum aestivum
  Clone ID: PAT_TA_77932.pep
ITKLIVPQNALTRVIFACRGGGWFNYITNKVTPCIAQSFVIQKVWTKRTQCHISTITLTCSSIHPSQGDSP

SEQ ID NO: 183515 - protein, 83 aa, Triticum aestivum
  Clone ID: PAT_TA_77933.pep
GLPTLLFFSFRTLISETLSGSMIAEHMMQQPRRQKATSHHGTPGWITITSQIFALILFLSLPLEGTCQTVLLFAYRTTCIIMF

SEQ ID NO: 183516 - protein, 127 aa, Triticum aestivum
  Clone ID: PAT_TA_77934.pep
GYCSSTVDLLQPPPVTIHPWAPIHPASTARSSTGYCSTSPLHGILFNHPSIDYCLSSPPPATVQPVLHRLLFNLPSTWSCSCSPPRGLVHPRPTGSIDRGPVHLVATPRGPVHPTPHWELFSQHHPF

SEQ ID NO: 183517 - protein, 51 aa, Triticum aestivum
  Clone ID: PAT_TA_77935.pep
NTFITWIIRTYDSNSSKHPQLPKIIKVKPNQSIKYQVLFTRVCASFLLPPF

SEQ ID NO: 183518 - protein, 130 aa, Triticum aestivum
  unsure (1)..(130): unsure at all Xaa locations
  Clone ID: PAT_TA_77936.pep
LRQVVFPRYRXRSDVIEXXTVTGLGKTAVNNWEIYVASGSEAKLVAYXXGMHTYSXXWXNRFTMVLEVERFKGSTXQIMGASLGKSXEWAIVGGTXDFAMXTGVVQRXAHTKTXDEEIQELTIDGXCRMN

SEQ ID NO: 183519 - protein, 181 aa, Triticum aestivum
  unsure (1)..(181): unsure at all Xaa locations
  Clone ID: PAT_TA_77937.pep
IFSTNHKDIGTLYFLFGIXSGIIGSSLRILIRLELRQINSIINNNQLYNVIVTIHAFIIIFFITIPIVIGGFGNXLIPLIIGCPDISFPRLNNIRFXLLPPSLIIIICRFIINNGTGTGXTIYPPLSNNIAHNNISVDLTIFSLHLAGISSILGAINFIWYTTASLDNIRGRISTKLCIGS

SEQ ID NO: 183520 - protein, 89 aa, Triticum aestivum
  Clone ID: PAT_TA_77938.pep
RAKLSSLRSHLPSKKEGARLLPTLQKIKMKRKGQSTSPFPLKTVCPLFVSVNTQFLELSWRVLFLPPERPLFLSGMQRKGKIVWDTALD

SEQ ID NO: 183521 - protein, 65 aa, Triticum aestivum
  Clone ID: PAT_TA_77939.pep
THASVVGRSRNSFQLLSDERPWSREFGHCTVKIAELVCERVLFVVTDTTCFLLPAGLGLGSGRLL

SEQ ID NO: 183522 - protein, 120 aa, Triticum aestivum
  Clone ID: PAT_TA_77940.pep
PGRPTRPRHGAMVNSSTCGYAGCVGDVNALCPAELQVAGKEGAQEGRTVACRSACEAFGTAEYCCTGAHGGPDSCGPTRYSRLFKAACPAAYSYAYDDPTSTFTCGAGAQYLITFCPAQQ

SEQ ID NO: 183523 - protein, 113 aa, Triticum aestivum
  Clone ID: PAT_TA_77941.pep
LWRMDGWMDGVGGFRWRWVSGGWCGEKGKGERKAPGELDPHSCASERNHLHFHHRHPDAAPSLSLIQPPQLHRSLQMLLLLRGSQADLGAWILLGGGVIGRDGTGGRLVGRVG

SEQ ID NO: 183524 - protein, 163 aa, Triticum aestivum
  Clone ID: PAT_TA_77942.pep
SPRREDGDVHPVAGDAKLHRGSNGDVLDRERRPVAQHRGHHRVRLKVALRARQRRRPGNRRRHHTGAEADITHRVHHCGGSSYHRVEESGAGSGVPRNSRTGRQRRRATWDGGDDRRRPGSRRKLLGAPDLSSHWLETWPETEQRRHLGGLVQEATRCRTRGS

SEQ ID NO: 183525 - protein, 63 aa, Triticum aestivum
  Clone ID: PAT_TA_77943.pep
LHFANNQTFFNVCHKEKKSVFLMILFGFYCHPRSYELELRHLVSRIMASLTRKIKSFSKHDRY

SEQ ID NO: 183526 - protein, 127 aa, Triticum aestivum
  Clone ID: PAT_TA_77944.pep
HVKIYGESERLLGSVFSLANNLPDGGIIFLDEVDSFAISRDSEMHEATRRILSVILRQIDGFEQDRRVVVIAATNRKEDLDPALISRFDSMICFGLPDQQSRAEIAAQYAKHLTKPELVQFSLATEE

SEQ ID NO: 183527 - protein, 37 aa, Triticum aestivum
  Clone ID: PAT_TA_77945.pep
ITTFGTIVNSFFIYNDVISTVFPLFHGSYPPDTSHRF

SEQ ID NO: 183528 - protein, 148 aa, Triticum aestivum
  Clone ID: PAT_TA_77946.pep
DPRVRAGAALCSHMGVDKLAFTGSTGTGKIILELAARSNLKPVTLELGGKSPFIVMDDADVDQAVELAHRALFFNQGQCCCAGSRTFVHESVYDEFVEKSKARAQRRVVGDPFKKGVEQGPQIDGQQFKKILGYVKSGVDSGATLVTG

SEQ ID NO: 183529 - protein, 64 aa, Triticum aestivum
  Clone ID: PAT_TA_77947.pep
LSVLHFCILYASHILFIFSVIKIFFFEHAITLSYHGETSLFLLFGYNVFPMEKTWCFGLLHLIF

SEQ ID NO: 183530 - protein, 108 aa, Triticum aestivum
  Clone ID: PAT_TA_77948.pep
SAAAAAFRGGHYIPPLLCFLAAGRQEVRFRGQGRGPSLRKPQQGRPLLIPPPVPSPRIEERRLLLQDTTLFESPDRGGGERRRQTLQLRAAGRQSTMELCTATRTRGS

SEQ ID NO: 183531 - protein, 155 aa, Triticum aestivum
  unsure (1)..(155): unsure at all Xaa locations
  Clone ID: PAT_TA_77949.pep
LRFIPLPRGSVLPDLEVWXFMRKLQRYRRMGESEGKMRYIEVSKKKPYVVSSFSLDDGGSSWTLDHEVAFTTIWDDEPLKEMPAIGAIDPLNSHVVYLVCGNQLLGVDMEKEKITGSSRLAIPSVPILPCVLPTWLESTQIPSADWSKKTAVKRE

SEQ ID NO: 183532 - protein, 105 aa, Triticum aestivum
  Clone ID: PAT_TA_77950.pep
MEAALVSAATGVLKPVLGKLSALLGDEYKRFKGVCKEIRFLMDELEAMHAFLLKMSEDEDPDVQDKVWANVVRELSYDMEDTIDDFMQNVDDKDAKPDGFIEKIK

SEQ ID NO: 183533 - protein, 81 aa, Triticum aestivum
  unsure (1)..(81): unsure at all Xaa locations
  Clone ID: PAT_TA_77951.pep
DLVLEQYLLPNSPGIAGFRLDSFGVIRPRVTHSPLPSELDMIECSLIRMERRXHLNPAILHIQVTVVKVIRHWLCGQAHLI

SEQ ID NO: 183534 - protein, 131 aa, Triticum aestivum
  unsure (1)..(131): unsure at all Xaa locations
  Clone ID: PAT_TA_77952.pep
SELDLEKSLIGEASFPPPHGWDYSDYVPEAIGWEGEKPGDVXKEKKLKEINLESMSPERRDEEQQLMHLKLMGWRHFPVDLKNLSGIRCLLLGAGTLGCEVSRLLMTCGVRKLTVVDGGHVSMPDVLKQSL

SEQ ID NO: 183535 - protein, 137 aa, Triticum aestivum
  Clone ID: PAT_TA_77953.pep
LLRGRQDCRSHLPDRTTVAYQWLEKHVADESVSDEGFLGSGKTTAAGMRSRRSSNWKAVGVVNPSSGWGRWWRRVGWGRAGGVQAPEHGRYLGADDLQPSSCGERWTTTPRLHSKRSRGGEVASSGPPAATSGADAW

SEQ ID NO: 183536 - protein, 105 aa, Triticum aestivum
  Clone ID: PAT_TA_77954.pep
MAMASSWQEGKLEAVDLEHIPVDEVFENLQCSHRGLTSKHAQRRLQIFGPNKLEEKEVTTFHSANIIFFFSLMLHTRLSWSVDGCRRASSSSFLGSCGIHCHWVM

SEQ ID NO: 183537 - protein, 56 aa, Triticum aestivum
  Clone ID: PAT_TA_77955.pep
THASAHFKIQNPPLSLRPDQGERRRPANPRTLRDLVSESGEEPHRKILGVGRGTQE

SEQ ID NO: 183538 - protein, 178 aa, Triticum aestivum
  Clone ID: PAT_TA_77956.pep
MQDQLQIKRIMDKIEDCLTGQDEKILVILKLDADWVSRWKETKNAFSMFGCIAGALMLTFKDKIARAKEYCWPLREPIDYSLLGFYHDTALELTKNHMLEDNPKIYLDILDKCKHHEFCMKIFIHALHANPKRSNEELSKLHKALQPVHQASHTSAHNSLDSNIIAKKMFMFSYSDLP

SEQ ID NO: 183539 - protein, 159 aa, Triticum aestivum
  Clone ID: PAT_TA_77957.pep
DPRVREDVCAYAQTQITACSGDGLFLLAESFRFVINMLLIQKKTWKGRFELCHLVIRNGKFLILMPTVADASAESAFLDLKQLYILIKPFFKNNGRFANYVSSLKMTIDERSKTVTDSQLEVFLTELLTHMSFGEPLDNTSLLIHLVVIHEMLSGSDLL

SEQ ID NO: 183540 - protein, 70 aa, Triticum aestivum
  Clone ID: PAT_TA_77958.pep
IPPPNHLRLLQISSKCHPLQEAGSPAQEPAASRALSSSSRFLALKERGKKGGRNYSEISESEGGAVESKE

SEQ ID NO: 183541 - protein, 71 aa, Triticum aestivum
  Clone ID: PAT_TA_77959.pep
THFNLIEREFFLLHMIISMMMNQHKLVTRSENPTVFYAFIHQNRRIIFVQLAVKRNCSQELKVTSSELDWQ

SEQ ID NO: 183542 - protein, 70 aa, Triticum aestivum
  Clone ID: PAT_TA_77960.pep
FPSASCHHYQCYYGILLPVQVANWLALELFPLDVTYFILTPPSKDQYALQYWFATSGHALGLAGLVIVCP

SEQ ID NO: 183543 - protein, 80 aa, Triticum aestivum
  Clone ID: PAT_TA_77961.pep
LSEGIHYTLIGQNIPNHMMYMSHSTSRKKSITWPQVSCLTGYCSATQQFLQVNRHLHVKLVLVLQHAQEKPYPPILLRGF

SEQ ID NO: 183544 - protein, 144 aa, Triticum aestivum
  Clone ID: PAT_TA_77962.pep
PVRIPGRPTRPRSSPFAPRAREAEVAAKNAHDEKDHVVKLLFRQASHLFACKQWLKMLQLENICLQLRLKEHQIAAMFPELPWTVMKDEKAEPEGERKGRAKKKGRRQNKEGGFCKAIMFAVGVGIVGAGLLLGWTFGWLLPRL

SEQ ID NO: 183545 - protein, 86 aa, Triticum aestivum
  Clone ID: PAT_TA_77963.pep
RGLNELPTHSLEHTVDMRLVQGIPVCYNMYCANERMQREIVLSFLLHAWTEGSSLISHQLHQEYEQTVNNNPDSGLTCIVRSADAW

SEQ ID NO: 183546 - protein, 65 aa, Triticum aestivum
  Clone ID: PAT_TA_77964.pep
LVFLAIPCTIYTLSGPERFAWLRELILQGQRYVQGRCGGRRGAHRADSVRVVGGGRRRAAGGGGR

SEQ ID NO: 183547 - protein, 54 aa, Triticum aestivum
  Clone ID: PAT_TA_77965.pep
QARREKRFAEARVLNNRQTECASFLSAASNHIKTPAETKYYPRRIWSLLKLPDT

SEQ ID NO: 183548 - protein, 133 aa, Triticum aestivum
  unsure (1)..(133): unsure at all Xaa locations
  Clone ID: PAT_TA_77966.pep
SCRRPAAATAGPSPASAPRRRSTSSCCSPSSAPTSSPSSPSSPPLPATTPPPAQPPPPTSPPTSPPSRSRSAARPPPPXPPPGRPAPGAAPLPHPARAAARPRRAHGAHPHAGLRRGLLPPVPVRAGAPLGLH

SEQ ID NO: 183549 - protein, 182 aa, Triticum aestivum
  Clone ID: PAT_TA_77967.pep
WGKDYTLDWNSGRTDENPTDKGHGDILIRSKRVRSRPGQTSKQVPLDYSLHSYLEVIFRNPRMKITVQGSKVKARPLDKSLNTTSVISGDIAGRTIELTIGMSKVEWERTNCGVFLYWRGRLIESYKRVGGQMHNADTGRGVIGVADITELVDDEDGNSWVLNSKQGFQDCEMYAELEEWLG

SEQ ID NO: 183550 - protein, 205 aa, Triticum aestivum
  Clone ID: PAT_TA_77968.pep
GEMSSARSPSAAPAPLDDDDLLPEILLRLPPQPSSLPRASLVSKRWRSVASDSAFSRRFRRHHRLNPPLLGFFRVELRGRFEPRFEPSLDAPNRVPPERLSWRWNEGDDCYDLVGCRHGLVLVLNRAHTQVLVWDPVTGDRHRVAVLPGFKIAGAPISGTVLRGAGDDDHFQVVLVGTDGEEGHITEAIAYVYSSETGAWGDPIS

SEQ ID NO: 183551 - protein, 90 aa, Triticum aestivum
  unsure (1)..(90): unsure at all Xaa locations
  Clone ID: PAT_TA_77969.pep
MLRIRIINIRLAAEGKXKQLQERNRSNFLLSLSAELSSEASPPECRCLAGIILKNSLEGKYSEDNSLLIKQWNNLDPCIKSQIKESLLIT

SEQ ID NO: 183552 - protein, 201 aa, Triticum aestivum
  unsure (1)..(201): unsure at all Xaa locations
  Clone ID: PAT_TA_77970.pep
RVDPRVRSYYGLAQGTAXGGSAASRVAMYRVCSDEGCAGSAILAGFDDAIGDGVDIISVSLGASPYFSPDFSEDPIAIGSFHAVAKGVMVVCSAGNAGPEASTVVNAAPWIMTVAATTIDRDFESDVLLGGNSTAVKGGAINFSNLDKSPKYPLIAGASAKSNSASSTSDSASHCEPGTLDASKIKGKILLCNHSQSDTSK

SEQ ID NO: 183553 - protein, 198 aa, Triticum aestivum
  Clone ID: PAT_TA_77971.pep
LGASPFIHSSLVAGSLHLMTSYFSSQWHELVHILLAHPKVDIFMDVAFDSLHEDMRLLSVRLSTLGTKAFPVGPFDSQLTYFICQQCEASLQFLLSLCQQKLFRDRILKNKELCRNGGILSLSFTILKLGVPEWLKGSTDIASSISRQKAKILSILLQLCESESISYLDEVATLPKSMQLGLEVLDLLKIAFGRNKNL

SEQ ID NO: 183554 - protein, 57 aa, Triticum aestivum
  Clone ID: PAT_TA_77972.pep
KEQRRRLLQAVRADRHCRHPHDTRNQTSRIFHLATNERTNGRSCTACCCECAADAWV

SEQ ID NO: 183555 - protein, 140 aa, Triticum aestivum
  Clone ID: PAT_TA_77973.pep
TTCQALLAQNPRHGSRDLVAGNNLTVPIRCACPSPAQAAAGVRHLLTYLVMWGDSVSAIGDRFRVDTQAVLQANNLTASEIIFPFTTLLIPLKSAPTPDMLVSRAPPPAPAPPQAQQPPASSSGKWIAVGVGVGVGVLAL

SEQ ID NO: 183556 - protein, 172 aa, Triticum aestivum
  Clone ID: PAT_TA_77974.pep
PRVRVGHPFTRQENTVIQTCVVSAYGIAFSGGFGSYLFGMSDTIAKQATEANDPWNINEPHLGWMIGFLFLVSFIGIFALVPMRKIMIVDYKLTYPSGTATAYLINGFHTPEGAKLAKKQVKILGRYFMVSFFWGFFQWFFSGGDDCGFKNFPTLGLEAYKNRFYFDFSPTY

SEQ ID NO: 183557 - protein, 105 aa, Triticum aestivum
  Clone ID: PAT_TA_77975.pep
RPTRPRSKASPRIPPRRDSPHPPNSPSPAAARSPGHVRLPLRRRRRRRRRLRGPSALLFLPRPLGPGGGDKPPKEGKASSPYAAARPRPTAPAAAEAATGPRPRP

SEQ ID NO: 183558 - protein, 181 aa, Triticum aestivum
  unsure (1)..(181): unsure at all Xaa locations
  Clone ID: PAT_TA_77976.pep
RVDPRVRFLALGRITWDFRRSPSGGWGGSFLAMPGVANVTRLVIEREPWDAMDVGIPYPTGFHPRTAADARAWQQHVTSVPRPRLFAFAGAPRSAIKGDFRALLLNDCXAAGAECGALDCAEGKCIKDNALVLELFMGARFCVQPRGDSFTRRSLFDCMVAGAVPVLFWRRTAYLQYHWYL

SEQ ID NO: 183559 - protein, 163 aa, Triticum aestivum
  Clone ID: PAT_TA_77977.pep
MAPIKIGINGFGRIGRLVARVALQSPDVDLVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLA

SEQ ID NO: 183560 - protein, 110 aa, Triticum aestivum
  Clone ID: PAT_TA_77978.pep
NPNCFRAYMFGLIFLFIMQYLSRSHLICKFDNRRRPHLCTYKMHILGLGFLPHSLGSGYKYIILTGFYSFSHIDSNTILLNQYDGGLQFDALLKFMLKLQEVDLLWFAQK

SEQ ID NO: 183561 - protein, 90 aa, Triticum aestivum
  Clone ID: PAT_TA_77979.pep
HLGHDKGEREEMVVPEVIEGDSKVSGVGGEGEKVILSQGTFAALEGLALECDDGPSCSLFKEGTEDYEWFNMDAETARKFVKTRNRLGPP

SEQ ID NO: 183562 - protein, 74 aa, Triticum aestivum
  unsure (1)..(74): unsure at all Xaa locations
  Clone ID: PAT_TA_77980.pep
PTRPRVNRFVGRIIDDHRSAAPSSAVKDFTDVLLSLXGGDRLADADMIAVLWEMVFRGTDTVAVLMEGVLARLV

SEQ ID NO: 183563 - protein, 139 aa, Triticum aestivum
  Clone ID: PAT_TA_77981.pep
MSTGKAPALYHVRARSLTSKVLDLDSSPACPSPPPFRSHVTVPFLWEDAPGKPKLRAARPSALSLPSASPAPVLADGGPTARVAGGHEDGHGAHARPVLLKLKLPPRLQAAEHPLSSPRTVLQGPYFGGGGGGNKPPRP

SEQ ID NO: 183564 - protein, 73 aa, Triticum aestivum
  Clone ID: PAT_TA_77982.pep
TIELLYISASKQMNKCPVQCFRLTYIELYFSSSTTSSGKPQVSNKGRHTVQCKNRHVEISNMNLNHLSLPSPV

SEQ ID NO: 183565 - protein, 79 aa, Triticum aestivum
  Clone ID: PAT_TA_77983.pep
SNDSINLLLYIYFLRESTQHSVDIKEHASESADHCCSFQGGQPYQPHQALLHTLHSSWSHIYPLVGGNLVTKEKWYILE

SEQ ID NO: 183566 - protein, 99 aa, Triticum aestivum
  unsure (1)..(99): unsure at all Xaa locations
  Clone ID: PAT_TA_77984.pep
KFKKRLTTYPSIATLDIYTSFEXYCDASNHGLRSVLMQEGILVAXRQLRPHEXNCPTHDLEIAVVVHALSMSSSRWEDLINHYDVDIHYHPDKANVAVD

SEQ ID NO: 183567 - protein, 81 aa, Triticum aestivum
  Clone ID: PAT_TA_77985.pep
KKICRLRPKLVHQSFSSAREEEELHSIPEAGSLPRERSPPHGVPLKLKKGSEKMAVMMRQRVPCRCRTDEQLRPKEALCHS

SEQ ID NO: 183568 - protein, 126 aa, Triticum aestivum
  Clone ID: PAT_TA_77986.pep
MEFGRRKPMSLLELCIRKAIDNLRYIESVDGIEMDLLKRILPHCTLEHLTKIEENTKMDLSSVTDPLWKRFYFREFGEEHTNKVIARLKSLKETRSDTKYTWWKLFEARQKKQKQAEDEMVEKFTK

SEQ ID NO: 183569 - protein, 63 aa, Triticum aestivum
  Clone ID: PAT_TA_77987.pep
KTVANVSDLEMLFGRLWTQCQECQGSLHQDVLCTSRDCPIFYRRRKAQKDMAEARLQHDRWDF

SEQ ID NO: 183570 - protein, 69 aa, Triticum aestivum
  Clone ID: PAT_TA_77988.pep
CMSIAYGNTVLFFANFVSAHRAISMIAYTSFVRNPLASIQMHYGSHLWRVTYIARNCYYPIFDLLMIKP

SEQ ID NO: 183571 - protein, 111 aa, Triticum aestivum
  unsure (1)..(111): unsure at all Xaa locations
  Clone ID: PAT_TA_77989.pep
PPSNSKKSTDANENETPSLPWVCXEEFEEFAEKAKTLPDTISNEDKLLLYGLYKQATVGPVTTGRPGIFNLKDRYKWDAWKAVEGKSKEEAMADYITKVKQLLEEASASTS

SEQ ID NO: 183572 - protein, 77 aa, Triticum aestivum
  Clone ID: PAT_TA_77990.pep
PRRAKNCEAKNKSSCWPLDVTTVNPDRHRADCHHTNCVSLTVSLHCLGTDFEGSKFGSDPLLLATLWNCAHRAADSI

SEQ ID NO: 183573 - protein, 50 aa, Triticum aestivum
  Clone ID: PAT_TA_77991.pep
GWTSAASERSELMDVGWTTVWVRICTEWVTAALYIWTLIAPLLFPDRDFS

SEQ ID NO: 183574 - protein, 97 aa, Triticum aestivum
  Clone ID: PAT_TA_77992.pep
MVGTSSWSSSSSCTSSLGSLDDDVVVACVVKAADAAVEGTCVKFLCSYGGRILPRHADGALRYVGGDNRVVSVDRSLPFHELQRKLREMCGWEAVCL

SEQ ID NO: 183575 - protein, 162 aa, Triticum aestivum
  Clone ID: PAT_TA_77993.pep
ENLYSTEVQKVNYGDQQLNVRRKAGKLTQVIFDSGSSYTYLPHDDYTNLIASLKSLSPSLLQDESDRTLPFCMKPNFPVRSMDDVKHLFKPLSLVFKKRLFILPRTFVIPPEDYLIISDKNNICLGVLDGTEIGHDSAIVIGDVSLRGKLVVYNNDENHIGW

SEQ ID NO: 183576 - protein, 133 aa, Triticum aestivum
  Clone ID: PAT_TA_77994.pep
MAALREASRCLASRGSPAAARSMLLAQSRGITYKLFVGGLSQFATEESLAEAFSRYGQVIEATVVRDKVTDIPKGFGFVKFASPEEANNAREEMNGKALNGRVIYVDIAKAKPDRATDALPIARGPPKPISNG

SEQ ID NO: 183577 - protein, 153 aa, Triticum aestivum
  Clone ID: PAT_TA_77995.pep
DPNEVSEISMANSRQNIRKLVKDGFIIKKPQKIHSRSRARRAHEAKQKGRHSGYGKRRGTREARLPTKVLWMRRMRVLRRLLRKYREAKKIDKHMYHDMYMKVKGNSFKNKRVLMESIHKSKAEKAREKTLSDQFEAKRAKSKASRERKIARR

SEQ ID NO: 183578 - protein, 72 aa, Triticum aestivum
  Clone ID: PAT_TA_77996.pep
ESIVNTTRRQALLHSMVCGPQSSAMPEMETQAGRVMLSFELSSSRSMDMACEAEFLFPLSKLKGASLASSTN

SEQ ID NO: 183579 - protein, 145 aa, Triticum aestivum
  Clone ID: PAT_TA_77997.pep
GGAYGGFCDFDTHSGVFSYLSYRDPNLLKTLEVYDETAKFLRELEMDDDCLTKAIIGTIGDVDSYQLPDAKGYSSLMRYLLGITVEERQQRREEILSTSLKDFKEFADAVETINDNGVVVAVASPEDVEAANKENPLFSDVKKCL

SEQ ID NO: 183580 - protein, 238 aa, Triticum aestivum
  Clone ID: PAT_TA_77998.pep
LLPQFNASYREHENERPISPEEKEGLSGNGFAVKSDPIKVPPSIEVPELSFEELKEKTDNFGSKALIGDGSYGRVYYAILDSEKHVAVKKLDASTDPELDNEFLTQVSIASKLKHDNFVEMLGYCVEGNQRLVAYEFATMGSLHDILHGRKGVPGAQPGPALDWMQRVKIAIDAAKGLEYLHEKVQPSIVHRDIRSSNVLLFEDYKAKIADFNLSNQSPDMAARLHSTRVLGTFGYML

SEQ ID NO: 183581 - protein, 189 aa, Triticum aestivum
  Clone ID: PAT_TA_77999.pep
FRPRILIDVSKIDMATTVLGFKISMPIMIAPSAMQKMAHPDGEYATARAASAAGTIMTLSSWATSSVEEVASTGPGIRFFQLYVYKDRRVVEQLVRRAERAGFKAIALTVDTPRLGRREADIKNRFVLPPFLTLKNFEGLELGKMDQASDSGLASYVAGQIDRTLSWKDVKWLQTITTLPILVKGVITA

SEQ ID NO: 183582 - protein, 143 aa, Triticum aestivum
  Clone ID: PAT_TA_78000.pep
PRFHHTAASPPPALLPFVYLSQHQGARAGDAGLLLLPPRRCLRASRPRRRRVEARRRWSAAGERGCDVTGSGSGRTEEEEHARRNSTGGSTAEQGRCSSPASRDGTGGRRASGPRGFSASPVAEEAARVGRLRVRPRRHIWPS

SEQ ID NO: 183583 - protein, 94 aa, Triticum aestivum
  Clone ID: PAT_TA_78001.pep
KETKCCSVIVLYHYYQSDCCYNSNLQCSIFNLLVISNLVTLFAVCACHNVDDLCFLPLFSVFLWDSCRWWMCLGADYCLNELTTPSFSASIGCF

SEQ ID NO: 183584 - protein, 156 aa, Triticum aestivum
  Clone ID: PAT_TA_78002.pep
TDNPEDDLKTESLVKQLLYNSKLRSACPLPFDEAKLWQGENGPELKQEIQKQFRNISAIMDCVGCEKCRLWGKLQVLGLGTALKILFSVDGDSHLNQPLQLQRNEVIALFNLLNRLSESVKFVHEKGSSIEEVIKEQIPSTFQKGASKPNLKLDFL

SEQ ID NO: 183585 - protein, 109 aa, Triticum aestivum
  Clone ID: PAT_TA_78003.pep
MNLQLATVFFTFSLGTKTHYYGRMLLHGGAQYRGTGRGFVVFHAKFAENYRLYSRSHFVKGIELMILLIVYQLFGQSYRSTIAYIFITISMWILALTWLFGPFLFNPSG

SEQ ID NO: 183586 - protein, 62 aa, Triticum aestivum
  Clone ID: PAT_TA_78004.pep
EAVKMVYVWVGGENESSKSVEAVDWQQVTGDFLHRKGLSDALPVKVFKEHETENLLELLNVS

SEQ ID NO: 183587 - protein, 81 aa, Triticum aestivum
  Clone ID: PAT_TA_78005.pep
AWTPLCFVFTIFCSSFFLGEIVHLGSILGGILLVGSLYTMLWGKSKEVKTDNITHDTEKAEHKNSAESYPEEQHRHTTPEL

SEQ ID NO: 183588 - protein, 178 aa, Triticum aestivum
  Clone ID: PAT_TA_78006.pep
LPTMRLGFIMTHCPGNPKFDFHRYMVRVLEADFKKVVGISWYLWVFVVIFLLLNVNGWHTYFWIAFLPLFLLLAIGTKLEHVIAQLAHDVAEKHTAIEGDVIVKPSDEHFWFGKPRIILYLIHFILFQNAFEIAFFFWILSTYGFDSCIMGQVRFIVPRLVIGVVIQLLCSYSTLPLY

SEQ ID NO: 183589 - protein, 98 aa, Triticum aestivum
  Clone ID: PAT_TA_78007.pep
HCTSEHVHGWDKKPVRFQLSTSDGQQALSQCYLEEPGSWVLYHAGDFVASKPDQPMKLKFSMAQIDCTHTKGGLCIDSVLIYPKGKGFQQERVVRSQK

SEQ ID NO: 183590 - protein, 37 aa, Triticum aestivum
  Clone ID: PAT_TA_78008.pep
SFALVLKAESPEGFVLTHIQKTWLNGYSSGVEQASKL

SEQ ID NO: 183591 - protein, 56 aa, Triticum aestivum
  Clone ID: PAT_TA_78009.pep
LAAPPLVGSTAQHAHTRVEKRHGEEQACWRSERSRLMDDGVVTSGGRRQVVLLLPC

SEQ ID NO: 183592 - protein, 34 aa, Triticum aestivum
  Clone ID: PAT_TA_78010.pep
HLRKWKSTLSILDSRSSTIIISKKVHQTIGIFVL

SEQ ID NO: 183593 - protein, 144 aa, Triticum aestivum
  Clone ID: PAT_TA_78011.pep
MGPGVLVPRSAVPYASFARGRGRSASGRRSRNLVLSASFSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRHHMR

SEQ ID NO: 183594 - protein, 64 aa, Triticum aestivum
  Clone ID: PAT_TA_78012.pep
SDVPDGTVMKSILPEKGGNCLATESHITWKDGKVSQDIVLKLRNTETGELVLHLSWVNIPGVAR

SEQ ID NO: 183595 - protein, 187 aa, Triticum aestivum
  Clone ID: PAT_TA_78013.pep
CRLREEPAFSWIRKLPADIRTAIHHSKILFCNGYAFDEFFPDVIASSIDCAIDSGTAVFFDPGPRGKSLLDGTLDEQRALEHALRFSDVLLLTSDEAESLTTIRNPVQAGQELLKKGVRTKQVVIKMGSKGSIMITKSTVSCAPAFKINVVDTVGCGDSFTAAIAFGFLHDLPAVNTLTLANAVGAA

SEQ ID NO: 183596 - protein, 216 aa, Triticum aestivum
  Clone ID: PAT_TA_78014.pep
KDIAGTLATEEADDPAHVSKLRSALESVDHKRRKIMQQMRTDTALLTKEEGGSPIRNPPTAAEDARLASLISLDNILKQVKEVMRQSSSRPMRKSKRKALLDSLDDLLTQMPSLLDIDHPCAQKQIMEARKVVESLEEDPDDPAPQSNALGESEVSQWNVLQFNTGTTAPFIIKCGANSSSELVIKADLRVQEPKGGEVIRVGPRPTVLVDLSFEE

SEQ ID NO: 183597 - protein, 87 aa, Triticum aestivum
  Clone ID: PAT_TA_78015.pep
EAVKRAGGKLGKPEIFPASTDARYFRVLGIPAFGFSPMTNTPILLHDHNEFLSKDEYLKGIGIYESIIRTLATLKDSNVDYESRAEL

SEQ ID NO: 183598 - protein, 78 aa, Triticum aestivum
  Clone ID: PAT_TA_78016.pep
GPICPSSTAEGSRAGSVAPASAPCTPDEPKGKLCMQTGHQKTRAVNRLVPESESWSVSNSECVDSIWKQKFNIPISHT

SEQ ID NO: 183599 - protein, 172 aa, Triticum aestivum
  unsure (1)..(172): unsure at all Xaa locations
  Clone ID: PAT_TA_78017.pep
LHVLITGSTKGIGYALARKFLEAGDNVIICSRSAQKVESVVGDLKKEYGEQHXGTVCDVRDGKDVKALVEFARDKLKHIDLWINNAGSNAYTYKPLVETSDEALMEIITTNTLGLMICCREAINMMRNQPRGGHIFNLDGAGSDGRPTPRXELQMNEVNNVMVHNLSALGHA

SEQ ID NO: 183600 - protein, 135 aa, Triticum aestivum
  Clone ID: PAT_TA_78018.pep
ELLKQVDTWQMNVEQQLADIELASKQKAVFESLKSGNAALKSIQNEINIDDVQKLMDDTAEAKAYQDEINAVLGEQLSAEDEEAVMAEFENLEAQLAVESLPDAPVTEVRPAPANTETASEDIDEVIELPDVPTK

SEQ ID NO: 183601 - protein, 124 aa, Triticum aestivum
  Clone ID: PAT_TA_78019.pep
VSCLFASTNTKASTNDIAFCLSKPKGRTNGTTHGSTYTWVLSAMGGSHCHHTKSSLKEATIIYSAPRPKEVTSSQSGREKASEVPSPLIDPRGAMTVMTKSLGLLGHFCTAPPMEGSGRRGSRR

SEQ ID NO: 183602 - protein, 177 aa, Triticum aestivum
  Clone ID: PAT_TA_78020.pep
LADALALAQHHDAVTGTEKQHVANDYAKRLSIGYTQAEKLVSSSLSCLSQSGSKSHCPSQTTNFEQCPLLNITYCPPSEMDLSQGKSLVVLVYNSLGWKREDVLRIPVISDSIVVHDSEGREVESQLLPIANASLYMREKHVKAYLGMLPAAKPKFWLAFPSSGPPLGFNTDFISSG

SEQ ID NO: 183603 - protein, 224 aa, Triticum aestivum
  Clone ID: PAT_TA_78021.pep
YVLGYSGSIMVPLGWIGGTCGLLLAAAVSMYANALLARLHEVGGKRHIRYRDLAGHIYGRKIYGLTWALQYINLFMINTGFIILAGQALKATYGLFSDAGVLKLPYCIAISGFVCALFAFGIPYLSALRIWLGFSTLFSLIYIVIAFVLSLRDGITSPARDYSIPKSSGSTHVFTTIGAVADLVFAYNTGMLPEIQATIRPPVVKNMEKALWFQVTVGSLPLYA

SEQ ID NO: 183604 - protein, 47 aa, Triticum aestivum
  Clone ID: PAT_TA_78022.pep
AFSTAAKNWAHYPNIHFGLNSGREGGKKLVDEAVAAAPAPKKIQGFY

SEQ ID NO: 183605 - protein, 77 aa, Triticum aestivum
  Clone ID: PAT_TA_78023.pep
SSIFFFPSSLYPFFFFGLDDMDMHPAPPVVVTRSSGLGCLGSWLLLLARHCHPVAVAVLLRCCWLGSYISQCVYICS

SEQ ID NO: 183606 - protein, 130 aa, Triticum aestivum
  Clone ID: PAT_TA_78024.pep
LVRKPSISSATSGNLNPNVLAELFSLYREWQEENAKKISRKQEEIENKIETADALAVKLLQRFNYSLTSMRSTSHNLAEVHPLQIEVGELKGSLTEVISNCDALCKRIAAEGPESLRSSGQPFIPARAEA

SEQ ID NO: 183607 - protein, 178 aa, Triticum aestivum
  Clone ID: PAT_TA_78025.pep
HRFLELNIVHELIDMMQCNIDELQDSAYYALHQIIFAKGGSLVLQRFLQLGTIEKLVNLLDRKSLKTKDLAMQFLVDIAEVGTKPCIERMLSSQVVEKLVALEKAGDPFGGAVSRYIQGLNMCKKLQTAERAVMKQHILRKVRSAVRGHKLEASLVASVEASIAEGSRGASSSSRKKK

SEQ ID NO: 183608 - protein, 84 aa, Triticum aestivum
  Clone ID: PAT_TA_78026.pep
RRLSNFINKKMMTAHRRFQGAAIIVFILLVLQYAQSTSSTHEREQEQRADGRSCMTNEWTALLTFKASLSDPSRRLSSWHGRAC

SEQ ID NO: 183609 - protein, 68 aa, Triticum aestivum
  Clone ID: PAT_TA_78027.pep
LSRAISHYGANRIMWGSDFPYVVPECGYKGAREAISLVAGKIPVSLSDLDWILGKTVSQLFQGAWVTP

SEQ ID NO: 183610 - protein, 68 aa, Triticum aestivum
  Clone ID: PAT_TA_78028.pep
KFRVPITYIYMYKYNTMLKSALKTLAIEGHQVDKEQLHVSAEQIVCGDKGADGENCKCQERYGDGAIR

SEQ ID NO: 183611 - protein, 114 aa, Triticum aestivum
  Clone ID: PAT_TA_78029.pep
RIAGSIRPESLKKFVDTAEKCLAEYGVERPAMGDVLWCLEFALQLQEASLDSSGTKASPDSSGTDNTQLVLRNASRLHRNQSNASDGAEANLGDLDGMSMRRVFSKMIKSEEGR

SEQ ID NO: 183612 - protein, 154 aa, Triticum aestivum
  Clone ID: PAT_TA_78030.pep
KALDGFNFSAAAKVFEEEIREVAFGTFGGLGIAGLSASLLTSVLSTTLEDLLALALCSAGGFFVLSSFPGRRKLAIQKVNKAADELSRKVDEAIQKDISQSANDLIRFVEVISKPYQEACQRKIDWLQGVQGELSAVERKLQTLKVEIQNLHGS

SEQ ID NO: 183613 - protein, 159 aa, Triticum aestivum
  Clone ID: PAT_TA_78031.pep
LPAKGAKRVFSDEAPPPSPAAAAGKGKKVAEEEDDDKKVAATPQPAAKAQVVGWPPIRSYRKNTMATTQLKGSKEDTEAKQGQGFLYVKVSMDGAPYLRKIDLKTYKNYKDLSTALEKMFSGFSTGEMSRVTLPLRMARQYVIVFHFDVDAVRSTSRNL

SEQ ID NO: 183614 - protein, 42 aa, Triticum aestivum
  Clone ID: PAT_TA_78032.pep
ILLPPVGVFLRYGIGVEFWICLLLTILGYIPGIIYAVYVLVA

SEQ ID NO: 183615 - protein, 134 aa, Triticum aestivum
  Clone ID: PAT_TA_78033.pep
RLPFSATPLYLPQYRPTLQRSAAALQSARTHARHELAAMSWLARSIAATLSSAHSDDDDESESPSGDKSPPRASDPTSADTVESDEQPDTPSRGVKGDISELTESLTRRFWGVASFLAPPPVEGEAGEEEEEEE

SEQ ID NO: 183616 - protein, 106 aa, Triticum aestivum
  Clone ID: PAT_TA_78034.pep
FGDVALLGNVAKYETMRSLWMSSCDVTLKGCQVLASKMPMLNVEIMNELDGSSEMEENHTDISKVDKLHVSEMEENHTDLSKVDKLYVYRTTAGARDDAPNFVKIL

SEQ ID NO: 183617 - protein, 66 aa, Triticum aestivum
  Clone ID: PAT_TA_78035.pep
MSAAGEEDKKPAGGEGGGAHINLKVKGQDGNEVFFRIKRSTQLKNLMNAYCDRQAVDMNAIAFLFD

SEQ ID NO: 183618 - protein, 114 aa, Triticum aestivum
  Clone ID: PAT_TA_78036.pep
PPPPRDESAPRAPRGGGGGGGGGSFVDSANKVYVGNLAWGVDNSTLENLFSEQGQVLDAKVIYDRESGRSRGFGFVTYGTAAEVNNAISNLDGIHLDGRQIRVTVAESKPRRQF

SEQ ID NO: 183619 - protein, 129 aa, Triticum aestivum
  Clone ID: PAT_TA_78037.pep
QIQSRAARLVPSCGCDSSVVRLHRKPTTAVASFPSGSTAQGSSSSSTMASGLHPTTDGGSGISGQAAFGWRHGHRRLGTDQVVLTLFPDQWWPSFLWLLQRPFLCHGLFDAGAFLCYRVAAASMNIHLI

SEQ ID NO: 183620 - protein, 101 aa, Triticum aestivum
  Clone ID: PAT_TA_78038.pep
VVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 183621 - protein, 115 aa, Triticum aestivum
  Clone ID: PAT_TA_78039.pep
AVTRAISAPQCSVTRFLCANNVKIYLHCLCSECKTTTSNNRVKFIRYSSLPSPRGSKSALPTPILSTPELASRHASPATSATATNSGQHQINPALMQQTAICCCQCTLLQLDCDL

SEQ ID NO: 183622 - protein, 87 aa, Triticum aestivum
  Clone ID: PAT_TA_78040.pep
DILNSYLNKYRIELDPQLEALVGRHSRKPWSKFINADNQHLVSPEAIDFLDKLLRYDHQDRLTAREAMAHPYFLQVRAAENSRPRAQ

SEQ ID NO: 183623 - protein, 70 aa, Triticum aestivum
  Clone ID: PAT_TA_78041.pep
MSKARNALVATGLLVFAGAGLSFPFLFVKSKNRPIIDSSKPLPPQATFRGPYVNTGSRDIGPDPTNYPKK

SEQ ID NO: 183624 - protein, 61 aa, Triticum aestivum
  Clone ID: PAT_TA_78042.pep
YQLNHISCEQTGESSLIERLASYSPALHAAAASTGRQVASDVRSGTGLVSRGEGSRAPSPP

SEQ ID NO: 183625 - protein, 93 aa, Triticum aestivum
  Clone ID: PAT_TA_78043.pep
KDYWVVRLVELRCSSSSGTLGWVMAVVGASRLVVVHLHDHPRHRLAHVHRRRDRRLLSRSELQSRRALLQLAPPHQAQASWRGDGGGEGEEEE

SEQ ID NO: 183626 - protein, 206 aa, Triticum aestivum
  Clone ID: PAT_TA_78044.pep
GEEIYVGPVGQHSCELIRYFESIEGVSKIKHGYNPSTWMLEVTSTVQEQITGVNFSEIYKNSELYRRNKSMIKELSSPPDGSSDLSFPTEYSQTFITQCLACLWKQSLSYWRNPPYTAVKYFYTIVIALLFGTMFWGVGRKRSNQQDLFNAMGSMYASVLFMGVQNSSSVQPVVSVERTVFYRERAAHMYSPLPYALGQVAIELPY

SEQ ID NO: 183627 - protein, 108 aa, Triticum aestivum
  Clone ID: PAT_TA_78045.pep
MSASPEFYKPAPPAFSPCSSPLLLHGAVAEESTTAGAGTMWPQQQEEEDYRCRTPTSGESQVKPLGTCPPAPRKPRAPAAPAPCRKRLFEVEVFSLRLEELERLFWRP

SEQ ID NO: 183628 - protein, 107 aa, Triticum aestivum
  Clone ID: PAT_TA_78046.pep
FLGPLVLQQNELLTTILLFGARACAMGSFTVLCLYAPEVYPTVVRSTGAGIATAVGRIGGVVCPLVAVAMLRSCHQMEALIVFEVILCLAAVACIFFPVETKGRGMD

SEQ ID NO: 183629 - protein, 91 aa, Triticum aestivum
  Clone ID: PAT_TA_78047.pep
HDFTVKDASGKDVDLSTYKGKVLLIVNVASQCGLTNSNYTELDQLYEKYKDQGFEILAFPCNQLGGQEPGTNEEIVQIACTHFKADYPIFY

SEQ ID NO: 183630 - protein, 74 aa, Triticum aestivum
  Clone ID: PAT_TA_78048.pep
MSRPNRSDAHLSAEDEATLEAEVRGYYDDAAPKRHTKPSRSEHSAVYADALVPDAGGNTPPELDKVQELEGHTE

SEQ ID NO: 183631 - protein, 74 aa, Triticum aestivum
  Clone ID: PAT_TA_78049.pep
VAHDPVVSFKTALWLWMTNAHKVMPTQGFGATIRVLHGALECNGKNPAAMKARVGYYKDYCKQFGVDPGNNVTC

SEQ ID NO: 183632 - protein, 123 aa, Triticum aestivum
  unsure (1)..(123): unsure at all Xaa locations
  Clone ID: PAT_TA_78050.pep
MVHMHPTAVNQEWRGIPTRLNNIPHSREIREYFYNDVVKATKLAIEDKKTRLQIDINIPELNPEVDVYRIGTLMELVRELSLSFADDGKRVKSLDSXVCVQGSMGQGAFAGIPLQLAGIRKIL

SEQ ID NO: 183633 - protein, 83 aa, Triticum aestivum
  unsure (1)..(83): unsure at all Xaa locations
  Clone ID: PAT_TA_78051.pep
RAPTHTRWQGVKNRRPTTISAAPPYPNRMYPTSRPYTQYRSSIKTGLPYXTYRSTGYDSRIYRSWGLPTGVIYFVSHHNFLHI

SEQ ID NO: 183634 - protein, 228 aa, Triticum aestivum
  Clone ID: PAT_TA_78052.pep
VAATAGGVSQIRALSGCTAGGEDILQNIMRHVVPNFDNLYAGQTMDRIQSMSLLRMATQDAIHKLVNQETVEINIDLGNGHKVSKVLDHSEFEQVNRAIFDKCEKIINQCLVDAKLVPEDINDVILVGGCSKIPRIRSLVLGLCKKEISYKNIDALEAAVSGAALEGAIASGVNDPSGSLDLLTIQATPMNLGIRANGDSFAAIIPRNTTVPARRDMLFTTTHDNQTE

SEQ ID NO: 183635 - protein, 76 aa, Triticum aestivum
  Clone ID: PAT_TA_78053.pep
VACSYSKLGRIEAGLSALEEALKAGYEDFKRVRTDPDLANLRKSEEFEPLLKNYDESFINENAINAIKSLFGLGKN

SEQ ID NO: 183636 - protein, 134 aa, Triticum aestivum
  unsure (1)..(134): unsure at all Xaa locations
  Clone ID: PAT_TA_78054.pep
YVLARSDNHLWTMKTRRSRXQVERELGKLFSKGGGSGVGTKSKXSGSKFNMVVEDIREGVLIFEDEDDAVKYCDLLQGGGQGCEGIAEIEASSVFNMCRNMKALAVLFRRGRTPPLPQSLERDLRARKRSPLED

SEQ ID NO: 183637 - protein, 126 aa, Triticum aestivum
  unsure (1)..(126): unsure at all Xaa locations
  Clone ID: PAT_TA_78055.pep
EGDEVLHIELRKWADIMVIAPLSANTLAKIAGGLCXTTLLTCIVRAWDYSKPLFVAPAMNTLMWNNPFTERHLQTINQLGIILIPPVTKRLACGDHGNGAMVETSQIYTSVRLAWKTQPHDASSSL

SEQ ID NO: 183638 - protein, 68 aa, Triticum aestivum
  Clone ID: PAT_TA_78056.pep
LVDVAGGLCGAAATIVAAFPDLKCTVLDLPHVVAKAPTDTNVHYVAGDIFQSIPPANAVFLKVHTSHS

SEQ ID NO: 183639 - protein, 179 aa, Triticum aestivum
  unsure (1)..(179): unsure at all Xaa locations
  Clone ID: PAT_TA_78057.pep
FGLARNFMDDQSHLSTGLAGTFGYMAPEYIVHGQLTEKADIYSYGVLVLEIVTGRKSHNSVASSTEGLSLMALIWRHYNAGTLMELLDPNLREQCTEEDALRVFHVGLLCAQASPNLRPPMWKVVEMLXGRDHHKVVLPRPTQPPFINVKVSKNAKSDGSSGSASLMSNSDKSPLSLNQ

SEQ ID NO: 183640 - protein, 116 aa, Triticum aestivum
  Clone ID: PAT_TA_78058.pep
MSVLRIDTNVSHVDIDDEFLVLCTEALAKTFQKPKSDILVFVNGDQPIIIAGSTEPAVIVSLLSVDGINANINKLHSAALFPLFTKYLKINENRITIAFSPIEPHAMGHNGKMITQ

SEQ ID NO: 183641 - protein, 75 aa, Triticum aestivum
  Clone ID: PAT_TA_78059.pep
VRRLETERDNLKKDAAIYNYIQERLQKSAAYKMIMELGTMEMEAQEISFEELLAKEKEDTAFWQRNGKMRSFSSK

SEQ ID NO: 183642 - protein, 108 aa, Triticum aestivum
  Clone ID: PAT_TA_78060.pep
GGVSGFLLLLLYYIVDVIHIKKPFVLFQWMGMNALIVYVLAACELFPTLIQGFYWRSPENNLVDVTESLLQAVFQSKRWGTLAFVLLEIVFWCLAAGFLHMKGIYLKL

SEQ ID NO: 183643 - protein, 201 aa, Triticum aestivum
  Clone ID: PAT_TA_78061.pep
GAFGASAPFALGKQIHALVIKKCFGGNTYVCNGLINMYSKCGELQESIEVFDGTPSKNTVTWNSIIAAFARHGHGSEVFGLFESMKADGVKPTNVTFLSLLHGCSHVGSASKGLEILNSMSSQYGIHPKVEHYACVVDMLGRASQLDDAKAFIEDGPFKDSALLWQALMGACSFHKDSEVGKYAAEKLLLLDPDCTAAYVL

SEQ ID NO: 183644 - protein, 98 aa, Triticum aestivum
  Clone ID: PAT_TA_78062.pep
QVLAAARTDLVNRLQGLREKLAHKKAEASKTDSVRAQIETMRREIQKGRAAVDFEKKAHSDNLEQSKAMEKNMISVASEIERLRGELANAEKGGTAVN

SEQ ID NO: 183645 - protein, 189 aa, Triticum aestivum
  unsure (1)..(189): unsure at all Xaa locations
  Clone ID: PAT_TA_78063.pep
ILLSKISPXLVGNPIEEQKLYDAVDCILYSMNKGGTFSSYECQRTTSWLEILNPSENFVNIVIDYPYVECTSSVLEAFILFKELYPLYRTQEIDECINNAAMFIENKQRKDGSWHGTWGICFTCGTMFAVKGLVAAGRTYDTSSSIRKACNFLLSKQQTTGGWGESYLSSETGKYSNGDTHAVNTAWAM

SEQ ID NO: 183646 - protein, 69 aa, Triticum aestivum
  Clone ID: PAT_TA_78064.pep
HEANAVALVDAFNYTDHYLGSVLGRYDGNVYPALYEEAWKDPLNETVVPEGYHEYLRPLLKQQLKLSRL

SEQ ID NO: 183647 - protein, 68 aa, Triticum aestivum
  Clone ID: PAT_TA_78065.pep
KTEDRTRTAGSILAGTRYVLLPCCLYLTKAVSLSEYTHHTALRMPYFDATRWSLIQQSCSPIQNGEGK

SEQ ID NO: 183648 - protein, 116 aa, Triticum aestivum
  Clone ID: PAT_TA_78066.pep
ASAAPALMHEHDDAAAARPSRSAAMSGSGGKADGTSVARAALSLAMSVRTCVAPIDDDPRAAPPAVAAPAIDAEAAAGAIASLIVDGHGDGGRRSDDDDGAMKTRINLSALDITAK

SEQ ID NO: 183649 - protein, 82 aa, Triticum aestivum
  Clone ID: PAT_TA_78067.pep
VASNEHSGSSRCKRQFKLQCSLRSVPAALAASSEKTYKVHIIIPVMQYCPSFYHGINFLLRRWFCIFGFLPAFALQSLDLYS

SEQ ID NO: 183650 - protein, 148 aa, Triticum aestivum
  unsure (1)..(148): unsure at all Xaa locations
  Clone ID: PAT_TA_78068.pep
DQAMNALEEEFSFLSSSKQIVSDMNEKDKVIVFERGDLVFVFNFHPNKTYKGYKVGCDLPGKYRVALDSDALVFGGHGRVGHDVDHFTSPEGMPGVPETNFNNRPNSFKVLSPPRTCVAYYRVDEDREELXRGGAVASGKIVTEYIDV

SEQ ID NO: 183651 - protein, 143 aa, Triticum aestivum
  unsure (1)..(143): unsure at all Xaa locations
  Clone ID: PAT_TA_78069.pep
LLSCVFSWEFWLKILQMVGYDPCSTSCGVLLLIGWKKNLLLELXNLIRKGLNSLIILGAWTLWNHRTRCVFNRVSPSIARALQLACEELQLWRLEAFPTSFVLEPDLSEILGQGHVHILKVCMKNGDSVVVCCSVLTAFISSS

SEQ ID NO: 183652 - protein, 139 aa, Triticum aestivum
  unsure (1)..(139): unsure at all Xaa locations
  Clone ID: PAT_TA_78070.pep
GPEWPSEEKVKRREMVAPEARYIFVRQSSNAITTQNIMKQDSRLEFTHEXMESSAQGKGLGKFLMELVELIACKSQMGAVMLTVQKANNLAMAFYKKLRYVISSTSPSQVDPLIGLEKNYEILCKAFESEAKSILEEGN

SEQ ID NO: 183653 - protein, 105 aa, Triticum aestivum
  unsure (1)..(105): unsure at all Xaa locations
  Clone ID: PAT_TA_78071.pep
MNRKPGDWDCRSCQHLNFSRRDICQRCSEPRGVADRGSGGGGDYANFGGRGGSSFGGGFGAGSDVRPGDWYCSCGAHNFASRSSCFKCSAYXEEAAVNSGAGGFD

SEQ ID NO: 183654 - protein, 125 aa, Triticum aestivum
  Clone ID: PAT_TA_78072.pep
PLPQIELCPEVEATRPSICVRLAMEGSPHSRSFSAWSATSPHGVDPLPLRPPHAGRRWLPHRSVPPPPAARDGARYHAVLVQPRPLPLPSRSRQRLIFLGGDYTFLPGGGALCLLSCVSPSGCAL

SEQ ID NO: 183655 - protein, 137 aa, Triticum aestivum
  Clone ID: PAT_TA_78073.pep
CSCRYARICISENPGCLFIATNRDPTGHMTSAQEWPGAGTMVAAVSCSVQKEPIVVGKPSGFLMDFLLKSFNLETSRMCMVGDRLDTDILFGQNTGCKTLLVLSGCTSLPELQDASNNIHPDVYTNSVYDLVGLLQK

SEQ ID NO: 183656 - protein, 88 aa, Triticum aestivum
  Clone ID: PAT_TA_78074.pep
HEAAYALASIFNKYLHSPEFSRENQLDKILDDILERCFSTVLANSSSKISHSSAGTSDDVDSSDVFSGNKLSKINILSSLAWIGKGYL

SEQ ID NO: 183657 - protein, 66 aa, Triticum aestivum
  Clone ID: PAT_TA_78075.pep
VWILAATQKTVDVPSAKDWRGGRAASFNIIPSSTGAAKLIIGQARDQCYHLMFPFSYFFLASPGIL

SEQ ID NO: 183658 - protein, 76 aa, Triticum aestivum
  Clone ID: PAT_TA_78076.pep
AKYTYYDPVYTAYVLCVFCTYLSAKLGERVRHRVYVHPPYTYSRLQTPPRAPRLVWTDDSAYPLPSLAQERVDEQP

SEQ ID NO: 183659 - protein, 200 aa, Triticum aestivum
  Clone ID: PAT_TA_78077.pep
LGMPIVPAVTELIAAQFLWLDYDDRTKPIYLYINSTGTMDENNELVASETDAYAIADFINRSKSKVYTINLSMAYGQAAMLLSLGVKGKRGVLPNSITKLHLPKVHKSGGAAIDMWIKAKELDTNTDYYLELLSKGVGKPKEELAEFLKGPRYFRAQEAIDYGLADTILHSLDGSFKPKDLTAQLAKAQAMRQSGKRAAA

SEQ ID NO: 183660 - protein, 98 aa, Triticum aestivum
  Clone ID: PAT_TA_78078.pep
VLILTCKKYVTIRRTASTSCMQMHSNSTGKMHILFLLTLHSLVVLIAEDTKRDCSALNWVIKGEERNHQEYHQPHNCRICPKGKFDSYFIRLLLIYYG

SEQ ID NO: 183661 - protein, 159 aa, Triticum aestivum
  Clone ID: PAT_TA_78079.pep
GTRHNAAPVLAMRRKKNVHEDVKPLAVTNLNAFEIISFSTGFDLSGLFIKKECKKETRFTSDKPAAAIISKLEDVAKILNLRIRKMDNGVVKIQGRKEGRNGVLQFDAEIFEITASYHLIEMKQTGGDSLEYQKLLEENIRPALKDIVWAWHGDDQQQK

SEQ ID NO: 183662 - protein, 239 aa, Triticum aestivum
  unsure (1)..(239): unsure at all Xaa locations
  Clone ID: PAT_TA_78080.pep
MADAAADLRRRIKEQRAAIKRRITDSRDRTAAASSTFNAALLEARSIANQTVSNRAKLSQQKQHLRKLESDLAQALSVQTSRMSNHKLMTESISNTIATNEQLRRLVMDRRATRDACMNAISNQLKDIESLEAESDADGDKNLENSLMWYDKFLGFQVVGGEGVKFVFNKIDVQSPDKEYSFCVKLVEERYXLVRCVPFVDGIEELVKELNCNNDLYKFVRFMRNRFQAATISGNQLSS

SEQ ID NO: 183663 - protein, 81 aa, Triticum aestivum
  Clone ID: PAT_TA_78081.pep
GTRVEPAKVLQRVKATGKNAEMWPYVPYALTTYPYVGGAYDKKAPAGFVRSAPQAMAEPSAPELKYMNMFSDENVNACTVM

SEQ ID NO: 183664 - protein, 73 aa, Triticum aestivum
  Clone ID: PAT_TA_78082.pep
FFFFFFFFVKCIVCAWVINVHYFLIIITPGSIRTYKVTIQKRKKKGKLHAYYNRGAPSRLINKPPSRRQSNGS

SEQ ID NO: 183665 - protein, 91 aa, Triticum aestivum
  Clone ID: PAT_TA_78083.pep
MENYQGQHGYGADRVDVYGNPVGAGQYGGGATAPGGGHGAMGMGGHAGAGAGGQFQPAREDRKTGGILHRSGSSSSSSSSEDDGMGGRRKK

SEQ ID NO: 183666 - protein, 221 aa, Triticum aestivum
  Clone ID: PAT_TA_78084.pep
MCNVGANRNQAFVEFADQNQAISMVSYYASSSEPAQVRGKTVYIQYSNRQEITNNKGTGDSSGNVLLVTFEGVQPNDVTIEVIHLVFSAFGFVHKIATFEKAAGFQYTDAPTALEAKNSLDGRSIPKYLLPEHISACHMRITFSAHKDLNIKFQSHRSRDYTNPYLPVNQTAIEGIVQPTVGPDGKVKEPESNVLLASIENMQYAVTVDVLHTVFSAFGSV

SEQ ID NO: 183667 - protein, 75 aa, Triticum aestivum
  unsure (1)..(75): unsure at all Xaa locations
  Clone ID: PAT_TA_78085.pep
MAPKRLVCFLAVAAALATTCXGWGAGAGDVVSSSAAALSFVDRLRQMMIPAAVGDGDYCDSWRVGVEANNVRGWT

SEQ ID NO: 183668 - protein, 218 aa, Triticum aestivum
  Clone ID: PAT_TA_78086.pep
MCSNHQDENSALLHYIQTHQDNVKQNVLLQLLALVGKQPAFHQLRSVEQLGYIALLRQRNDSGVRGLQFIIQSTVKDPANLDARVVNFLNMFEGTLYNMSDTEFKSNVSALIDMKLEKYKNIREESAFFWGEISEGTLKFDRKQEEVAALRELKKEELIDFFNDHVKVNAPQKKILSIQVYGGLHSAEYETIVQNAPPPQSCEITDIYSFRRSRPLYG

SEQ ID NO: 183669 - protein, 86 aa, Triticum aestivum
  Clone ID: PAT_TA_78087.pep
DELASLLAQCAIAEAQSTNTNPSQGPGSDPVDMLNSDEACILAESGRKQIILDAFADGSSFICLKCGGLFSTSRKDEHLAYWCGTA

SEQ ID NO: 183670 - protein, 185 aa, Triticum aestivum
  Clone ID: PAT_TA_78088.pep
GTRQAFSSQHFPSSFYGGRKKTLVVASLLTCRFATLVMCGASLARMAAAPVAMYYNVFRFLTVVLTIQLPCCGIRLLHDIAIIFFHMPPPGNLASTLIIMFEWILSVLVLAASCSALGVEVYMDKDTGACMFMQPQPCRWYKEAAMLGLLAGVFSYTISLLLFCLQSSRHTQPPAPAPAHGHDQG

SEQ ID NO: 183671 - protein, 46 aa, Triticum aestivum
  Clone ID: PAT_TA_78089.pep
GVNSFVLGCRGLGPLKRALLGSVSNYVVNNATCPVTVVRGPTGSSA

SEQ ID NO: 183672 - protein, 76 aa, Triticum aestivum
  Clone ID: PAT_TA_78090.pep
IWAGITQHPSRFKLWVVVFGGALAMLLEVYDFPPYKGYADAHSLWHASTIPLTYLWWSFIKDDAEFRTSTLIKKAF

SEQ ID NO: 183673 - protein, 67 aa, Triticum aestivum
  Clone ID: PAT_TA_78091.pep
CYHSIWSRKACCPVLVGITPKIKMHVWYLLMNLSCFSNICLHLSCLAVVVTAWHRQPEFLALDEYQV

SEQ ID NO: 183674 - protein, 130 aa, Triticum aestivum
  Clone ID: PAT_TA_78092.pep
ISVAAGTPAARIWPRTGCSFDGAGRGRCATGDCAGALSCAVSGEPPTTLAEYTLGRPGAGGDDFLDLSLIDGFNVPVSFQPANGGGARCSKGRGPSCAVDITARCLPELRVPGGCASACGKFGGDTYCCR

SEQ ID NO: 183675 - protein, 134 aa, Triticum aestivum
  Clone ID: PAT_TA_78093.pep
QAAILSDATRMVIQLRSEAQQLKETNGSLEEKIKELKAEKDELRDEKQKLKLEKESLEHQMKLMTSTPAYMPHPTLMPAPFPQAPLAPFHAQGQAAGQKLMMPFVSYPGYPMWQFMPPSEVDTSKDSEACPPVA

SEQ ID NO: 183676 - protein, 49 aa, Triticum aestivum
  Clone ID: PAT_TA_78094.pep
ISLTKSFPIKLWHPPENFKPSTNGPRESNISWSNLVCGAEGVEEAPPSS

SEQ ID NO: 183677 - protein, 139 aa, Triticum aestivum
  Clone ID: PAT_TA_78095.pep
SSLRKILTSYSAASSRQTIFASASIPQHNRFLHDCVQHKWTKSDVVHVHVHPVQPMPSHLCHKYVICTKKERLHVLLSLLERDAPKSGIIFVAEQSERSKKAGNPPSTTVVAEFLRNAYKGSLDVLLLEEDMNFNARAA

SEQ ID NO: 183678 - protein, 99 aa, Triticum aestivum
  Clone ID: PAT_TA_78096.pep
SFIDTLAKNGLVECALSLLDEMIKMGIKPNVVTYNTIIDAFGKSKILTEEDPGNMGIVGVYGQIVRTNPVTRGGRSATDVRMRRSQELFFILELFQKMV

SEQ ID NO: 183679 - protein, 89 aa, Triticum aestivum
  unsure (1)..(89): unsure at all Xaa locations
  Clone ID: PAT_TA_78097.pep
LTQKLKELIPRQMFKVPIQACIGTKVIASEALSAIRKDVLSKCYGGDITRKRXLLKKQAEGKKRMKAIGRVDVPQEAFMAVLKLEKEVL

SEQ ID NO: 183680 - protein, 102 aa, Triticum aestivum
  Clone ID: PAT_TA_78098.pep
EPSDEKCDVFSYGVILWELCTMRQPWEGMNPMQVVGAVGFQQRRLDIPGGVDPAVAEIIKRCWQTDPRMRPSFSEIMGTLRPLLKNTLANQPNRKRAQQTDD

SEQ ID NO: 183681 - protein, 111 aa, Triticum aestivum
  unsure (1)..(111): unsure at all Xaa locations
  Clone ID: PAT_TA_78099.pep
IIHQQGITFIPYQDNASNISKVXKLGGTSNSNLEXPVLIRIEYELXSVNIDEYYISNSNIECIGLQSFAPNWYKDIKFVRVTDKAYPLFYDLWNILIKYTFTYTVGFRICC

SEQ ID NO: 183682 - protein, 162 aa, Triticum aestivum
  Clone ID: PAT_TA_78100.pep
RDYLFLEVARRDLRVIIENKQRLVLAHATSGYKHSLKEVLDTPGVMALIKDTKAAQEVRALQDFFNMLTNDPARACYGPKHVEIAHEQYAAVQTLLITDTLFRNTDIATRQKYVNLVENVKKSNSTVHIFSSMHVSGEQLAQLTGIAAILRFPLPQLEDIEM

SEQ ID NO: 183683 - protein, 86 aa, Triticum aestivum
  Clone ID: PAT_TA_78101.pep
SYSRHAVFHIPMSSRARRFSRPCLSHYSFATTARGEGCHADETCMWNTVPNSRSTPKVTSMAIQPPRSTLSPDLSMLAPPRYAPAT

SEQ ID NO: 183684 - protein, 73 aa, Triticum aestivum
  Clone ID: PAT_TA_78102.pep
KKQIDMSYDFDGFYMILLLQKTLPYCAVALKLYHTGLSSFTKSSIQILITWSYQFFVINSTIQCAIHNIYKME

SEQ ID NO: 183685 - protein, 137 aa, Triticum aestivum
  Clone ID: PAT_TA_78103.pep
VALQFVCYPALAKILRTRMGLPLPSVRETIAQIVVYSLVEDYLSYWIHRLLHTEWCYRKIHRVHHEFTAPTGFAMSYSHWAENVVLSIPALAGPVLVPCHVTTQWLWFSIRLIEGINTHSGYHFPFSPSRLIPFYGG

SEQ ID NO: 183686 - protein, 67 aa, Triticum aestivum
  Clone ID: PAT_TA_78104.pep
PRSFNTPLLAQGFCTLHVPSQQAGNTCHGNTKNRHPMAIGETLLTMITEATGHRKRTHLPSHCFLLS

SEQ ID NO: 183687 - protein, 116 aa, Triticum aestivum
  Clone ID: PAT_TA_78105.pep
LDTLRVTPLTPFAEQDFLNMFFRDQYRPIPNVYNLVLAMLWRHPENVQLEKVKAVHYCAAGSKPWRFTGKEPNMDREDIKMLVKKWWDIYNDETLDFKGLPLSPAADDADDEVEAV

SEQ ID NO: 183688 - protein, 64 aa, Triticum aestivum
  Clone ID: PAT_TA_78106.pep
KIDIPYAASEEELRYHMGLSNFTTGKGKVNLGESNVRPLEVFMCSVVRKMGYGDGFKWVSQNIN

SEQ ID NO: 183689 - protein, 76 aa, Triticum aestivum
  unsure (1)..(76): unsure at all Xaa locations
  Clone ID: PAT_TA_78107.pep
DGYLKPYVTSEPEVTVXTERADDDECLILASDGLWDVVTNEMACEVVRACFRSNGPPSPPGCSRPKAVLPPSAGAS

SEQ ID NO: 183690 - protein, 144 aa, Triticum aestivum
  Clone ID: PAT_TA_78108.pep
LRNFDFPRPSHIQAMAYGPILEGRSCVIADQSGSGKTLAYLCPIIQNLRSEEVQGLHKSSPRNPRVIVLTPTAELASQVLNNCRLISKSGVPFRSMVATGGFRQKTQLESLNQELDVIIGTPGRFLYLLQEGFVQLANLRCVVL

SEQ ID NO: 183691 - protein, 37 aa, Triticum aestivum
  Clone ID: PAT_TA_78109.pep
REVLRWEDKRDAAGYCPEESFYSTTELSSSRLIVAAE

SEQ ID NO: 183692 - protein, 90 aa, Triticum aestivum
  Clone ID: PAT_TA_78110.pep
MGRRGEPYYVEAAPPVDVNKNTEWFMYPGVWTTYILLLFFAWLLVLSVSGCSPGAAWTVVNLAHFAITYHFFHWKKGTPFAADDQGIYSR

SEQ ID NO: 183693 - protein, 98 aa, Triticum aestivum
  Clone ID: PAT_TA_78111.pep
MGEGAAPMAAGLCPRLRTLLASSRPLLAARSGALPLPLRRAGPAMPLVARARRGLGSSTAADPLAEDFATATDLRFESPLEVVKYPDPILRARNKGIN

SEQ ID NO: 183694 - protein, 184 aa, Triticum aestivum
  Clone ID: PAT_TA_78112.pep
HARRARRHYIDEMRTLSIFGAPKFSREAILPTERFGVKGLYDKPMILAVKKFDKNEVVGFLLKHGLKTIFEEPELINLSKAILSGPMKMGLMLSAARYLDIPEMALPMKEILVPGESTLTTAFRISQEYPTIPWVFMTEKDNLRLGSIDKLVELGEFNVFNDKLVLARDFMHNTMDIPVGVPAR

SEQ ID NO: 183695 - protein, 93 aa, Triticum aestivum
  Clone ID: PAT_TA_78113.pep
ERLRKERDEKRAERDRLRRRAEAQAAYDKAKRKEQSSSRSSGGASPRGFPGGMPGGGFPGGMPGGGFPGGMPSGGFPGGMSGGGFPGGMPGGG

SEQ ID NO: 183696 - protein, 143 aa, Triticum aestivum
  Clone ID: PAT_TA_78114.pep
DHKVCVLTRSASKATSVFPASTFPGITIAEQGDWDKCIQGSTAVVNLAGMPISTRWSPEIKKEIKESRINVTSKVVNYINNASGDARPSVFVSATAIGFYGTSEISSFDESSPSGNDYLAEVCREWEARACQVNQEDVRLVLL

SEQ ID NO: 183697 - protein, 64 aa, Triticum aestivum
  Clone ID: PAT_TA_78115.pep
MAAEGEKKMITLKSSDGEEFEVEEAVAMESQTIRHMIEDDCADNGIPLPNVNSKILSKVIEYCN

SEQ ID NO: 183698 - protein, 83 aa, Triticum aestivum
  Clone ID: PAT_TA_78116.pep
SHQHRSSCPKHKRSKKVLHELEQAKIYTVHAMIKTETISAPPVTKPLSSSPQRHQQQRRLKPNLARTGDDKTQHAPSSQSSCS

SEQ ID NO: 183699 - protein, 85 aa, Triticum aestivum
  Clone ID: PAT_TA_78117.pep
RLVACHAVPYAYVVFACHLTQQTRAYSVSMLGRDGTAVDAVAVCHADTSGWNPKHIAFQVLKVKPGTVPVCHFLPQDHVIWTRNG

SEQ ID NO: 183700 - protein, 42 aa, Triticum aestivum
  Clone ID: PAT_TA_78118.pep
FFFFFFLNFAMGITGCSYFCIIIPNILTIKEVSVSKTTSRKR

SEQ ID NO: 183701 - protein, 114 aa, Triticum aestivum
  Clone ID: PAT_TA_78119.pep
LPAAVKGRSLQIQAPRRVALRVRAAAAAVAVEAAEVDYSSNISVFPMEACDLIGGEACNVQMYPEAKLSSSAAVAVSRAAAEEVDRDYLSYDEPTTVFPEEACDDLGGEFCKAT

SEQ ID NO: 183702 - protein, 63 aa, Triticum aestivum
  Clone ID: PAT_TA_78120.pep
LADVWSCGVTLYGMLVGAYPFEDPDDPKNIRKTIQQIMQVQYKIPDYVHISTECQQLLARIFV

SEQ ID NO: 183703 - protein, 77 aa, Triticum aestivum
  Clone ID: PAT_TA_78121.pep
HLSFNLVYLYGFTDFVDRCEIALQTHPEFRNKWRCYCSLEGCVNQHIQQSLRHVLECHGCFVHLRRKMPQEASRQRL

SEQ ID NO: 183704 - protein, 67 aa, Triticum aestivum
  Clone ID: PAT_TA_78122.pep
FFFFFFFDTNPYECLVATYTVFNYRQVTTTEVAKRQKSYFASTLTDNYSSQVLRLSESTTAENISRN

SEQ ID NO: 183705 - protein, 156 aa, Triticum aestivum
  Clone ID: PAT_TA_78123.pep
SDLRKLAVYLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSSVCDIPPIGLKMASTFIGNSTSIQEMFRRVSEQFTAMFRRKAFLHWYTGEGM

SEQ ID NO: 183706 - protein, 170 aa, Triticum aestivum
  Clone ID: PAT_TA_78124.pep
SNEMFLPVPMAFIYNMEDGLTNDIPTTLHRSKADCSVPEEMVTVSVDGSVLDRIAKIMSYLRLGSSGKVLKKKKKERDTKGKNSLASGDYDEVARPGQTNGSALKHQFEKDMPPPPPPRNNNLSKNEKPSVPVARADEDDIFVGDGVDYSVPNKEMSQSPVSEDMDESPH

SEQ ID NO: 183707 - protein, 55 aa, Triticum aestivum
  Clone ID: PAT_TA_78125.pep
ALLFSLIMSGLREEEEATGTRIQVVEEEGCRIAGDRGHITIDSDVGTCLAIALMR

SEQ ID NO: 183708 - protein, 111 aa, Triticum aestivum
  Clone ID: PAT_TA_78126.pep
EEGADIIQTEGGKCSSPTKPGVLGLIEKATPTLAAAYSISRAVSIPVMCSSGLSSVTAPMAVTAGAAGVGVGSAINKLNDVVAMIAEVRSIAQAMGLAPRIVSENLRTVRH

SEQ ID NO: 183709 - protein, 110 aa, Triticum aestivum
  Clone ID: PAT_TA_78127.pep
GRGGPFEIQNLAFRVVVRGGYLTVNTLVAAVLPFLGDFMSLTGALSTFPLTFVLANHMYLMVKGPKLSAIQKLWHWLNVVGFTALAVAAAVSAIRLIMRDSSTYHFFADV

SEQ ID NO: 183710 - protein, 196 aa, Triticum aestivum
  Clone ID: PAT_TA_78128.pep
TWMVIFSLFWTLGTILEASLAWVVLPALNWRWLLVFTALPCFLLLPFFGLTPESPRYLCAQNRMSDATAVLERMANANQSALPPGILTYNRQTKFDDDALASESECLLPVREKECTVDNAKSSESGCLASLRILLSRKLLRSTLLLWFVFYANSFAYYGLVLLTSQLSDANKNCASGVNVGLHQKVTNLYKDTFIT

SEQ ID NO: 183711 - protein, 79 aa, Triticum aestivum
  Clone ID: PAT_TA_78129.pep
PDILENFSKEYMYLACVAYVKKVKKGPFVEHSPMLDDISGVANWKKVNSGLLKMYKAEVLEKVPIMQHFLFGSLIKWED

SEQ ID NO: 183712 - protein, 51 aa, Triticum aestivum
  Clone ID: PAT_TA_78130.pep
DSLHGCFFKNELWQVIEMGTTCDFLAVIKQTKAPIFSHKRGSALYHGFGWQ

SEQ ID NO: 183713 - protein, 120 aa, Triticum aestivum
  Clone ID: PAT_TA_78131.pep
KFATEHKCVSADVIRKAFQATEEGWLSLVSKEWSMKPQIASVGSCCLVGVICAGTLYVANLGDSRAVLGRLVKATGEAVAMQLSSEHNACHEEVRQELQSSHPDDPHIVVLKHNVWRVKG

SEQ ID NO: 183714 - protein, 55 aa, Triticum aestivum
  Clone ID: PAT_TA_78132.pep
TDGGAAAGRIVMELDANEVPKTAENFRALCTGEKGVGKSGKPLHYKGSTIHRGIP

SEQ ID NO: 183715 - protein, 64 aa, Triticum aestivum
  Clone ID: PAT_TA_78133.pep
VCFRDSRKDKTSKSKPLLMRSYQMQHPKHIVLSAQKDNYSRKLKRKYILSRKINWFSTMVTKLE

SEQ ID NO: 183716 - protein, 142 aa, Triticum aestivum
  Clone ID: PAT_TA_78134.pep
MLIPKNNRLAIYEYLFKEGVLVAKKDTNLPRHPLIPSVTNLQVIVTMKSLTSKGLVKTQFAWRHYYYYLTNEGIAYLRNFLCLPAEIVPATLKRKQTEARGTAGAGAGAGTGAGVGAGAGTGPGLGAPESKFKGYGRGKPVE

SEQ ID NO: 183717 - protein, 157 aa, Triticum aestivum
  Clone ID: PAT_TA_78135.pep
TAMEWAMAELITHRNAMHKVQDEIRAVVGVTGCVTEDHIDRLPYLKAVLKETLRLHPPNPLLVPHVPLADTEILGYTVPTHTRVLINAWTIGRDPATWGEHAEKFIPERFLNNNVDYKGQDFGLVPFGAGRRGCPGMGFAVPTIEMALASLLYNFSW

SEQ ID NO: 183718 - protein, 60 aa, Triticum aestivum
  Clone ID: PAT_TA_78136.pep
MMGPNVSSEKKALAAAKRRAYVTFLAGDGDYWKGVVGLAKGLRRVRSAYPLVVAVLPDVS

SEQ ID NO: 183719 - protein, 89 aa, Triticum aestivum
  Clone ID: PAT_TA_78137.pep
AVWRTQLFVCKAQKNDEAASDAAVVTSRRAALSLLAGAAAIAVKVSPAAAAYGEAANVFGKAKKNTDFVAYSGEGFKLMIPAKWNPTKE

SEQ ID NO: 183720 - protein, 188 aa, Triticum aestivum
  Clone ID: PAT_TA_78138.pep
LHVLDGFTFFFSNLFSRVQTLTLSQFLAKVVETDVRYTLLKASLTDDYTPENSYALLLAKEGVSPSITGKVSRSQIAALVADVFSNVAVAENKVVEVSTSSSATTKSITEAFIAIPEDSRRTEYQDAAAKAQVKEETLASKQANEAEAAASKYEADTKKAPLEDAAATASPVNDERASLENLLSIPKV

SEQ ID NO: 183721 - protein, 138 aa, Triticum aestivum
  Clone ID: PAT_TA_78139.pep
MVDVLLRMQNDKGAMGSVSLTHGIIVDMLMDVFVAAIKAITCTLRWTMAELMANPRVLEKVQTEIRRVLAGQYRVREEALRDLGYLKAVIKETLRLHPTIPLVPRFCTQDRKIQGYDVPKGTIVVANVWAISRDPNYW

SEQ ID NO: 183722 - protein, 72 aa, Triticum aestivum
  Clone ID: PAT_TA_78140.pep
FVAAELSVHSSPYCKSNLYSGWGCLPLPFRQVSKVYPGGKLTFDVFSTAIGNVFYFYSKYIGNLVFFFLSAS

SEQ ID NO: 183723 - protein, 56 aa, Triticum aestivum
  Clone ID: PAT_TA_78141.pep
MSGGIARGRLSEERKAWRKNHPHGFVARAETLADGTANLMVWNCTNPGKQGTDWER

SEQ ID NO: 183724 - protein, 170 aa, Triticum aestivum
  Clone ID: PAT_TA_78142.pep
ERERGELVVQTRPSAPVNELQPVQNECLPEGSVSTAGTATENEKSIQQAQQSSKDIQSKSQGASTRSCTKVHKQGVALGRSVDLSKFTDYDELKAELDKMFEFNGELVSANRSWQIVYTDNEGDMMLVGDDPWEEFCSIVRKIYIYTKEEVQKMNSKSSAPRKEEPLTVG

SEQ ID NO: 183725 - protein, 94 aa, Triticum aestivum
  Clone ID: PAT_TA_78143.pep
YGPSIVDECLEAIIVSKETLPGGHAVNRKRAERGLTQLQIEVVELVPEKSTGNKISSTAFRKMEAERELQQQETAIGSHSIQKIESSEGIAATE

SEQ ID NO: 183726 - protein, 127 aa, Triticum aestivum
  Clone ID: PAT_TA_78144.pep
RIHSLVDLLMKVLARPDLPFYLYTVPPKKRIMDTSQDFCTAGFVPGANVHFSYDLPEGSLVNADDLKAGPFLREEIRSLDGLSLLLKPASQPDDSRMNSSTLQSGASQSDPVPTTNKKPGRPKWLKR

SEQ ID NO: 183727 - protein, 183 aa, Triticum aestivum
  unsure (1)..(183): unsure at all Xaa locations
  Clone ID: PAT_TA_78145.pep
LLPPSLIIIICSFLINNGTGTGXTIYPPLSNNIAHNNISVDLTIFSLHLAGISSILGAINFICTILNIIPNNIKLNQIPLFPXSILITAILLILSLPVLAGAITILLTDRNLNTSFFDPAGGGDPILYQHLFXFFGHPEVYILILPGFGLISHIISQESNKNETFGNIRIIYAILTIGLLGFI

SEQ ID NO: 183728 - protein, 117 aa, Triticum aestivum
  Clone ID: PAT_TA_78146.pep
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELR

SEQ ID NO: 183729 - protein, 121 aa, Triticum aestivum
  Clone ID: PAT_TA_78147.pep
MQPRQPTNDNDINRHPQTLTRRASYPCENYETERKGLGKRTLGDPQVTMGTSMVVDGSFVSSVSSDNSVEESSFRQLQDAVSQLDVQTKLCIRDGLYRLARSAQHRQVFPNMMNNNGDSQD

SEQ ID NO: 183730 - protein, 172 aa, Triticum aestivum
  Clone ID: PAT_TA_78148.pep
TVEIKTYPVFTEVPENTSERNFTVLIHLKAPLAQHLQPSSNLGDGNGLSTTRAPVDLITVLDVSGSMAGTKLALLKRAMGFVIQNLGSSDRLSVIAFSSSARRLFPLRRMTESGRQQSLLAVNSLTSNGGTNIAEGLRKGSKVIEERQAKNPVCSIILLSDGQDTYTVSPTA

SEQ ID NO: 183731 - protein, 85 aa, Triticum aestivum
  Clone ID: PAT_TA_78149.pep
LQFSVPFWPNQEDGGDLSQETHEIVKPVAVHSKNPINVDELVGMSKLSIGEPGQETVSTSLSLNLLGGQNRQSAFHANPQTRAQA

SEQ ID NO: 183732 - protein, 139 aa, Triticum aestivum
  Clone ID: PAT_TA_78150.pep
VPLSRSMPRGDSIRNQGPLLNRPSTVQKASSINTRLLPQGSGAALIGKSALLGTGVPPSRPLSFTPGPAPAQTTPSPKPLIAAPAVAPAPDKPASAPKGNSAELQKKTIALLEEYFGIRILDEAQQCIEELQSPGYYPE

SEQ ID NO: 183733 - protein, 74 aa, Triticum aestivum
  Clone ID: PAT_TA_78151.pep
LMSNCCSGKHSCPCSRVKLCYWIHLGSNTPTAMPGSLALYSPIGTPFSELGAVGKLNINMPVFTDSQQKKKKKK

SEQ ID NO: 183734 - protein, 47 aa, Triticum aestivum
  Clone ID: PAT_TA_78152.pep
LNHSILINYYFIYPIGFINILGTVFIKGFLILSYLLKDHILLFILLT

SEQ ID NO: 183735 - protein, 96 aa, Triticum aestivum
  Clone ID: PAT_TA_78153.pep
SLTDNNCSTTAPALYLRELQFYSNCACVILFQSEQGTLAFRVQIKHLLRLLPQAPYFPPAVVSEVHHCPLLVHHCLIGLSLLSRYPFCSIHPVLSV

SEQ ID NO: 183736 - protein, 135 aa, Triticum aestivum
  Clone ID: PAT_TA_78154.pep
NPDTDGRHNKDSSEICSAEQDSGTDTEECELVLKGKDACKEYIKSFLAAIPIRELQADIKKGLMASTPLHHRLQIEFHYTESCPAEISVPAPLSPFEAPFEFCWPEPPSPPPATEFAVTYPPAMEVAITQAVAVI

SEQ ID NO: 183737 - protein, 54 aa, Triticum aestivum
  Clone ID: PAT_TA_78155.pep
EIGCLANNNRAKTKREKKNKGYNKPGVTGYVRSLTRVPRHQRPVTQLIINRQNK

SEQ ID NO: 183738 - protein, 88 aa, Triticum aestivum
  Clone ID: PAT_TA_78156.pep
SPRVAVALLQVSDSHLVLLPIDRSLTACVSSIDDLIMVDSWHPSPVEGRCGLHLGLQGAHVAAALVVVSSRRRHAMDDAATADAEASC

SEQ ID NO: 183739 - protein, 39 aa, Triticum aestivum
  Clone ID: PAT_TA_78157.pep
AVIEQVGKEAGMSELRLSSVYLFHFELYHKEQLGDCSLS

SEQ ID NO: 183740 - protein, 111 aa, Triticum aestivum
  Clone ID: PAT_TA_78158.pep
WTPDSVYGLSFSETAGASRSASKGTLYKLLALLCRTALVQTAMCVSSSPMMLLWCLRRFKFVSSRADKTSLFIFLSSQMLSDQVQNWTGSEGVEHELVKNWHMWSKTLRFF

SEQ ID NO: 183741 - protein, 147 aa, Triticum aestivum
  Clone ID: PAT_TA_78159.pep
MAAFNKLGSLLRHSALASGVAASSSPAVFNAARLMSTKLFVGGLSWGVDDMKLREAFSGFGDVTEARVITDRDTGKSRGFGFVNYTSSDAANAAISGMDGKEIDGRPVRVNIANDRPAGNRGGGGYGGGGFGGGGYGGGNQSYGGGY

SEQ ID NO: 183742 - protein, 79 aa, Triticum aestivum
  Clone ID: PAT_TA_78160.pep
GIKYAPTIVYLGAIVLQLLLLFSRTSLMLISISNSIVLLMADYWIFYKLMHYLCLPASVCVVCLSALTPDACSQHKAIV

SEQ ID NO: 183743 - protein, 135 aa, Triticum aestivum
  Clone ID: PAT_TA_78161.pep
KIKLKGVEEEEVSPGFVICDPVSPCNVGKIFDAQVVILEHKSIICPGYSAVLHIHTAVEEISVRAILCLVDKKTGEKSKTRPRFVKQDQIAIMRLECTGGMICMEPFAQFQHMGRFTLRDEGKTIAIGKILRVVE

SEQ ID NO: 183744 - protein, 104 aa, Triticum aestivum
  Clone ID: PAT_TA_78162.pep
FFLFLFHLSFFKHKKPSCIITVYMLQHVLSYTQVHTITGDRGERLICRGEGTHLLSWCWPTITGVLCYKQIEDSMDRSGSSELDQSALLAGAADVVGDLLAALR

SEQ ID NO: 183745 - protein, 252 aa, Triticum aestivum
  Clone ID: PAT_TA_78163.pep
CKSKRGSNYTNLEDIQLCKSWIHISNDPIIGNQQPGKTYWERIANDFHMNRNFESDRTPNSLEHRFGIILKECMKFQGYYEEVERCHPSGIPYQEHLLEAHARYARKANGKNCQFEQCWLTLRHTQKFESTLEANKKPAKSRELNLSVGIEQENDESSAQGQETSSIPSAKKARPPGRKQSKEKLKKNEGDDDYKDMMQNLLVMKTEEHMMKKERWEKDMMLEQRKLKMEEEWLQWEQEQKIMFCDVTTMDD

SEQ ID NO: 183746 - protein, 114 aa, Triticum aestivum
  Clone ID: PAT_TA_78164.pep
FMSRKITNSELYRRVHRRKKAHNGQLKGHKGESQDYIQARGLFVEQEVGKNKEAALKHLIMNHKLWYLTCDFLASNAVPASCLVPPYAIRQCLRILSRFPSAGPPSIHPMSKGL

SEQ ID NO: 183747 - protein, 135 aa, Triticum aestivum
  Clone ID: PAT_TA_78165.pep
QLNHQVLVANIPLMDSSSSFVLVVLILQAVVIGCSSLDELPVQLSNRRLLHDRNHAALLYKDHFPTVGNMTFPTSHQLQNDPNYKPLDSSSHPAEASAKKGSSKGFKKWLYMVVIPVAGLIMLAGMAWMFLPCRK

SEQ ID NO: 183748 - protein, 75 aa, Triticum aestivum
  Clone ID: PAT_TA_78166.pep
FFFFFFFFLTRSGSSSCLYEDSSILSVHSTDLFHGNYCSFQHDFSKLCNTHHPKNLFQGNLLLFLVQRRHSLPLV

SEQ ID NO: 183749 - protein, 157 aa, Triticum aestivum
  unsure (1)..(157): unsure at all Xaa locations
  Clone ID: PAT_TA_78167.pep
AKKAAEEXSNTENNNASSSNSDSVMAEAEPASNAAAGDKKEQPKDDDDLLQQALAMSMEGGASGSAAVTDSAMAEAGAVDPDLALALQMSVQDANMSSDTDMSKVFEDRTFVSSILNSLPGVDPNDPSVKDLLASLHSQGEQEKKEDKSDKTEDEKN

SEQ ID NO: 183750 - protein, 130 aa, Triticum aestivum
  Clone ID: PAT_TA_78168.pep
FILSIQDGMWVVPSEYTSAEPDPLRNFAENIVEEFNSKNAEDVHRIYNIYVESDLQVADVKIIWVDRLGFDFHVHSGEGVFAVRIPFSREVTDEKGVKSSFNMMSHHAWEVEKSYASPEFEKVQFLKKVR

SEQ ID NO: 183751 - protein, 77 aa, Triticum aestivum
  Clone ID: PAT_TA_78169.pep
MAALLGRRFGMAAAALIALAALGSAASGTASKSSFVKSTVKAHDVVIFSKSYCPYCRRAKAVFKELELKKEPYVVEL

SEQ ID NO: 183752 - protein, 101 aa, Triticum aestivum
  Clone ID: PAT_TA_78170.pep
YNLFVSQLGNGTLIPHSSSSNQLAKDSPMIEEIMNISRGQRQVIHQLDNLTNLLHEHLVLTRQANNASRNRVLDIDTVMCPLICLTVASIGYFMFKGLNRG

SEQ ID NO: 183753 - protein, 138 aa, Triticum aestivum
  Clone ID: PAT_TA_78171.pep
VRARAPLVQCITNLVSMDIAANVLLASGASPAMVHSLREVPDFTPRCAAVYINVGTLSEDWLPSMRAAACAGRPWVLDPVAAAASGFRMEACLELLSLCPAVVRGNASEILALASRSAAASSSNFKGVDRSHGSGDAI

SEQ ID NO: 183754 - protein, 50 aa, Triticum aestivum
  Clone ID: PAT_TA_78172.pep
RLTVWKTSQSTKACSPLYLEMCSCTCRNSMDLASMRVRGGAFHQTSLENL

SEQ ID NO: 183755 - protein, 114 aa, Triticum aestivum
  Clone ID: PAT_TA_78173.pep
KQTLVSRCHPEDVHAGQDTDVLKTCGSERGRADASSPVILHAVAVGTPNCGLDNRPPSVTCRRADHAAARSGLGRPHCRAPVTARRPQASRATTATRQDGPDCCRRARGQQPQA

SEQ ID NO: 183756 - protein, 66 aa, Triticum aestivum
  Clone ID: PAT_TA_78174.pep
IPAAQYSIANISYELNVFGTRGPRRMRCLMHSIPASSLEAGGTVPSQPDSLLAHSLNESSFRSVSF

SEQ ID NO: 183757 - protein, 83 aa, Triticum aestivum
  Clone ID: PAT_TA_78175.pep
EFARYASLEWHVHAILTLPLVCPLSHRCRHIDTVWQSSITPLFCGRKYMGPKHQNGSKTPECQLPHFDEHRDLKCLVSCNLSI

SEQ ID NO: 183758 - protein, 43 aa, Triticum aestivum
  Clone ID: PAT_TA_78176.pep
IPYLIRRAEENRGLLSASSFDRHLLRKELVRRVKTAVVGMGRE

SEQ ID NO: 183759 - protein, 236 aa, Triticum aestivum
  unsure (1)..(236): unsure at all Xaa locations
  Clone ID: PAT_TA_78177.pep
ELIDAKTKXTKETLEVDAALIATGRAPFTKGLGLENINVVTQRGFVPVDERMQVMDATGNVVPNLYCIGDANGKLMLAHAASAQGISVVEQISGRDNILNHLSIPAACFTHPEISMVGLTEPQAREKADKEGFEISVVKTSFKANTKALAENEGDGLAKMIYRPDTGEILGVHILGLHAADLIHEASNAIALGTHVQDIKFAVHAHPTLSEVLDELFKAAKVNTGVLHSINEPVAV

SEQ ID NO: 183760 - protein, 170 aa, Triticum aestivum
  unsure (1)..(170): unsure at all Xaa locations
  Clone ID: PAT_TA_78178.pep
RIIYAARGIFNRFIPDVHIDKDHRSGSAGGRSPGYGVTLVAETTTGCLLSVDVTVSCPIVDEINEESEKPELTSPEDLGVQAASMLLEXVAQGGVVDSTHHGLLFILCALCPPDVSKVPVGQLTPYGIETLRNIRDFLDVKFIIKPDPNSNTVTLKCVGAGVKNLARKIS

SEQ ID NO: 183761 - protein, 74 aa, Triticum aestivum
  Clone ID: PAT_TA_78179.pep
EQGALLGVIQSLLCLRAIQLFSHSTSQRNMTMQVKYSQRLKSDIFKIYTYCSHRVNISTKYVSKEDLFDKLFFR

SEQ ID NO: 183762 - protein, 90 aa, Triticum aestivum
  Clone ID: PAT_TA_78180.pep
NVNVHFSHVFSRSLNISTRFCCSEDEVLPSSLFSMTRIYDNLQNQSYIMMINKFVKNTMPRKTIATAEIDATMVLYCYPSLFVLQNDHDS

SEQ ID NO: 183763 - protein, 170 aa, Triticum aestivum
  Clone ID: PAT_TA_78181.pep
GLVPNSARGIEALLSDEIFQPKVFWSLADVQATCGTLGLSTATVKLIGPDGEEKIACAVGTGPVDAAYKAVDDIIQIPTVLREYSMTSVTEGIDAIATTRVVVTGDVSDSKHALTGHSFSRAFSGSGAALDIVVSSVRAYLSALNKMSSFVGAIKASSEVSESQRVQTTE

SEQ ID NO: 183764 - protein, 90 aa, Triticum aestivum
  Clone ID: PAT_TA_78182.pep
DYFFCYTSPPSAGYSPRDASPEYTPSIPLISLPRRAASPDYTPSSPSVVSDAVSRTSPPSHRRFHPYQRSRTSCCQSHLPPPSMDTKRIQ

SEQ ID NO: 183765 - protein, 70 aa, Triticum aestivum
  Clone ID: PAT_TA_78183.pep
FDRSCFQSIISEFQSIVSYSYQRTLFRLIDRPPSSCLSRSVSVVTFVCVCVCVCVCVCVCDRQSQMFVAC

SEQ ID NO: 183766 - protein, 182 aa, Triticum aestivum
  unsure (1)..(182): unsure at all Xaa locations
  Clone ID: PAT_TA_78184.pep
MSPTASMRLPSDSPKLGTRLVCSLRKSVNKQSDPNSFQEEANSNNEQEWQSDSQVAGKLALSCDSCDNRLPSKVSKKGSKGCSWCSVDYRHYKKLLQLKXYYGICKEIXHHTNGGNXILYQCKACKERMMSLNEWEKHTDLRTRNWKISIKQKSMGEPLINLISPLIFVKLFFNQTPRPYDT

SEQ ID NO: 183767 - protein, 120 aa, Triticum aestivum
  Clone ID: PAT_TA_78185.pep
FFFFFFLNSIPGNFSPCLRSYIQELMNYPERLFLRNVNAHLSATFSPGGIGRGRASESSVALLMPRGKSQHGLQQQANRKPSTETVIRSRSLTDVPSLEKSSADLADLGIVFCSEFRADQ

SEQ ID NO: 183768 - protein, 224 aa, Triticum aestivum
  Clone ID: PAT_TA_78186.pep
MQASNAVAVPYQVPAQVSGPPTITNAPNFHPVCTVQLRPPTNGGLTVQTMGNASQVAFGYPAVQLPTLETSSSWAFGAPPQAVSSFTAKEQTGTKQADDGKKPQEAGASSSAHAEDEKKADRGLSLMGSAIRPGIAPNVKFGGSGSYPDLPWVSTNGAGPNGRTISGVTYKFGRNEVKIVCACHGTHMSPEEFMRHASADAPAQENSATLPAFPVGNQATSAEN

SEQ ID NO: 183769 - protein, 216 aa, Triticum aestivum
  Clone ID: PAT_TA_78187.pep
CPIHISRDNRCTKVLKGLLQNLLYLGPIYCLAAAGGFPLLAAPFTAVLAWLLGGGLATLLAPSIVGLAWLLDSGIAALLVLFTAALAWLMDGGFTTLLAPFTATPFGLAWLLLDGGFALLAPSATLLVWLLAGTPQLKTVALLVVIWLPFVFMACFRGDAWQQAGTGVAALLTSVLFGALALTVSTMPRGVPAAECETGILVFFPSCCHSSSYRLN

SEQ ID NO: 183770 - protein, 113 aa, Triticum aestivum
  Clone ID: PAT_TA_78188.pep
GRNQAAYLTSLDLRKKQRSTCEEETKRIQDFRDPCPISLDLSKEKEQQKRNKLKPPDTALHLSLAASAGYIQCRTTLLSLSAVRCPLRRARAPRTAWKKEIFLGEEFFKKKIQ

SEQ ID NO: 183771 - protein, 54 aa, Triticum aestivum
  Clone ID: PAT_TA_78189.pep
TYNPSLSVLIKPKSNNNPIIYIHHTVCAGTCVAVLVYTQSFTSLGRSTTKVATC

SEQ ID NO: 183772 - protein, 110 aa, Triticum aestivum
  Clone ID: PAT_TA_78190.pep
HHPDAVLCCSFKEKPMFTFANKAGLDMLETSLIALQDLTLDKIFDESGRKAIFSDISKLMEQGYAYLPSGVCMSGMGRHVSFDQAVAWKVLGEDSNVHCLAFCFVNWSFV

SEQ ID NO: 183773 - protein, 70 aa, Triticum aestivum
  Clone ID: PAT_TA_78191.pep
QIEKWQFSRILTPTNQTGPTNKTDDMVLQPKKHLWNFKPSTICSNGVGELPIETAHFPSTSAQTPTIHMH

SEQ ID NO: 183774 - protein, 178 aa, Triticum aestivum
  Clone ID: PAT_TA_78192.pep
PAPEAEAEEAELNLILLRKMGMGCTNMLSQSQLSKIKMLASRPDICKRNSHLKLCYNLRNRNVFVPNTNKPQLGPLHTNKPQLGSLQYKKGKEHVYDVSGQTPTCAKVALEHYNRSYEDEYEMVKALDSVSSFFNGVWVHVNFLAKLKGATQCPDLVPKFFFAEEVQRQHQFVVVGFA

SEQ ID NO: 183775 - protein, 176 aa, Triticum aestivum
  Clone ID: PAT_TA_78193.pep
MASSTCALALVLALSVGASVARGSEPWWNETQVYTTTANSGGSNGVFVGLTLIQSAAAKGAVCLDGSLPGYHLHRGFGSGANSWLVNLEGGGWCNDVSSCVFRKGSRRGSSNHMERQLQFTGIMSNRPDENPDFYNWNRVKVRYCDGGSFTGDGSDAAAGLYFRGQRIWQAAMDDL

SEQ ID NO: 183776 - protein, 221 aa, Triticum aestivum
  Clone ID: PAT_TA_78194.pep
HEAEVLLLASGKDNLLPSGEEADRLFKALKNCRVRYFKDNGHTLLLEDGVNLLSVIKGANMYRRGRQRDFVTDYLPPTLSEFKQTFDVDHKLFHLALSPVMMSTLKNGKVVRGLSGVPDKGPVLFVGYHALMGIELSPLYEEFLREKKTVVRGMAHPFLFGNKFDSSRQEISRIDTVSMYGGLPVTPINMYRLFKRNDFVLLYPGGVREALHRKGEEYKLF

SEQ ID NO: 183777 - protein, 130 aa, Triticum aestivum
  Clone ID: PAT_TA_78195.pep
QIHFLYPSGVDRFQRQFAHLEENYRRGVASTPPRIKPTSLPRERVCSSKDSHNQDSDNEEQRAGSYVARTIISPPRSQEEGRKLQSSYQCATSTADSCAKSYLKSAANISASRHGIKGKTGRKEKESPRL

SEQ ID NO: 183778 - protein, 97 aa, Triticum aestivum
  Clone ID: PAT_TA_78196.pep
ELLKEPLPDFVLGSDVIYNEEAVGDLQATLNQLSGKHTTILLAGELRNDAVLECFLEAAMEDFLIACIEQDQWHPEFRSNRVALFILIKKPEKPSTD

SEQ ID NO: 183779 - protein, 113 aa, Triticum aestivum
  Clone ID: PAT_TA_78197.pep
TISEPRKKEIRNAMARAKNSSSGNGEVDVQKVEKIAPVYNLVTKPSVYGANRRATTVKARPATTAVAAGFAGSSNSRQPAPAPASWPHGSVVTKEFISKYIEDKKRQFNQGDE

SEQ ID NO: 183780 - protein, 129 aa, Triticum aestivum
  Clone ID: PAT_TA_78198.pep
GDTVLRGGGIQPLPDQVDAAAAGGRDVFASTARRAMGGCSTFSTAKRSTTTTTTKNPGTPHDAAAAAPQPEPSCDLGLWLSPGSPPAPGDRRSGGRRADTPSMNSEGSVTTCGVVGGGEREPELLNLFV

SEQ ID NO: 183781 - protein, 64 aa, Triticum aestivum
  Clone ID: PAT_TA_78199.pep
LMQFLKVACSCTISTPKERPTMFEVYQLLRAIGEKYHFSAEDDLMMLPPLSTDGETLDELIVAQ

SEQ ID NO: 183782 - protein, 155 aa, Triticum aestivum
  Clone ID: PAT_TA_78200.pep
EAAFLVLNDKFTCEQLLVCAQPEEHINMQIFVKTLTGKTITLEVESSDTIENVKAKIQDKEGIPPDQQRLIFAGKQLEDGRTLSDYNIQKESTLHLVLRLRGGVIEPTLRLLAQKYNCDKMICRKCYARLHPRATNCRKKKCGHTNNLRPKKKLK

SEQ ID NO: 183783 - protein, 90 aa, Triticum aestivum
  Clone ID: PAT_TA_78201.pep
HEGRQSVPWEGGSRRVFFLLLSSLSFSRRIICVQIPCFSLGLAYCAELVFSSMASCSYSFGYVELFLSLLESVVDVELLSVQKGVLLWVD

SEQ ID NO: 183784 - protein, 95 aa, Triticum aestivum
  Clone ID: PAT_TA_78202.pep
ARGALLVLTNGRFRSVRHRVMVSSGRPRVSVIFFGGPPPRERLAPLPGLVDREGGRRRYREFTWREYKTSAYRTKLADNRLCYFETTTAAAAANS

SEQ ID NO: 183785 - protein, 77 aa, Triticum aestivum
  Clone ID: PAT_TA_78203.pep
RARPQFGWMERSELPQTNQPPKYKLYQYVLWVAALLLLVVGFVIILVMLFKGKNGNDSCHWCHYLNCVPTSRWKCDT

SEQ ID NO: 183786 - protein, 86 aa, Triticum aestivum
  Clone ID: PAT_TA_78204.pep
RGGRPHRRALGDPPPRTGRPAGVHAYIHVRVCACITIAYQGRHERNYASTVDRTSSSSTYTINASCSSRRYGGIYTCVVFSYYGLV

SEQ ID NO: 183787 - protein, 231 aa, Triticum aestivum
  Clone ID: PAT_TA_78205.pep
ADSLTKRKPCSAPKWKEMTGSGIFAAGSNGDAGEAAAAAAKPARTASRQAISTVSHISFAEDGTDPPKKPTSVAEVAKQRELSGTLQSEADSKMKKQISNAKSKELSGHDIFADTPDSRSNRARNSSNGSTASHTPVKNTNASTFSFGEANTDSAPKTAKKITGKKVNDLTGNDIFKGDAPPASAEKHLSTAKLKEITGSNIFADGGKEPIRERVGGNRKPPGGESSIALI

SEQ ID NO: 183788 - protein, 88 aa, Triticum aestivum
  Clone ID: PAT_TA_78206.pep
LGVCLLQGRSHRPNLPLLLSWAEGGQVLSGSFCSTLMFYLCSPRYFWSSLWLSVDSLWSNVGVGNNYRLLVMDVEMSPFKKTSGLLDS

SEQ ID NO: 183789 - protein, 145 aa, Triticum aestivum
  unsure (1)..(145): unsure at all Xaa locations
  Clone ID: PAT_TA_78207.pep
MNILKRVWKCKNISPVIKTFIWRLIRRAIATGEHANALTDIEKDCALCGFPENDVHLFFHYEFARAVWFSAKTPLLSSALPQEQDGVQHCLAXIITPQIPVDILVQITTYLWFIWKARNDLRFHKRSWSVLQVHLAVRTHIHSFA

SEQ ID NO: 183790 - protein, 151 aa, Triticum aestivum
  Clone ID: PAT_TA_78208.pep
MAEEAAKKVEVEVTKDKEPEAAPAEAVPEAAAKEDVAEEKAVIPATEPPAAEEKPPADDSKALAIVEKVADEPAPEKPAAEKQGGSNDRDLALARVETEKRNSLIKAWEENEKTKAENKAAKKVSAILSWENTKKANIEAQLKKIEEQLEK

SEQ ID NO: 183791 - protein, 200 aa, Triticum aestivum
  Clone ID: PAT_TA_78209.pep
DEGKICVSVNIADALDYLHHDCGRPTVHRDLKPSNILLDDDMNALIGDFGIARLCIESGQKTGLVSSIGGTIGYIAPEYAGGGHASTSGDVYSFGVILLEMLTGKRPTDPMFGDGLDIVKFVETSLPHQILNVIDACLIDESEEFARAKPESENMIHQCLVSLLQLGLFCTHPVPSERMNMKQIATKLHDIKASYRIESK

SEQ ID NO: 183792 - protein, 120 aa, Triticum aestivum
  Clone ID: PAT_TA_78210.pep
FFFFFFFNKKTVCVLHLGTKTPHSSLIQFSHSTHHHQQQQSSRNLSFSQVSTPTHGSTDLIWLASTTSLPFPRWQGNTGAPTNRSRAGLQLHQIQQWRKRCTDIQYVLVLLVAFTSLGRG

SEQ ID NO: 183793 - protein, 219 aa, Triticum aestivum
  Clone ID: PAT_TA_78211.pep
MGRRPARCYRQIKNKPYPKSRYCRGVPDPKIRIYDVGMKKKGVDEFSHCVHLVSWEKENVTSEALEAARIACNKYMTKSAGKDAFHLRVRVHPFHVLRINKMLSCAGADRLQTGMRGAFGKPQGTCARVDIGQVLLSVRCKPNNAVHASEALRRAKFKFPGRQKIIESRKWGFTKFSRDEYVRLKSEGRIMPDGVNAKLLGCHGRLSARAPGKAFLSAA

SEQ ID NO: 183794 - protein, 72 aa, Triticum aestivum
  Clone ID: PAT_TA_78212.pep
PSNCFSIPTKEHTICNVMLRCSGCPSHNLQPHEKCTYSKRPVSSTLQDRSACITSIASHTCSQVSRTSATEW

SEQ ID NO: 183795 - protein, 223 aa, Triticum aestivum
  Clone ID: PAT_TA_78213.pep
GVELTDDRIKGTVEDMIGGGTETTIQTLEWTMAELIANPRVTAKLKNEITRVVTADQPTISESDLNRMEYLKAVFKEVLRLHAPLPLLVPHESTAPAVVQGYEIPAKTGLYINVWAIGRDPAAWDAPEEFRPERFVGSSSPVDFRGNDYQFIPFGAGRRICPGINFALPVLELAVASLMRHFDWELPAGMQLTDLDMSETPGLMTPRRVPLVVVPRTVPQPAL

SEQ ID NO: 183796 - protein, 62 aa, Triticum aestivum
  Clone ID: PAT_TA_78214.pep
NMPLASLPGTDPWFKPRDVANMAVPQTPLRHDRPWWIAFVILGVLSKNASYTLPDWHGPFVI

SEQ ID NO: 183797 - protein, 78 aa, Triticum aestivum
  Clone ID: PAT_TA_78215.pep
LFVTVHTVVDPVFCTCYSFDAEEVRSALDLLEFRTIDHAMQPVCNFIAFWRGFHSVPCMGFTISCLFSGKKKKKKKKK

SEQ ID NO: 183798 - protein, 86 aa, Triticum aestivum
  Clone ID: PAT_TA_78216.pep
MATVPVNPKPFLNNLTGKTVIVKLKWGMEYKGYLTSVDSYMNLQLANTEEYIDGQFSGNLGEILIRCNNVLYLRGVPEDTEIEDAE

SEQ ID NO: 183799 - protein, 195 aa, Triticum aestivum
  Clone ID: PAT_TA_78217.pep
CFTSFSSEEIIESLKRIFDQNVRLIVRSTANVEDLAGMSAAGLYESIPNVSLSDPSSFCAAGGQVWASLYTTRAILIRQAAGVPQRDAKMAVLVQEMLQPDLSFVLHTVSPVDHDPKLVEAEVAPGLGETLASGTRGTPWRLSCHKFDGKVTTLAFANFSEEMVVLNSGPTDGEVTHRTVHYSKKPLSVDATFRG

SEQ ID NO: 183800 - protein, 50 aa, Triticum aestivum
  Clone ID: PAT_TA_78218.pep
INKEESLCMYVCMYVCMYVCMYVCMYVCMYVCMYVCMYVCMYVCMYVCMY

SEQ ID NO: 183801 - protein, 87 aa, Triticum aestivum
  Clone ID: PAT_TA_78219.pep
VTNNKGINGVLLLYTSRLVNQIFFVVPLFFPASMHIGSPSPHGASEHDRSRTCPAHWEDYTSCSLYGDRRSSISNLQGQKRKGSKES

SEQ ID NO: 183802 - protein, 199 aa, Triticum aestivum
  Clone ID: PAT_TA_78220.pep
AAFMSKDKAAERTLGDIILQKIMEKDAEVATEGRPRVKLDNSIIELYKEVGKFLSRYTSGKIPKAFKRIPSLECWADVVQLTEPENWSPNAVYQATRLFSSNMNTKNAERFYEAILLPRVRNDIRKNKRLHFALYQSLKKALYKPAAFNKGILLPLCRERNCTLREAVIIGSIIQKVSIPFLHASVALVKLAEMEYCGT

SEQ ID NO: 183803 - protein, 158 aa, Triticum aestivum
  Clone ID: PAT_TA_78221.pep
ASINERPIIFSLSNPTSHSECTAEQAYTWTQGRAVFASGSPFAPVEYDGKTFVPGQSNNAYIFPGLGLGLVISGAVRVHEDMLLAASAALADQATEENFVTGSIFPPFTNIRKISAYIAAAVAAKAYELGLATRLPPPKDLVAYAESCMYSPVYRNYQ

SEQ ID NO: 183804 - protein, 91 aa, Triticum aestivum
  Clone ID: PAT_TA_78222.pep
ARGTRCRQDGSTTFMRSWALQGSMDGRNWTSLRVHDDDPTICHPGQFASWPIVGPAALLPFRFFRVALTGPAAGCAWNLCICFLELYGYFR

SEQ ID NO: 183805 - protein, 78 aa, Triticum aestivum
  Clone ID: PAT_TA_78223.pep
ARGSYVANFGYDPSKIKDTPQDCEYMSSDQIALMMSMPGMNEALTNQFPDLKLKAPVALNPFTSVFDTLKKLLELYFK

SEQ ID NO: 183806 - protein, 101 aa, Triticum aestivum
  Clone ID: PAT_TA_78224.pep
CADRWHDDGGLPAALIHQGSLFAIQKGYRLIAVMPAKYLLDKLILLRFMGAELYLTDPALGFAGMFDKVEQLREQLPNVLVLNQVTKNLQNFFRFPVTSNV

SEQ ID NO: 183807 - protein, 54 aa, Triticum aestivum
  Clone ID: PAT_TA_78225.pep
ARGFDCLMKTYGFLTPEFCTETKYMKTPFLEFTDLLAKPTKGLLIKAPTETVEA

SEQ ID NO: 183808 - protein, 119 aa, Triticum aestivum
  Clone ID: PAT_TA_78226.pep
PEREWSGASERRRDREKDMPPEQEWSERRHRNEHDMGRERDRDYGRDRERDRDRERDRDRERDRDRERHRDDRDRYGDYHKHRDRDSERNENWDRGRSSGLRSRSREADHSKRRRMTPQ

SEQ ID NO: 183809 - protein, 241 aa, Triticum aestivum
  Clone ID: PAT_TA_78227.pep
ARGNFFAVLLGNKTALKGGSGKVVDSGPNDHIFVFYSDHGGPGVLGMPTYPYLYGDDLVDVLKKKHAAGTYKSLVFYLEACESGSIFEGLLPDDINVYATTASNAEESSWGTYCPGEFPSPPPEYDTCLGDLYSVSWMEDSDFHNLRTESLKQQYKLVKDRTAVQDTFSYGSHVMQYGSLELNVQKLFSYIGTNPANDGNTFVEDNSLPSFSKAVNQRDADLVYFWQKYRKLADDSSKKNE

SEQ ID NO: 183810 - protein, 258 aa, Triticum aestivum
  Clone ID: PAT_TA_78228.pep
ASANIQHLSLQTEDLVASKSTEDNPAVIIPDHLQLANADCGHLSFGSFGSGAFSGLLPSKVHKNGVEEVPVPDESPSVDQEDVRNQDNNVALNSSTNGDVEARIGTNMENTDEPSVSQPDILTQGAVDVSSLQYNLPSVSDHVYSNTTQPSTMESSQGDIQVQHLPQFSSLLQANTLHNNLLGSNLPNLRDFDFSPLLSTQLATKYNPPVPTTSLPAISMQETLKPGGFSNAQSTQNLPSVSIPSGPPLPQQLSVHPY

SEQ ID NO: 183811 - protein, 111 aa, Triticum aestivum
  Clone ID: PAT_TA_78229.pep
TRLNLWLKKWVRALITRSFAIVPTIIVALFFDTSDSALDVLNEWLNVLQSIQIPFALIPLITLVSKEQVMGVFKIGPNTQAVTWTVATLLKFEAPYLAHFSAWRSSSMLRL

SEQ ID NO: 183812 - protein, 95 aa, Triticum aestivum
  Clone ID: PAT_TA_78230.pep
KYQKITKTKEDLYCFFLEEYVHLTKTTPGPKRQRETSFNSSAGAAERERKTAVKRLAPPARLFATPGLRWAGCGGAVARSRLRGVLVRHVGRWEK

SEQ ID NO: 183813 - protein, 67 aa, Triticum aestivum
  Clone ID: PAT_TA_78231.pep
PDSSSFCKFSDKFKNLTFVYADIDECPETTQNIRYTPTFHFYRDGERVDEMLGTGEERLHDRLWLHS

SEQ ID NO: 183814 - protein, 49 aa, Triticum aestivum
  Clone ID: PAT_TA_78232.pep
LVFKNLKLIQTSPKSTNVSVRPFKAKEHTQRSHTSYSTINLKHARFSSL

SEQ ID NO: 183815 - protein, 71 aa, Triticum aestivum
  Clone ID: PAT_TA_78233.pep
SLSLSRIARSLPHPRPDPLHLPNPQRAPEEIRRRSRRPRRAAVTPSPLDSVACALGSSSYASRFSLRVFFF

SEQ ID NO: 183816 - protein, 123 aa, Triticum aestivum
  Clone ID: PAT_TA_78234.pep
IFSCLFREHAEDFDENMVVCHGERSRSLNPGFWISLLINKQMTSDGTTPYTAGQEGSVTIRSARGSRTPPGATVPAGWWHRWWDIAAIGDGGKGHAGGKEQGATPNRAREREHRRRHKCCPSC

SEQ ID NO: 183817 - protein, 250 aa, Triticum aestivum
  Clone ID: PAT_TA_78235.pep
HFQQVYIKDTDERACAYIAGPAPNRWGFATEGNDLFNVIRSSSGDAQVSESANTDLTERKHNDVRSHSLFFGITLSLLAEIINSRLFTTVRDSMGLTYDVSFELNLFDKLDLGWYVIAVTSTPSKVHKAVDACKGVLRGLHSNKIVERELDRAKRTLLMKHEAETKTNAYWLGLLAHLQSSSVPRKEISCIKELTMLYESATIEDLYLAYEHLKVDESSLFACIGIAGAESGEETTDDELDMGLHGMGPI

SEQ ID NO: 183818 - protein, 61 aa, Triticum aestivum
  Clone ID: PAT_TA_78236.pep
IVKLANRNSLMFRIFPGWRRKSPQVNLATSSFHNQYIYSYIIVLTHSNRKGEKNSGTCHEE

SEQ ID NO: 183819 - protein, 261 aa, Triticum aestivum
  Clone ID: PAT_TA_78237.pep
EGAACVLPPRRKACVLASCSREPPDRNRGLEVERRRLLMSGLVSSFAIVLPISEAYAVMETDEDVKMNTQVDEINAYSFLYPVELPGKKFSFKWVESRKPERYSSAAPLSPDARQRIVSERVDMIHNVVISVSIGPPNSRFLPSKDKSSWDPKDVADCILSDRSTLKVTTGQRMTESSVLDAHATEVDGEPYWYYEYLVRKSPTKSAPEPNLFRHNVACTAERDGFLYSLNASTLSKQWESMGPFLQQTVASFRLLPPTEN

SEQ ID NO: 183820 - protein, 78 aa, Triticum aestivum
  Clone ID: PAT_TA_78238.pep
TRESVDQTMSISTETDRNARFVKLVYSLAPACASGASTEVSSIVFSTVGAYPSVVFVSAGAMASCRVFSTVNSHVSQL

SEQ ID NO: 183821 - protein, 49 aa, Triticum aestivum
  Clone ID: PAT_TA_78239.pep
TFDYCGLSTAMVQQKSHPPVRLSRRTRRDTASRTPQRERERERERESLV

SEQ ID NO: 183822 - protein, 62 aa, Triticum aestivum
  Clone ID: PAT_TA_78240.pep
KKYKIPCNLEQRNYMIASSIVPRCTIDRVSYCASIIDTRMVQILHSSKLCLTLHQGTWLQPS

SEQ ID NO: 183823 - protein, 69 aa, Triticum aestivum
  Clone ID: PAT_TA_78241.pep
IRRLARRGGVKRISGLIYEETRGVLKIFLENVIRDAVTYTEHARRKTVTAMDVVYALKRQGRTLYGFGG

SEQ ID NO: 183824 - protein, 70 aa, Triticum aestivum
  Clone ID: PAT_TA_78242.pep
NPDLWKWLTSQEQPPEDLNSNPVFAAIKSKVTDNLTKHASPETRSTPGQPWVRGWDDIKKGKDGPKYGNQ

SEQ ID NO: 183825 - protein, 92 aa, Triticum aestivum
  Clone ID: PAT_TA_78243.pep
MNDHRDAPMRCRVQASWFGCSMGCSCCRLVRRCHDCCKLSRCPVFLSSSSCSKFLGKIDGGAIDRSAAEPDSARHRLRPVLEPSLHLVRAVA

SEQ ID NO: 183826 - protein, 70 aa, Triticum aestivum
  Clone ID: PAT_TA_78244.pep
PIYSVHTGKEKSLVISMDQFSVCYCLDSNTMQQQQKQETNITITEANQSLFTDRQCATTHKNQNLETVQV

SEQ ID NO: 183827 - protein, 42 aa, Triticum aestivum
  Clone ID: PAT_TA_78245.pep
MATLTVPSSVPAVAEDAEQLHKAFEGWGTNEKLIISILGHRN

SEQ ID NO: 183828 - protein, 125 aa, Triticum aestivum
  Clone ID: PAT_TA_78246.pep
MRQVVEKIATCAFIGFGDSNELILESRAGLLTLFIKCYFTVIKKVILDTIPKTIMYEMVNQIKENFQKDLISKIYKSKHFNMAELLLESKDIVDERVKTQNLFEASEKALKLMKEIELICLDSEL

SEQ ID NO: 183829 - protein, 221 aa, Triticum aestivum
  Clone ID: PAT_TA_78247.pep
ARGPDFFFITASLRFDGALNVDLTEFQTNLVPYPRIHFPLVTYAPVISAEKAYHEQLSVSEITNACFEPANQMVKCDPRHGKYMACCMLYRGDVVPKDVNAAIASIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGMDSVEGEGEGGEEY

SEQ ID NO: 183830 - protein, 58 aa, Triticum aestivum
  Clone ID: PAT_TA_78248.pep
FFFFFFFFFFFKVKSCACPRTACYLHSFPREYTKTTPWLSHKSSGGRCSEKKLETSSL

SEQ ID NO: 183831 - protein, 161 aa, Triticum aestivum
  Clone ID: PAT_TA_78249.pep
HEGCFYTSNTAFQDKGFDATGWELALVTAPSNTTSSSSVGQLGGGFDKLILDSLYDDGAYRQRQQQQLYGSAAPNPFMTNDPFAMSNQVAPPPSVQMAAMSQQHPQIPTMMQPNPFGPPMQPQMSMGPATNNPFLDSGFGAFPVANNGHQQHNPFGSAQLL

SEQ ID NO: 183832 - protein, 109 aa, Triticum aestivum
  Clone ID: PAT_TA_78250.pep
METGARNEIFALQPAPIQVSYMGFPGTTGAAYIDYLVTDEFVSPSRYSHIYSEKLVHLPHCYFVNDYKQKNRDCLTPGCPHKRSDYGLPEDKFIFACFNQLYKMHPDIF

SEQ ID NO: 183833 - protein, 92 aa, Triticum aestivum
  Clone ID: PAT_TA_78251.pep
KKIRKAEKKEKKFRDLFVTWNPISLENEGSDLGDQDWLLSSTRNSDASMAQCKSTGGVGPIHPMVQQQPSLQPRATFLPDLHMYQLPYVVPF

SEQ ID NO: 183834 - protein, 37 aa, Triticum aestivum
  Clone ID: PAT_TA_78252.pep
NSKGSSRLLIIFKNFNLKFNFNFYFIYKVYISFNLSF

SEQ ID NO: 183835 - protein, 53 aa, Triticum aestivum
  Clone ID: PAT_TA_78253.pep
PVAESEFDFSDSALSHDFLKANNLLAYDFIFSGLELCTQQVLATLWRKKKKKK

SEQ ID NO: 183836 - protein, 196 aa, Triticum aestivum
  Clone ID: PAT_TA_78254.pep
GSSCDRYVMGQGVGSYDGDSLEQTIARSRCHKGRLLYYFPRQFSKQIDVESVSSWCGWHTDHGSLTGLTCGLFTKNSVEVPCPDSAAGLYIRTRDNQVVKVVFDEDQLAYQIGETTEILSRGYLCATPHCVQAPNSENASNVDRSTFALFMQPDWNEKLKFPSEIPYHQELIPPNGTLTFGEYSERLVNKYYQTTT

SEQ ID NO: 183837 - protein, 78 aa, Triticum aestivum
  unsure (1)..(78): unsure at all Xaa locations
  Clone ID: PAT_TA_78255.pep
GALLSVIISTSSELFGLKHXGKIFNFIILANPVGAYLFNTLAGYVYDLEVAKQHATTSGSDIACHGPNCFRLTFCVLS

SEQ ID NO: 183838 - protein, 81 aa, Triticum aestivum
  Clone ID: PAT_TA_78256.pep
SQVSFTGNTHTHTDTVTVTSHRRRANSDGSCTGAQVSSQSSWQSVISALVADGAVDEVAAFGDGDGDLGLDPGALGGLGQH

SEQ ID NO: 183839 - protein, 173 aa, Triticum aestivum
  unsure (1)..(173): unsure at all Xaa locations
  Clone ID: PAT_TA_78257.pep
MEDRIRKKRHKIVQTKTGSPNPMKVVFNKFDFSNSYIWFEFYNALLPKDVTLISDSLRSWHIVGRLGGCNSMNMQLSQLPLDCKRPTYDALEGANVTPTSFYNIGDLEIQDNLARVXDIGIHEPLLLDILLNALTTISSDHVGIKQVQFGGLEFLNWSEDLKTEEVGYSVCKI

SEQ ID NO: 183840 - protein, 43 aa, Triticum aestivum
  Clone ID: PAT_TA_78258.pep
SYLTVQHNYRYFMEHLSKGIVFASRNYIGTGGFADDNCSFSLG

SEQ ID NO: 183841 - protein, 177 aa, Triticum aestivum
  Clone ID: PAT_TA_78259.pep
MPPRSDHAGGSAAAAAATHADFDSIDPLFHVLRVLPFSFLRPPRTRLRLPSNLALPSPMTVFSLILLTYFAVVSGLVYDVIVEPPGIGSAQDPGTGAVRPVVFLPGRVNGQYIIEGLSSGFMFLLGGVGIILLDLAVDRTRPRSLRVSFGSAGAVAVVIAYAMAMLFLRIKIPGYLW

SEQ ID NO: 183842 - protein, 132 aa, Triticum aestivum
  Clone ID: PAT_TA_78260.pep
SGVDQLVEIIKVLGTPTREEIKCMNPNYTEFKFPQIKAHPWHKVFHKRMPPEAVDLVSRLLQYSPNLRCTAVEALVHPFFDELRDPNTRLPNGRFLPPLFNFKAHELKGVPADIVAKLIPEHAKKQCSYVGL

SEQ ID NO: 183843 - protein, 175 aa, Triticum aestivum
  Clone ID: PAT_TA_78261.pep
RGKLTLSNVLKSITAALVESSGDSRAALFVRDFIITQIADKDLHQFWEPEEPIKLLSEILARDDIQSPVPRLIGCSGKNTILACFRVGIYTPHNKQMIGLGFGETVDIAHEMAARDSLRQLFGTPDNILLPFNLELNQLCASTVKNLFVNEWSQKNLPTRPIHYELRKAKEISSN

SEQ ID NO: 183844 - protein, 111 aa, Triticum aestivum
  Clone ID: PAT_TA_78262.pep
MSLCTIARRLCLSKPSSGRCLSVVWGHLYSTEVASQKVVDLADRIAALPPEEIKQIAPALLFRLNREPPQVISGQGFSFGAQGGSGAAAGKADEKKAEKTVFDVKLEKFDA

SEQ ID NO: 183845 - protein, 75 aa, Triticum aestivum
  Clone ID: PAT_TA_78263.pep
KRMKLRLTPEIRFIEDESMERGSRILAILDKLKEEREQQEGKDGEEDVEGSYISEEEDGDWDADDPDEEDIIYVK

SEQ ID NO: 183846 - protein, 87 aa, Triticum aestivum
  Clone ID: PAT_TA_78264.pep
EGRREELLLPQRKLHSAKPAHGSVLACTCTTRMILITKTTSIEAQSASELIISCNVRRICPWRTSCPESIFALCVVSYSQATTHAST

SEQ ID NO: 183847 - protein, 65 aa, Triticum aestivum
  Clone ID: PAT_TA_78265.pep
ICCLTYTFLYCTYPRDRERARKELLMASDDQLGGEASDDNESSAAHTTRVDEESSVSSLNQRLIS

SEQ ID NO: 183848 - protein, 46 aa, Triticum aestivum
  unsure (1)..(46): unsure at all Xaa locations
  Clone ID: PAT_TA_78266.pep
EIDEWGPXIEFSIMAKHFDRQGKPPYAYHAQYLAHLLSHGQLDGSG

SEQ ID NO: 183849 - protein, 67 aa, Triticum aestivum
  Clone ID: PAT_TA_78267.pep
MPLSATSVISKLTEEKMSAIQQNQKLRQELELLRKESSKTSGGGFSITFLFVVGLLGIIVGYILKRT

SEQ ID NO: 183850 - protein, 63 aa, Triticum aestivum
  Clone ID: PAT_TA_78268.pep
CQNMVCVSRLKRSSPILHLFLRQSKHLLLLQIGRRSTRGHCCSSLIDQQQREKRGSVALLTDA

SEQ ID NO: 183851 - protein, 39 aa, Triticum aestivum
  Clone ID: PAT_TA_78269.pep
RALDAAGIFELGDAASAAAYWNAGSCWTDVVQDPSMYLP

SEQ ID NO: 183852 - protein, 142 aa, Triticum aestivum
  Clone ID: PAT_TA_78270.pep
KRTIEKFEKEAQEMGKGSFKYAWVLDKLKAERERGITIDIALWKFETSKYYVTIIDAPGHRDFIKNMITGTSQADCAVLIVAAGTGEFEAGISKNGQTREHALLAFTLGVKQLIVGVNKMDSTEPPYSENRFEEIKKEVSSY

SEQ ID NO: 183853 - protein, 215 aa, Triticum aestivum
  Clone ID: PAT_TA_78271.pep
KFSGSNPDNTPVEVIPADASASNSSDSGNSSLEGFQWLNTWNHMKQLTNISDGLPHANEAIDNARTAWENLTISVHNSTSKQTEKERQCPYSIRRMNASKPDTGDFTIDIPCGLIVGSSVTIIGTPGSLSGNFRIDLVGTELPGGSGKPIVLHYDVRLTSDELTGGPVIVQNAFTASNGWGYEDRCPCSNCNNATQGTSKLRLYCFFFCPVTLGI

SEQ ID NO: 183854 - protein, 133 aa, Triticum aestivum
  Clone ID: PAT_TA_78272.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDY

SEQ ID NO: 183855 - protein, 110 aa, Triticum aestivum
  Clone ID: PAT_TA_78273.pep
RADLQVNNKMLEMYAKCAAMNHARRTFDHMPDRNMDSWHIMIDGYTMNGLGDVTLQLFEEMKTKYGIAPTAHTFTLGLNACANSEAIEEAFLDFDAMARDHGIEAGVEHY

SEQ ID NO: 183856 - protein, 229 aa, Triticum aestivum
  Clone ID: PAT_TA_78274.pep
LHGYISLDDWELLLPDHKSSFLVDVECSNGSHGVVVGGKDQLLLGAELVVIDMDHFGSTSSHPPPYDYCILDEEANEKLPSEDAYGHDPIAIDVYEAEEQEETTIKSVKEADQDDDVLVEAAVPDGVSQRAREEEEEEGVSKTGFSVGSLRVNGVGALCSFGVAAATFCILLLGGGGGKQQQQLHKRQGHKIQLQQMYAGDERIQQVVQQASRLNQTMSSVMGGASSAR

SEQ ID NO: 183857 - protein, 146 aa, Triticum aestivum
  Clone ID: PAT_TA_78275.pep
MGRPRGGKAKRPPSSQATKSEDADAGSGGEEEEAVMTPAYKRRGRPQKHYHKADDTDGEEEEDDAAAKAEPMLEDAKQPVVPVVMASPENDGGGKKRRRRRQPKRGYDSSAAEEKDEAAVKRSGGFRHHGSRRKSTPRRAAEAGVE

SEQ ID NO: 183858 - protein, 71 aa, Triticum aestivum
  Clone ID: PAT_TA_78276.pep
FFFFFFFFFFFLVKILALRSCKSTSAQGGKKWRRSYTETNQMCFLFTAHLVTPFATNYYPRRYMTISAGGG

SEQ ID NO: 183859 - protein, 72 aa, Triticum aestivum
  Clone ID: PAT_TA_78277.pep
PRRGVPVQELQRAPPALAGRRRRGGDTAAAGHGHRHRLELRSRSVMALFFFLLMERATLSSSIQRVTTSELS

SEQ ID NO: 183860 - protein, 137 aa, Triticum aestivum
  Clone ID: PAT_TA_78278.pep
MACCFLFGKKAKQAVEGDEDLHSVKVFSYNDLRKATQDFSGANKIGEGGFGSVFRGVLKDGTVVAVKVLSATSRQGIREFLTELTAISDIKHENLVTLIGCCAEGSHRILVYNYLENNSLAQTLLGSRYRNIRVNWR

SEQ ID NO: 183861 - protein, 110 aa, Triticum aestivum
  Clone ID: PAT_TA_78279.pep
QQTDPNFQDIPTQSWYPPSVVGSSSRPSTPTSSSGSPHQRASDNPQSSSRGQPSPAEAAGIIARLKDKSIEELQRILKDKEAYNAFFNSLDQVKTQNNVRDELRKETLQL

SEQ ID NO: 183862 - protein, 133 aa, Triticum aestivum
  Clone ID: PAT_TA_78280.pep
HQICQLLGGIWGRSKHSRRSEALLAFKKAITTSEGIFLNWCEQDVDPCNWKGVRCDSHTKRDRTTCMGKEDTCRSAGINYFTEDIAARSQAVARQFKSLKVKAVVALLSLSRNDTAEDVDSNNEKEKSYGYMM

SEQ ID NO: 183863 - protein, 68 aa, Triticum aestivum
  Clone ID: PAT_TA_78281.pep
ARCPHPPRRRLSQQPSSATKPPAAAPSDASSSRHLARVTWTTNSRTSIWNNSSVTLEEQDMQQMSITT

SEQ ID NO: 183864 - protein, 190 aa, Triticum aestivum
  Clone ID: PAT_TA_78282.pep
RYAAHKFEYSISLSRKKYNVGQINSTELTDAIWKNYIHGKLTYTHWTKGGEAMAPIVSPTGGTLLVRKLANLSPTQVFVGDVVLLKDPEKSDDLIIRRLAALEGYEMVSNDEKDEPFVLEKDQCWVLADNLALKPKEARDSRLFGPVPMTDILGRVIYSLRTAVDHGPVENSGMAMKQDGPVLTVELDVE

SEQ ID NO: 183865 - protein, 232 aa, Triticum aestivum
  Clone ID: PAT_TA_78283.pep
RGHYVEDWKKVSEHVGSRSEKDCIARFIRLPFGEQFMGPREDRMGFENNDDNTDEPGADVSKRLHLTPLADASNPIMAQVAFLSAIVGPDVASAAAQAAISAQSRVDLNDSEIETSINSTKEEESSHTNGLSVNDLLKEAAANARAQLEKERNSIEQSLSNIVDVQMMEIQDKICRFEQKEMLMEKERQQLNCLRDILFTDQLAVMQHQQRTPAVVTECKGDEKPKPLANMS

SEQ ID NO: 183866 - protein, 107 aa, Triticum aestivum
  Clone ID: PAT_TA_78284.pep
ENHHQEGEDYDAQDSNPFPSSEVECLSEVASVKSENVHTLQLPELIVVPEEAWSVFGNIKFIQEQEGEHQLSNGLSVCNDIYTSDLSAQKTSQKAEIFADYKEKEFP

SEQ ID NO: 183867 - protein, 209 aa, Triticum aestivum
  Clone ID: PAT_TA_78285.pep
SGDASMDIKGQDADVNIDTNAITIEDEHVVAKSEAVIESFDDDQKTEDSKEDAQLTTATDVDDDMEEGELPEEPEEKSDVDMSEIEGETTAERAAVEPDQSPITQSGVADASPSRNADASPAREPSPNPVQAGATSRPQNTSTTTEAREPSTNPAQAGASEQWNTRTINFERARQNRQARFQRPQQPAAGAQQPVAARGRGQSVTLRKD

SEQ ID NO: 183868 - protein, 157 aa, Triticum aestivum
  Clone ID: PAT_TA_78286.pep
TRLARPSLSKMCYNRRMEKNTMFLLSLLRVVAARSILAAYTIPFFIIPRTVHPLLGWPLYLLGSFSLSSIVINVFLLHPMTVLTTWFGFIGALLVMAFPWYLNGVVRALAVFAYAFCCAPLIWASLVKTMSSLHVLIERDAFRLGEPNQNAEFTKLY

SEQ ID NO: 183869 - protein, 48 aa, Triticum aestivum
  Clone ID: PAT_TA_78287.pep
HYNEKNVYQQQRPNANLEAKWAGTLEITVTCENGNYFPNHRECWTNMA

SEQ ID NO: 183870 - protein, 36 aa, Triticum aestivum
  Clone ID: PAT_TA_78288.pep
QKHCINFNLIYDLLNDLLNNCSILTVHRYHNNYTFN

SEQ ID NO: 183871 - protein, 222 aa, Triticum aestivum
  Clone ID: PAT_TA_78289.pep
FSLAFVIHESANPHIAVLGRLPGTTVYRNTLQYPEAYTYNGIVVVRIDAPIYFANISYIKDRLREYELNLPSSNKGLDVGRVYFVILEMSPVTYIDSSAVQALKDLHQEYKARHIQIAIANPNQQVHLLLSRSGIIDLIGAGWCFVRVHDAVHVCLQHVQNSSSNALKLAVQASGELSDSVSTPKPEKQHPKYYGFFKNLWKARDYPHADGEVQPLLRQNLV

SEQ ID NO: 183872 - protein, 149 aa, Triticum aestivum
  Clone ID: PAT_TA_78290.pep
MAVKMIIFAACVATALAQYAAPAYPAQNAYAQAEHAYAPTPYNFEYSVNDPHTYDVHSQSEYSDGNGYVKGTYSLLEADGSTRVVEYTADDHSGFNAEVKKIEGHNHGYSAPAPAYKPAYSAPAYSAPAHSAPAYSAPAYSAPAYKPAY

SEQ ID NO: 183873 - protein, 191 aa, Triticum aestivum
  Clone ID: PAT_TA_78291.pep
DFDGGLELQQVGLRKEDLLGGSAELLNLRLRQLRVLTGLEILHLQKPAYDVVKQGRIHLELFNTHTALFSKLLNNPTLVTVKGKTKSLHGKKTQAQIEEISAALRSGWTRGGGIWSVIGGVLVTQRCYLFAWSAGLSGLLFFLLFFSLLGCSPAALVLADGGGSLVGFWRGFGLDSRLSSLASFLGIVMGD

SEQ ID NO: 183874 - protein, 143 aa, Triticum aestivum
  Clone ID: PAT_TA_78292.pep
MALLLSPTVSFLVSPAAPRSRALSTAANVSYPASRLQCKNLSSLQSPLNVTATCASFAEKRPVLVHATADGSEAGAEQPEEPKPVTKIEDMPLESKQKMIMEQRARMKLAKKLRQRRKRLLRKRKLRKKGRWPPSKMKKLKNV

SEQ ID NO: 183875 - protein, 103 aa, Triticum aestivum
  Clone ID: PAT_TA_78293.pep
AGTEYLSCYRSTCYPSSMASRRHQMRQSKPMSRVTETTSQSRRSRPSQQQPVWTTRRFPGHSQPLQLSLEQQRWRSLRYANAEEAAAAPWINASYHQNVAPGL

SEQ ID NO: 183876 - protein, 94 aa, Triticum aestivum
  Clone ID: PAT_TA_78294.pep
TRERNRYLDSSAPHALCYRLLIGAGLDWICSSSAVQRTDHHPVVHGGAPRSDGGLRPIGDLGFPAEPPPAVRLGRGSCGERRVGRGGRGGRDGG

SEQ ID NO: 183877 - protein, 53 aa, Triticum aestivum
  Clone ID: PAT_TA_78295.pep
FFFFFFLVHLCCIYKQKMLFFSYNYVIYWQKKCYSSRTFMLYISKKLSQFTCY

SEQ ID NO: 183878 - protein, 117 aa, Triticum aestivum
  Clone ID: PAT_TA_78296.pep
KIMQSIGFLGPAFFLTQLSHVDSPAMAVLCMACSQGTDAFSQSGLYSNHQDIGPRYAGVLLGLSNTAGVLAGVFGTAATGYILQHGSWDNVFELSVVLYLVGTLVWNVFSTGEKILD

SEQ ID NO: 183879 - protein, 53 aa, Triticum aestivum
  Clone ID: PAT_TA_78297.pep
LLQSPWSNKYDPPLEDGTVPSEEMRNLEVEANDVFSVYRDQYYEGGISSVYIW

SEQ ID NO: 183880 - protein, 72 aa, Triticum aestivum
  Clone ID: PAT_TA_78298.pep
WARYNEAQRVLTTRYLNLFLWRIYQPPKQKEVPSGAPSILRPQRGWWIASIVFLGQQQQIYFMSLLYNTNLA

SEQ ID NO: 183881 - protein, 206 aa, Triticum aestivum
  Clone ID: PAT_TA_78299.pep
LGYVRFSGNLLSGQIPPIISAMGNFNLLLLDDNLLSGVLPSEISQMSLVALNVSRNIISGDIPSEIGQMVLLETLDLSFNNFSNELPSSLSQLYKLSKFNVSYNPLLSGNVPSTGQLSTFDKQSFLGNPLLSFHFTDHGPRLESNNDELSTECTEKDPAKEETIVLIISFIAFFFATIAIREHDRFMHVYYTMKCTCARTKIYAQL

SEQ ID NO: 183882 - protein, 125 aa, Triticum aestivum
  unsure (1)..(125): unsure at all Xaa locations
  Clone ID: PAT_TA_78300.pep
EAASFTSQVIIMNHPGQIGNGYAPVLDCHTSHIAVKFAELVTKIDRRSGKELEKEPKFLKNGDAGMVKMIXPTKPMVVETFSEYPPLGRFAVRDMRQTVAVGVIKNVEKKDPTGAKVTKAAAKKK

SEQ ID NO: 183883 - protein, 69 aa, Triticum aestivum
  Clone ID: PAT_TA_78301.pep
DCHRPVVTSEGQIIREETIIYSEVQYSTTKQKLKVKLPRNQLKLTPFSLSLFTPVQELRFWQRTRSPAP

SEQ ID NO: 183884 - protein, 147 aa, Triticum aestivum
  Clone ID: PAT_TA_78302.pep
MRGSCPGGGASASLAPSFNGFRAMICRRPATVNCTSRIGISFIQTAKTGPFRAGDRATGGICYASQAVELLPTLCPEIVVRDARLEDCWEVADTHCSSFFPGYKFPLDLVLRIDRYIALLSGFSDPPGCMKTCLVAGNSNSVNNTFT

SEQ ID NO: 183885 - protein, 116 aa, Triticum aestivum
  Clone ID: PAT_TA_78303.pep
YSNYSQLRYSEAVNVIGFVYSVLQFFVLADLMRRNKHLNPRRKGDYFDFFMDQVLAYLLISSSSSATARVGDWIDNWGSDPFPKMANSSIAISFMAFLVFAISALISAYNLFRRDI

SEQ ID NO: 183886 - protein, 78 aa, Triticum aestivum
  Clone ID: PAT_TA_78304.pep
IRKIIAEKSGIFTLGRAIQFFIVTNFSFSTCWIQFLKYLHMAKIIIFLHCSVQAPNFTKKNEVFSQCTRQTSSQNCIY

SEQ ID NO: 183887 - protein, 54 aa, Triticum aestivum
  Clone ID: PAT_TA_78305.pep
LCTSTEDSLQTNPIIGRIDRKSGHGAGRPTQKLIDEAADRYSFMAKMLGASWTE

SEQ ID NO: 183888 - protein, 95 aa, Triticum aestivum
  Clone ID: PAT_TA_78306.pep
KKFYMDNHTWFRLISMAFFCYFTLIYAIVMDAAGSFFYVYHACRPQIVFCLCSFYILVFTSFCPLSIAGPSDRWHPGAAVNFICFMHDTTPVLLL

SEQ ID NO: 183889 - protein, 84 aa, Triticum aestivum
  Clone ID: PAT_TA_78307.pep
FSLSLFWLSQAMDGACNKDGLMSVLPTLPWSLFGDSVVSSSCYYVPVFVVGFQQCLETCNFLLYPNLHRNRLPAHGRYVSDGEK

SEQ ID NO: 183890 - protein, 170 aa, Triticum aestivum
  Clone ID: PAT_TA_78308.pep
VPVAGYHWFDGDGMIHAMRIKDGKATYVSRYVKTARLKQEEYFGGAKFMKIGDLKGFFGLFMVQMQQLRKKFKVLDFTYGFGTANTALIYHHGKLMALSEADKPYVVKVLEDGDLQTLGLLDYDNGLKHSFTAHPKVDPFTDEMFTFGYSHEPPYCTYRGITKEGAMLDP

SEQ ID NO: 183891 - protein, 74 aa, Triticum aestivum
  Clone ID: PAT_TA_78309.pep
EVLNAKPLCNVLDPQGRNPFSHNLDFTNRKFNTKTEFLIYPRFAEESRLRESTDHYLKSLKPSSAIELNKVLKF

SEQ ID NO: 183892 - protein, 41 aa, Triticum aestivum
  Clone ID: PAT_TA_78310.pep
RLFSKKIRYQVRKVNADCRPRMKGRFVRSPSLLQQVLEEES

SEQ ID NO: 183893 - protein, 78 aa, Triticum aestivum
  Clone ID: PAT_TA_78311.pep
MALTSAQRIALTVSFFGLLSFLLGVIAENKKPPYGTPIKGKDVVICKFPSDPTIAMGSLSVMSLGLTTIVGHAAIFYP

SEQ ID NO: 183894 - protein, 140 aa, Triticum aestivum
  Clone ID: PAT_TA_78312.pep
CSTWKHGISLRTLLRRSENIQGPCLLIVGDMQGAVFGGLLNSPLRPTEKRKYQGTNQTFVFTTIHGEPRLFRPTGANRFYYLCLNDALAFGGGGSFALCVDEDLSGSCETFGNSCLAHSPEFELKNVELWGFTHSWNRST

SEQ ID NO: 183895 - protein, 74 aa, Triticum aestivum
  Clone ID: PAT_TA_78313.pep
PLQLSEICFGYDPSRYAGRDEDVSDMEADFATIEMEEKRSARIARQEDEEELRLIEEEERREQERKRRKMARGR

SEQ ID NO: 183896 - protein, 56 aa, Triticum aestivum
  Clone ID: PAT_TA_78314.pep
RDRVVTGLLQASLDGLLHVILDGGSTRVFSPNDAPFLEEDLETLKEFFISGGYGLP

SEQ ID NO: 183897 - protein, 36 aa, Triticum aestivum
  Clone ID: PAT_TA_78315.pep
LQVLLEQVEEEKQRLTPVRDQGVTLTRKTEDQANAS

SEQ ID NO: 183898 - protein, 111 aa, Triticum aestivum
  Clone ID: PAT_TA_78316.pep
RPRFSDHLEAIKFICKDFWSELFKKQIDNLKTNHRGTFVLQDNRFRWLTRVSLDPYTENTDSTENDSAALGDTAAQTTTMLLYFPCGLIRGALTNLGIPRSVSADMSNLPT

SEQ ID NO: 183899 - protein, 73 aa, Triticum aestivum
  Clone ID: PAT_TA_78317.pep
IREAKPPSCPPRSIISSNPRSPNRNRKEKRKAQDVNQPRTINNTRHVYYFKSKLPIMIKHNLQSRHKFATTAT

SEQ ID NO: 183900 - protein, 127 aa, Triticum aestivum
  Clone ID: PAT_TA_78318.pep
FQPIRLIRDEQRSLSVGSQSDPNDTDSSLSLPFPQISERHATITCKNKAFYLTDHGSEHGTWITDNEGRRYRVPPNFPVRFHPSDVIEFGSDKKAMFRVKVLNTLPYESARSGKQQGQQQQQVLQAA

SEQ ID NO: 183901 - protein, 119 aa, Triticum aestivum
  Clone ID: PAT_TA_78319.pep
DLMTALQLVMKKSSAHDGLVKGLREAAKAIEKHAAQLCVLAEDCDQPDYVKLVKALCAEHSVHLVTVPSAKTLGEWAGLCKIDSEGKARKVVGCSCVVVKDFGEESEGLNIVQDYVKSH

SEQ ID NO: 183902 - protein, 78 aa, Triticum aestivum
  Clone ID: PAT_TA_78320.pep
SDSRSVLVSSDSTEVQLAVDGVDIRPVGDAEWGGFQQSEALIADVREVSPEADGGSLDIPVVNPPPVSDHIQGGATHP

SEQ ID NO: 183903 - protein, 70 aa, Triticum aestivum
  Clone ID: PAT_TA_78321.pep
VIMVNFREEDDKSPVNSINDNSTIVLINEMSNLLQVDLDLELMTICQRMVERGINPKLLDQSIKEIKKQG

SEQ ID NO: 183904 - protein, 97 aa, Triticum aestivum
  Clone ID: PAT_TA_78322.pep
LHHMGLTTAGSIGAMTAATLDDSVLRVQAIADAALGVNPDIIVLCHGGPISGPQEAEFILKNTKRVHGFYGASSMERLPVQQAITNTVREYKRISLK

SEQ ID NO: 183905 - protein, 119 aa, Triticum aestivum
  unsure (1)..(119): unsure at all Xaa locations
  Clone ID: PAT_TA_78323.pep
SFPYKWINKKWKEGFHVTSMATAGNRWGVVMSRNSGFSTQVVELDFLYPNEGIHRRWESGYRITSTAATNDQAAFILSMPKRKPMDETQXLSDTSAFPNAHDKEKWAKNLYITSICYGQ

SEQ ID NO: 183906 - protein, 223 aa, Triticum aestivum
  unsure (1)..(223): unsure at all Xaa locations
  Clone ID: PAT_TA_78324.pep
VKFWXTFNEPNIFAKLSYIYGRYPPGHCSRPFGNCTSGNSSTEPYIVGHNMVLSHANVVSIYKEKYQGKQGGYIGITVLSRWYEPFRNIPTDILAVDRGLSFGAPWFLDPIILGDYPSPMRKMLGPNLPEFTSKQKKILQASKLDFIGLNHYSTSYLKDCISSSPCELDPFDGDAQISTSIDRDGILIGERTGSPYLNVVPYGMEKVVMYFKRRYNNTPMYIT

SEQ ID NO: 183907 - protein, 104 aa, Triticum aestivum
  Clone ID: PAT_TA_78325.pep
WRYLLLITSPEPSHMQTRRRHIDLIYSDLMKSCKYEAAFTKNVIEMGRVSLAVNSALASCRPDLPRRADQNHAHALDCGDWSLCLLLPSGVNGTEAKDKWGGST

SEQ ID NO: 183908 - protein, 56 aa, Triticum aestivum
  Clone ID: PAT_TA_78326.pep
ISHTKPGCMSVRNKQEVSRSTSTRTYKRQSHTCKAKTTLLINTHAHARTCNVCTYC

SEQ ID NO: 183909 - protein, 136 aa, Triticum aestivum
  Clone ID: PAT_TA_78327.pep
MARTKQTARKSTGGKAPRKQLATKAARKSAPTTGGVKKPHRYRPGTVALREIRKYQKSTELLIRKLPFQRLVREIAQGFKTDLRFQSHAVLALQEAAEAYLVGLFEDTNLCAIHAKRVTIMPKDIQLARRIRGERA

SEQ ID NO: 183910 - protein, 116 aa, Triticum aestivum
  unsure (1)..(116): unsure at all Xaa locations
  Clone ID: PAT_TA_78328.pep
GLAAYVTSQIDSSLSWKCXDIKWLQTITRLPILVKGVITAEDARLAIECGVAGIIMSNHGGRQLDYLPATISCLEEVVREAKGRVPVFLDSGIRRGTDVFKALALGASRVFIGRPV

SEQ ID NO: 183911 - protein, 206 aa, Triticum aestivum
  unsure (1)..(206): unsure at all Xaa locations
  Clone ID: PAT_TA_78329.pep
QWVYDTTQFDNILKKLKXSATPAIKEFEDDVSNSPDSTPKEADQQXNEVTKVTRPQGRYKKRERGKSVSGYSAKDLEGILVRKSDDNCKVDQEVEPTCCDEPDPIICQDTVSQADDVNWWGHKFGFKSGGFLGAKSRKNKSSATKGTSNVRQTFGEEDQENLYNLVQDKATSGKQGLGIKGLPIKVAGHHWKGNKTSFGDSDEENS

SEQ ID NO: 183912 - protein, 66 aa, Triticum aestivum
  Clone ID: PAT_TA_78330.pep
SITSSRPVPPIPWFRLHRYSTLPLFPRKIVNPSKIQISSARIMQPPTGAEPHEGHTNTLRAVQYCR

SEQ ID NO: 183913 - protein, 128 aa, Triticum aestivum
  unsure (1)..(128): unsure at all Xaa locations
  Clone ID: PAT_TA_78331.pep
VEGKALKMSSTVPKSSNIFWHDCPVGKTDRQKLLKQKGCVVWITGLSGSGKSTLACTLGRELHTRGKLAYVLDGDNLRHGLNKDLGFNAEDRAENXRRVGEVAKLFSDAGLVCIASLISPYRRDRESC

SEQ ID NO: 183914 - protein, 82 aa, Triticum aestivum
  Clone ID: PAT_TA_78332.pep
TQIDNAAKRENTQPCFPCSGSGAQVCRFCTGKGIVTVVLGAGETEESQCVNCEGIGSLTCTTCQGTGIQPRYLDRREFKDDD

SEQ ID NO: 183915 - protein, 139 aa, Triticum aestivum
  Clone ID: PAT_TA_78333.pep
MAEAEAEAAPAAAAGGGGIGDILATAERDFLVRNSGEQVKISSIEASPVAIYFSASWCPPCRRFTPKLIEVYKELAEQGKSFEVIFASADQNEEGFNEYFAKMPWLAVPFSDTEGRAALDARFKVSGIPHLGILDAKTG

SEQ ID NO: 183916 - protein, 133 aa, Triticum aestivum
  Clone ID: PAT_TA_78334.pep
MHCQEMEATYYVKVDENNCAYFDQVEKLNNYGAHNRDTISRLLWAFFHYWAYEHDYTRDVISIRTGRIISKERKDWTRRVGNDRHLICIEDPFEISHDLGRVIDKFSIKILREEFERAANILQVDPNPNMTLF

SEQ ID NO: 183917 - protein, 85 aa, Triticum aestivum
  Clone ID: PAT_TA_78335.pep
CCPKTMQVQSKQPQNSSDGFRIRGTFQGLLLIIRCQGWRQLFAGLSLNYVKVVPSVAIGFTTYDMMKTLLGVPPRERVHASGGNK

SEQ ID NO: 183918 - protein, 153 aa, Triticum aestivum
  Clone ID: PAT_TA_78336.pep
GFHLDGCLEIIDRKKDIVKLQHGEYVSLGKVESALATSNYVENIMVYADPFHSYCVALVVPAHQALEKWAQNSGINYKGFEELCQNDQANKEVQQSLSKAAKAARLEKFEVPAKIMLLPEPWTPESGLVTAALKLKREQIKTKFKDDLDKLYH

SEQ ID NO: 183919 - protein, 71 aa, Triticum aestivum
  Clone ID: PAT_TA_78337.pep
NDDEYPMKAHGIQCSVSRICICMKCLKVKLHKMPGCIVLTLVQNPIFLGLLIMTTLDLWTFVYNTSVLVPI

SEQ ID NO: 183920 - protein, 39 aa, Triticum aestivum
  Clone ID: PAT_TA_78338.pep
AKRSRSKGLPAEQRCQSSASCVIPNRRRNSPCMAAALPL

SEQ ID NO: 183921 - protein, 218 aa, Triticum aestivum
  Clone ID: PAT_TA_78339.pep
TPKLRQCLLAALGQLTVDHGMPPASDSWVMENVVEPALQELSANQLDQPVSQEVFFQEFRKFLGIMALRLQQHPVIVAHTENTFDGSGIRRLLSNKFELDKLLDSVWRDVPKEHKDKTSKEYLRIALDRIADSASLPPFGAVDQVDAVVNEAFKMAKADEMKAVDEAEFKKLLTEILGAIMLQLDGNPIGVSTNTVVHEPMSTSSALLSPTPLSPMVS

SEQ ID NO: 183922 - protein, 100 aa, Triticum aestivum
  Clone ID: PAT_TA_78340.pep
FFFFFFGREEEILLWCYDSHDIFSEKNTAYKVFCGDSSQELLMTSCGKLKNVAPPHPRHSCNQKLFSCFVRVGNQSTDHPHTHTTSTKNKSSFSRVILPV

SEQ ID NO: 183923 - protein, 90 aa, Triticum aestivum
  Clone ID: PAT_TA_78341.pep
MSSAQIAPADHVCYVHCNFCNTVLAVSVPGNSMLNIVTVRCGHCTNLLSVNLRALMHSLPEQDQLQENIKGHGGNGTLHDQGGHLELGSS

SEQ ID NO: 183924 - protein, 99 aa, Triticum aestivum
  Clone ID: PAT_TA_78342.pep
MSDLDVQIPTAFDPFAEANAGDSGAAAGSKDYVHVRIQQRNGRKSLTTVQGLKKEFSYSKILKDLKKEFCCNGTVVQDPELGQDIQLQGDQRKNGSNFL

SEQ ID NO: 183925 - protein, 68 aa, Triticum aestivum
  Clone ID: PAT_TA_78343.pep
MRDWAPAIIATALFALLCPGGVLQMPGRQRPVDLMNMKTSFPSMLVHAIIYFLLLMLFIGILQPHLYI

SEQ ID NO: 183926 - protein, 137 aa, Triticum aestivum
  Clone ID: PAT_TA_78344.pep
MAPKAEKKPAEKKPAEEKAEKKPRAEKRVPGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 183927 - protein, 66 aa, Triticum aestivum
  Clone ID: PAT_TA_78345.pep
RYMCFALSMLCLSRVERKAASFFNGSSQCHMCHGCLAMKQHMRGKVYLSSCTLRNSRFQKKPENLH

SEQ ID NO: 183928 - protein, 84 aa, Triticum aestivum
  Clone ID: PAT_TA_78346.pep
LDDVFQRPESVECVQKVNRIAEKYWDLYSSDDLEQDLPGHLLMYPIGVTADGTVTELPGMENFPDTRARVLGNKSDYLPPILTT

SEQ ID NO: 183929 - protein, 130 aa, Triticum aestivum
  Clone ID: PAT_TA_78347.pep
YKMLRIEGQESMGSVNFRLAEQLKVNALTFRPTGYLSFDISMGREIMPVALYNDVDDDRDPLLFEYLARPIFPSSAVQGKFAEGGGGCECTENCSIGCYCAQRNGGEFAYDKLGALLRGKPLVYECGPYC

SEQ ID NO: 183930 - protein, 194 aa, Triticum aestivum
  Clone ID: PAT_TA_78348.pep
FDGFRFDGVTSMLYHSRGAGQGFSGHYDEYFGLNVDTDALIYLMLANYMLHKFYPNCITIAEDVSGMPSSCRPVSEGGLGFDYRLGMAIPDMWIKLLKDVQYDDWNMGNIVHTLTNRRWMEKTVAYAESHDQALVGDKTVAFWLMDKEMYTHMAVSSDPSLIIDRGIALHKMIRIITNSLGGEAYLNFIGNEFG

SEQ ID NO: 183931 - protein, 210 aa, Triticum aestivum
  Clone ID: PAT_TA_78349.pep
MTDIRVSNALLSMYGRSGFVSEVEAVLGKIENPDLVSWTAAISANFQNGFSEKAVALLLQMHSEGFTPNDYAFSSGLSSCADLALLDQGRQLHCLALKLGCDFKVCTGNALINMYSKCGQIGSARLAFDVMNLHDVMSWNSLIHGLAQHGAANLVLEAFSEMCSSGWQPDDSTFIAVLVGCNHAGLVKEGETFFRLMTDRYGLTPTPSHY

SEQ ID NO: 183932 - protein, 100 aa, Triticum aestivum
  Clone ID: PAT_TA_78350.pep
MYVEPLPIPLTVPGTEPMSREELNRRLSCDVKIEDCKTVSYEWTGKCRSCQGTGLVSYFRKKGKETICKCVPCAGIGYVRKITYREDIQNIDELDNGKLP

SEQ ID NO: 183933 - protein, 171 aa, Triticum aestivum
  Clone ID: PAT_TA_78351.pep
HEAEALRRMKESLQNKEWVAKFEKPKGDPSAFLKPSTTVLSPYLKFGCLSSRYFYHCIQDVYKSVRNHTKPPVSLIGQLLWRDFFYTVSYGTPNFDRMKGNKICKQIPWSENEELFVAWRDGQTGYPWIDAIMIQLRKWGWMHHLARHSVACFLTRGDMVSNKNSVGNYLH

SEQ ID NO: 183934 - protein, 124 aa, Triticum aestivum
  Clone ID: PAT_TA_78352.pep
MAVVSRKTSTMVAAVAVVVALLLASASSASAAITCGQVGTALAPCIPYATGRASALPSSCCSGVRSLNGQARSISDRQAACRCLKSLANSVKSVNMGTVATIPGKCGVSVPFPISMSTDCNKVS

SEQ ID NO: 183935 - protein, 104 aa, Triticum aestivum
  Clone ID: PAT_TA_78353.pep
TCLALVADETAAAHFLLWGGECGAFEPGDIVRLTDGIFSYHRGNALVLRAGRRGRAEKVGELTMLFVETPNMSELQWGPDPNDGRRMVQEAVVSPYSQIFKPLR

SEQ ID NO: 183936 - protein, 171 aa, Triticum aestivum
  Clone ID: PAT_TA_78354.pep
FNSYVNLLISALPGSVDDEVNLEGLGNKIVRMAETEDQQLALLANASLLAEELLPRAAMKLYSMNPVSMDRLHRRGPEKQNRAAEQREWKRKLHRMVHKIIDRHCRQHALDLIFTEEGDTHLSPEMYINMDNTAEDPEWVPSPIFQELYAKLNNMASVAPHMFVGRERLST

SEQ ID NO: 183937 - protein, 66 aa, Triticum aestivum
  Clone ID: PAT_TA_78355.pep
ALFKLSNLQHLLLSTNGDATILKINDFGFAKLWADRRVCLLLEFCTVYRSYLLQCIKQKKGDDVKG

SEQ ID NO: 183938 - protein, 208 aa, Triticum aestivum
  Clone ID: PAT_TA_78356.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIK

SEQ ID NO: 183939 - protein, 206 aa, Triticum aestivum
  Clone ID: PAT_TA_78357.pep
LSLRNTSYAGEPPSEIGKLKLLQTLDLWGTDIEELPSSIIGLRRLMFLALNWRICLPNGLKNLTSLEVLQYAIVDSAQIAEELGHLMQLRILRVGLCKKDTEAGYYEGICKALVESLGKLQKIQQLVVLSPSDVVMNLEGSLESLGNQLSYLRIRKTWINPGSLLLLSSLDITVSQVRTEDIQVLGMLQALRVLRVDVAGDNLQVL

SEQ ID NO: 183940 - protein, 59 aa, Triticum aestivum
  Clone ID: PAT_TA_78358.pep
TRALRAGTVWINCFDIFDAAIPFGGYKMSGIGREKGIDSLKNYLQVKAVVTPIKNAAWL

SEQ ID NO: 183941 - protein, 154 aa, Triticum aestivum
  Clone ID: PAT_TA_78359.pep
KASVTSAEVSQDGRFITTADGSSVKFWDANHFGLVKSYDMPCNVESASLEPKSGSKFVAGGEDLWVHVFDFFTGEEIACNKGHHGPVHCVRFAPGGESYASGSEDGTIRIWQLSPANSDDNEAANANGKTTAGVNEVTTKIEGFHIPKEGQTEG

SEQ ID NO: 183942 - protein, 184 aa, Triticum aestivum
  Clone ID: PAT_TA_78360.pep
MAGGGGKPFGDNVFAGHAAAGAAAISASAVAVHPLDTVKSLLQLSAAGQKQKMGIRHAVDRLMHVSGPAGLYSGIGWSILGKLPGLGARFGTYELLTAFNKDGREDNHVNYSEAMLAGITAGAVEAFVCTPFELLKLRSQVGSAIPMKATNPANVIQESFPLLSKLLPGHVPDMRVWNSSVSLL

SEQ ID NO: 183943 - protein, 139 aa, Triticum aestivum
  Clone ID: PAT_TA_78361.pep
NTGASRDSTGLLLCVFAVISTTTVMAKAQVAAARFMTEVAPPPVVSVMRRRKQAPWCLDTIAEDTIAEQLVACGSPSSTDYGFAAAWSLKRMPPPHAHAQPRERAAGFVGKYFSDAHGSQQLVSRRRDVHAQELHKVGA

SEQ ID NO: 183944 - protein, 120 aa, Triticum aestivum
  Clone ID: PAT_TA_78362.pep
YIDQIATATKPHVKKIRTTLKPYTKRARHVYGQFLETATTYHQQAQATISDYLHQHEFTKQFVTEELVWYLASALLVMPVFILYTLLIEIFGIKKQKKKTSRSSNANHGHRRHKRRHAEK

SEQ ID NO: 183945 - protein, 62 aa, Triticum aestivum
  Clone ID: PAT_TA_78363.pep
KLLEVLVQRREQLAPSDTKTEKKGFDMKWPDIADCIDRAGRDIERMIKDDLLEELVLELLFS

SEQ ID NO: 183946 - protein, 122 aa, Triticum aestivum
  Clone ID: PAT_TA_78364.pep
PARGSVTQETFDRAGFTLPGVDVDQYTVKYNNALELVEHLRAMGETNALFQRNPVLKRDTALATAAIYQSMFGLEDGSIPATFQVIYMTGWREHPSQQKAKRRGSATISFSDIQKQFGPSEN

SEQ ID NO: 183947 - protein, 65 aa, Triticum aestivum
  Clone ID: PAT_TA_78365.pep
ARGCIILLNLKPGSPDYALFANASKITPSTNPASDSTAGSGFKLQAGIHGSVVLAVISAIVSSLF

SEQ ID NO: 183948 - protein, 73 aa, Triticum aestivum
  Clone ID: PAT_TA_78366.pep
AMEEYFSCGCFPNFLSVFVSLVVSIIIRPYMWLRDIDLPGSFISQTLSSVLDWTRLFSFCYWIMWSFKCCGDF

SEQ ID NO: 183949 - protein, 114 aa, Triticum aestivum
  Clone ID: PAT_TA_78367.pep
FFFGNNKKLYVTQILWEAFVHVNRLLYYRAGTASWSWLKQKTKESVQICVKKSRALNTLETSSTLNANIIQRRRRRGLSLTAHPPTGTCLRPPSGASPCRRRRRRWGQRPSPSP

SEQ ID NO: 183950 - protein, 86 aa, Triticum aestivum
  Clone ID: PAT_TA_78368.pep
RPTHDPFSVSTNNTFPPIDLSSSLFVGHFVFSVLESSHSSFFLLREIYRDQFFSVLPPTIVGVHSPRKASLHVQADKNHSSESGCG

SEQ ID NO: 183951 - protein, 179 aa, Triticum aestivum
  Clone ID: PAT_TA_78369.pep
MDFHTLSRPELQVLCKRNNVRANMTNAAMAEALESLDFVDGINYEMAPIPILVPASTVTTRLTARRSASRKTEMVMLNPVPAILQRSQRTATQKALDQKPKDDITEVKERAASKIPQAKLTDETCEDDGLDEDDSAEEIGSTDEENDTVFTSGLLQEFDKEMDTRPDQAFIKSCSRILK

SEQ ID NO: 183952 - protein, 220 aa, Triticum aestivum
  Clone ID: PAT_TA_78370.pep
PTFTSVDDFLQKVATLRGKLKKGGIVDVEAAARIVLHDWNEGKIPYFTVPPKRDAVDDSDAVIISETGKEFNIDEIYKAESSYIGGLKSLEEFRHIEIPSNAPPQIDEEMLEDGKKQNEPAQENHDESMSDANEREGAKTASASTQNDKLYTAEGILDPRKRKAEKKKRKANKFSVLTDMDADYDFKVDYQMKDAPAEDGNDGGDEEPKEADPMTGVDDA

SEQ ID NO: 183953 - protein, 184 aa, Triticum aestivum
  Clone ID: PAT_TA_78371.pep
EWNVMNKHKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEGFSKNLKLGIHEDSTNRTNIAELLRYHSTK

SEQ ID NO: 183954 - protein, 84 aa, Triticum aestivum
  Clone ID: PAT_TA_78372.pep
YHQPGKQRMMLPTVPVRTTGTVVVEMVDKNGLYFSDEFSLTFHMHYYKLLKWLLLLPMLGMFGVLVILRPQEGAPLPSFSRNVD

SEQ ID NO: 183955 - protein, 126 aa, Triticum aestivum
  Clone ID: PAT_TA_78373.pep
MATISAAAATTVVARATIARPQALGLPQLRTRSERVRCSYSKDAKEATPAAAVRGAGASLLAAAGAVTASAGPALALVDERMSTEGTGLSLGLSNNLLGWILLGVFGLIWSLYTVYTSGLDEDEES

SEQ ID NO: 183956 - protein, 164 aa, Triticum aestivum
  Clone ID: PAT_TA_78374.pep
PDKFEIGKKMGITDFVNPNDIAEKTAVSEVIKEMTGGEGADYCFECIGSVSVMAEAFKSSRTGWGKTVVLGVDGSLALISVPSFDIMRGRSVTGSLFGGIKPKDDIPVLAHKYLDKELELDDFITHQMGFQEINRAFDLLTQGKCIRCIIWMDDDYGAKENHGA

SEQ ID NO: 183957 - protein, 86 aa, Triticum aestivum
  Clone ID: PAT_TA_78375.pep
TRGQFCFIQAAWRRYYKRKMAEQRRKEEEAASRPSSSHPSLGATIYASRFAANAMRGVHRLRSKAVPTIVRLPKPPEPDFGVDDAD

SEQ ID NO: 183958 - protein, 64 aa, Triticum aestivum
  unsure (1)..(64): unsure at all Xaa locations
  Clone ID: PAT_TA_78376.pep
IAKHKXGVHTTIRVRRIIAGVGVEITFPVYSPRIKEITVIRHRKVRRAKLYYLKDKLPRFSTFK

SEQ ID NO: 183959 - protein, 67 aa, Triticum aestivum
  Clone ID: PAT_TA_78377.pep
ELAPPHPGEIPQIFRDAGKLIKGAATGRWAQVSVREGLVNAVITAEVICWFFVGEIIGKRSIIGYKV

SEQ ID NO: 183960 - protein, 111 aa, Triticum aestivum
  Clone ID: PAT_TA_78378.pep
LRPAARRALDRRRSPSRRHAAHLSSGYSLAQITNHRSQITRNNFFSMEGKDKGWKRGSLKPYHEKKTYLARSTMGRDGSAMADELTRRWGHERGWGSQWRSPRGACAAERE

SEQ ID NO: 183961 - protein, 59 aa, Triticum aestivum
  Clone ID: PAT_TA_78379.pep
LGVLNSQNSEESCARPQHIVLNHLFIEKGWGAHPLVALGLTHRFESKYVTVVLYKPIER

SEQ ID NO: 183962 - protein, 130 aa, Triticum aestivum
  Clone ID: PAT_TA_78380.pep
SFPWIPALYTGVLSTVLCMWAELVAMGDVSATETAIVYGLEPVWGAAFAWFLLGERWDNTTCIGAALVLCGSLTVQLFGSAPKKYKKVKKRSSNALETPVKQQDYLSLSPIPVDSGKFIGRQLERRNKTL

SEQ ID NO: 183963 - protein, 35 aa, Triticum aestivum
  Clone ID: PAT_TA_78381.pep
IPYIKFAVAEQAVRAHVSVIPLSSILPRIKKASLN

SEQ ID NO: 183964 - protein, 131 aa, Triticum aestivum
  Clone ID: PAT_TA_78382.pep
MASTAVKLIDIAVNFTDGMFKGIYHGKQCHAADIPAVLARAWAAGVDRIIVTGGSLKESREALEIAETDGRLFCTVGVHPTRCGEFEESGDPEGHFQALLALAKEGIEKGKVVYDYIISQHAKSVVTVVFL

SEQ ID NO: 183965 - protein, 38 aa, Triticum aestivum
  Clone ID: PAT_TA_78383.pep
CCSNMGSMKKNFKQILFDSMILSFSMYLLKHYSLYQLY

SEQ ID NO: 183966 - protein, 123 aa, Triticum aestivum
  Clone ID: PAT_TA_78384.pep
RHPRMQLPGLLLRQATHELPAARARLVVLRHRRRRGLEVVGLPRPPQQRRPPPAALRRPSRADRPSGGGGARTDRRRRPRRRRAGGQGNGGDRCARCHRHSDRPVASFSARLALLGCCDCDAR

SEQ ID NO: 183967 - protein, 221 aa, Triticum aestivum
  Clone ID: PAT_TA_78385.pep
GIVTQCLAPTRVNDPYLLNLLMKINAKLGGLNSLLQVEASPSIPHVSEVPTIILGMDVSHGHPGQDRPSVAAVVSSRQWPLISKYRASVHTQSARLEMMSSLFKPRGTDDDGLIRESLIDFYTSSGKRKPDHIIIFRDGVSESQFTQVINIELDQIIEACKFLDEKWSPKFTVIVAQKNHHTKFFQTGSPDNVLPGTVVDNKVCHPKNFDFYMCAHAGMIG

SEQ ID NO: 183968 - protein, 226 aa, Triticum aestivum
  Clone ID: PAT_TA_78386.pep
TRLPDLGPIGANGLASPRDFLSPTAWFEQDHHPGYTIVQKYGGELFTATQDFSPFNVVAWHGNYVPYKYDLSKFCPFNTVLFDHGDPSVNTVLTAPTDKPGVALLDFVIFPPRWLVAENTFRPPYYHRNCMSEFMGLIYGIYEAKADGFLPGGASLHSCMTPHGPDTKTYEATISRAGANEPFRLSGTLAFMFESSLIPRVCRWALDSPCRDLDYYQCWIGLKSHF

SEQ ID NO: 183969 - protein, 56 aa, Triticum aestivum
  Clone ID: PAT_TA_78387.pep
FFFFFLSMEMISSGAGNIHGTCFTCLFISASSNAVQQSWYYYYCRRPCKVRLMAEP

SEQ ID NO: 183970 - protein, 56 aa, Triticum aestivum
  unsure (1)..(56): unsure at all Xaa locations
  Clone ID: PAT_TA_78388.pep
ANAKVTLTCKKNPLVKINMDGIPIGRKIDLAAYNSYDGLSSAXGELFHGFLQAQKD

SEQ ID NO: 183971 - protein, 64 aa, Triticum aestivum
  Clone ID: PAT_TA_78389.pep
VQFRFLVPLFRVLGRTRVPCLSDSIGDRYINIFAKVNHQGKHAPFSYALSLKFYTCLVYIDFKK

SEQ ID NO: 183972 - protein, 254 aa, Triticum aestivum
  Clone ID: PAT_TA_78390.pep
GHVCWDDNDIINGKPTGAVRISFGYMSTYEDAEEFLKFLQSSFVSKPVGLKNGYMVNTDTFNLVDDWRQQAISDIRLKSITIYPVKSCQGFSVQSWPLTTGGLKYDREWLLQGSGGEVLTQKKVPELSSICTLIDLELGKLFLESPKCKDKLQICLLENLTLLSAEVDVYGQRYEVQSYGDKVNSWFSGAIGRPCTFVRCSSSKYRSCTINGRRDRLCRDTRSKLSFVNEGQLLLVSEYSISDLNSRLSSSNGN

SEQ ID NO: 183973 - protein, 41 aa, Triticum aestivum
  Clone ID: PAT_TA_78391.pep
QPWESSIDSSLTSEEREQKRKQATDRATFVQGLVLSTLFGD

SEQ ID NO: 183974 - protein, 96 aa, Triticum aestivum
  Clone ID: PAT_TA_78392.pep
VNGLCTPISDQSAPVYITIGDGGNQEGLATNMSQPQPRYSAFREASFGHAILDIKNRTHAYYTWHRNQDGSSVAADSMWFTNRYWEPTDDSADDFQ

SEQ ID NO: 183975 - protein, 106 aa, Triticum aestivum
  Clone ID: PAT_TA_78393.pep
SSPTSTSTCSDNGSPVLGKHSRDSKPQGDDKAEKNLWIPKTLRIDDPDEAAKSSIWTTLGIEPGDRSMFRSFQSKPESREQISGAARVLQANPAALSRSQSFQETT

SEQ ID NO: 183976 - protein, 197 aa, Triticum aestivum
  Clone ID: PAT_TA_78394.pep
QVLVPVDGNPQACIFLDTPGHEAFGAMRARGARVTDICIVVVAADDGVLPQTSEAIAHARAAGVPIIIAINKIDKEGANAERVMQELSQIGLMPEMWGGDTPMIQISALTGDNVDELLETVMLVAELQELKANPHRNAKGTVIEACLDKAKGPLATLVVQNGTLNKADIIVCGEAYGKIRALYDDRGKLVDKAGPSN

SEQ ID NO: 183977 - protein, 69 aa, Triticum aestivum
  Clone ID: PAT_TA_78395.pep
SYLQKLHSSSVTTHESMIRRSHCCRATETCYHYRFLSVCDCCLIIVVLPSYPLASPFQSYATSSPCMDS

SEQ ID NO: 183978 - protein, 58 aa, Triticum aestivum
  Clone ID: PAT_TA_78396.pep
ISNYDIFLTRDCLAYAKIKPAVNQIEVHPYFQRDSLVKFCQKHGICVTAHTPLGGSTA

SEQ ID NO: 183979 - protein, 69 aa, Triticum aestivum
  Clone ID: PAT_TA_78397.pep
VCAAVHELYKDPRGREMERELARRLSRAPPVVPVVFIGGRLVGSTDMIMSLHLANKLVPMLKAAGAIWL

SEQ ID NO: 183980 - protein, 169 aa, Triticum aestivum
  Clone ID: PAT_TA_78398.pep
HEALPCSPVPSAERSPVTPGNNGQPQQPVANANGSAPSEPPKRAPLTARERLRAARVLGKYAEPSAKGSSSSSKPAKPEFGSGVLDALREADAKKGGGGGGRRGSRLPEAPGNLFDDSKRGMPKDGWTFELPFGVDVFLVLVSFTLITTIMFGTAFLVWKLGAIHFNEY

SEQ ID NO: 183981 - protein, 242 aa, Triticum aestivum
  Clone ID: PAT_TA_78399.pep
HEGSNLLGTKFAIYDTQPPCNTSQPGKTSRRFYSRKVSPKVSSRTYNIAQVSYELNVLGTRGPRRMNCVMHSIPASCLEAGGTVPCQPDSILARSIDESFGSISFSKSSVVDHSMRFSSTRFSEISMSSHTIGDAALGDNDECKDRPLILRNKAPRWHEQLQCWCLNFKGRVTVASVKNFQLVAATQPSAGAPTPSSQATPVPPPEHEKVILQFGKVAKDMFTMDYRYPLSAFQAFAICLSS

SEQ ID NO: 183982 - protein, 74 aa, Triticum aestivum
  Clone ID: PAT_TA_78400.pep
SIHLVTIHGQYCHSCCQNVIINNQYIFCFIAYVRIMHSQRDALLHHHASDSSSLRCFPATKMAGCLPYRPDRTS

SEQ ID NO: 183983 - protein, 102 aa, Triticum aestivum
  Clone ID: PAT_TA_78401.pep
SVGMLSAVSSSSIRVTAGIIQLDGLTFSSGSDRWPLQKNGDLSLLVSFAVESDVSSKLPVGLEDATRISTVPMVMRSGFYLFFMSAMILLLSYKVGSCIYSR

SEQ ID NO: 183984 - protein, 115 aa, Triticum aestivum
  Clone ID: PAT_TA_78402.pep
AGAEPRPAAHRGDQAVAGHGHGHAAAVVGDHRLLRHRCHRPDHLHHAVSGVAGLLPAVAAAARSKFCTCRRGQRNCVLPFPSLSLFFSHVDDDEPLTGGSKDEFKHGEVKVSYMM

SEQ ID NO: 183985 - protein, 98 aa, Triticum aestivum
  Clone ID: PAT_TA_78403.pep
TTLEKGAATATLVATCRLLHAKYPGPSDLTLAVRIASLGGRNLMLPFHMRFGCARPLMVERAVQRLGCCQREMKALRLSDSFGARSPKDIVIPFVFLD

SEQ ID NO: 183986 - protein, 119 aa, Triticum aestivum
  Clone ID: PAT_TA_78404.pep
FTVWDVGGHDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKS

SEQ ID NO: 183987 - protein, 109 aa, Triticum aestivum
  unsure (1)..(109): unsure at all Xaa locations
  Clone ID: PAT_TA_78405.pep
LLKAQAAKALSRLFKSLGILRKRNCANHRKSSCGGAAGXCXXPRYFPPSARPRLRLRLLASSPAAAAAAARRRRSPIHPATEQGCLRRDPDLCFFSCMMDSKGKVKKET

SEQ ID NO: 183988 - protein, 197 aa, Triticum aestivum
  unsure (1)..(197): unsure at all Xaa locations
  Clone ID: PAT_TA_78406.pep
TGRAEEAIEAFVRMLPTVANSASPNEYTFSAXIAACPNIERAYLGEQLHAQAARRGLSHTRSVANSLVKLYARRGRLSAADAIFRENAVKDVVSWSTIISGYAQEGLVEESFALFSEMRHHSSCPRPNEFTLASLFSVCASAASLYAGRQLHALAVAAGLEHHAMVRSALVNMYGKSGSMTDANVIFSSRTRKKKKK

SEQ ID NO: 183989 - protein, 135 aa, Triticum aestivum
  Clone ID: PAT_TA_78407.pep
FTNYNTMILTIYEQASTTPKHHKIFFYNHARQLRQLSTEQSRLPLLSDWLIIGGQIRNIVAVQNSKSSNSVIHINKLYSVHQPNRADLMTLFFHSKWKLSRDFSPICPSHAGWGKQTFLGFPVFRQQVSFWGCSR

SEQ ID NO: 183990 - protein, 236 aa, Triticum aestivum
  Clone ID: PAT_TA_78408.pep
DRRAVEYDALRSSALRIHGLFERLNNCVTAPGVTGFAESLRSLAISLASSVKKDEADTTVQFQQCIKILADKVYLLTRQSADLLERYSAMQAVHGGITKELDEKKELIKNLYNKLQLEKQASKEKISFGRFEVHELAVFFRNPAGHYEAINRNCSNYYLSEESVALFTEHHPVHPAYIIGQIVHIERRIVHPGQMGGAPRRDSSGGRRSPASMLNPYNLPGGCEYFVVTVAMLPDA

SEQ ID NO: 183991 - protein, 100 aa, Triticum aestivum
  Clone ID: PAT_TA_78409.pep
KKWTRMHNIFSYRQTRWGTNKTSCERKASTTLVTVVKYYNHYKVSSMLGVKARLTQKDSPLVQDLRKISSNCRWKLFKLQLASFMEADLAALQSAILKKL

SEQ ID NO: 183992 - protein, 85 aa, Triticum aestivum
  Clone ID: PAT_TA_78410.pep
RAAQVNFGQMFVFIPQSPLIVDKVLTQNKFQVQLWPCEPIILAIEIFGGLIFVFLVQSKGNDLSVHRRPACMLKRSVLFHYEGKQ

SEQ ID NO: 183993 - protein, 135 aa, Triticum aestivum
  Clone ID: PAT_TA_78411.pep
VITKSVEKVKETTTTVLQGTQLLAIDTGAAMGLLKRALIGDELTQKEKQALQRTLTDLASVVPIGILMLLPLTAVGHAAILAFIQRYVPSMIPSTYAPDRLDLLRQLEKVKEMEVAEGSSEDILEAVGSRTEQVK

SEQ ID NO: 183994 - protein, 90 aa, Triticum aestivum
  Clone ID: PAT_TA_78412.pep
MGNAAPRVRRRDEPAAKSWSKGAEAAGELLPVAKAAGGEEKAAAERAVVTVKVVMTRKEAERLAARLREQRARGRNARMAELKNALRAGD

SEQ ID NO: 183995 - protein, 88 aa, Triticum aestivum
  Clone ID: PAT_TA_78413.pep
AVHILAQIHHSVVYSRFLLILYQHYQPLYSRQNWRLTRICCCLYRVITRLFNRLMVKKNGTDSLIYNRQPRCYKDIVLVNLYYNVSSS

SEQ ID NO: 183996 - protein, 94 aa, Triticum aestivum
  Clone ID: PAT_TA_78414.pep
GSLVDWITYLSNNSILQDAIDKSLIGKGNDAELLQCMKVACSCVLSSPKERPTMFEVYQLLRAVGEKYHFSAADDELTMQPQNANPEDELIVAN

SEQ ID NO: 183997 - protein, 74 aa, Triticum aestivum
  Clone ID: PAT_TA_78415.pep
METDYVRRFHRHEPRDHQCSSAVAKHIRAPVHLVWSLVRRFDQPQLFKPFVSRCEMKGNIEIGSVWEVNGRSGL

SEQ ID NO: 183998 - protein, 210 aa, Triticum aestivum
  Clone ID: PAT_TA_78416.pep
DEGYALPHAILRLDLAGRDLTDYLMKILTERGYSFTTTAEREIVRDIKEKLCYVALDFEQEMATAAASTSLEKSYELPDGQVITIGNERFRCPEALFQPSFLGMESCGIHETVYNSIMKCDVDIRKDLYANTVLSGGTTMYPGIADRMQKEITALAPSTIKIKIIAPPERKYSVWIGGSILASLSTFQQMWISKQEYDESGPGIVHRKCF

SEQ ID NO: 183999 - protein, 100 aa, Triticum aestivum
  Clone ID: PAT_TA_78417.pep
YMGCVDVRDVAHSLIMLYENPSAQGRHLCMESAERLVDLANKIADLYPEHPVQRIREDKQGWVVRAKDPSKKLIKLGVRFTPLDKTIRDTVDCFRSKGLI

SEQ ID NO: 184000 - protein, 232 aa, Triticum aestivum
  Clone ID: PAT_TA_78418.pep
EGEDRLLVYDYMKFGSLEDVLHDRKKIGKKLNWEARRKIAVGAARGLAFLHHNCIPHIIHRDMKSSNVLIDEQLEARVSDFGMARLMSVVDTHLSVSTLAGTPGYVPPEYYQSFRCTTKGDVYSYGVVLLELLTGKPPTDSADFGEDNNLVGWVKQHTKLKITDVFDPELLKEDPSVELELLEHLKIACACLDDRPSRRPTMLKVMAMFKEIQAGSTVDSKTSSAAAGSIDE

SEQ ID NO: 184001 - protein, 96 aa, Triticum aestivum
  Clone ID: PAT_TA_78419.pep
MRYYSLKQPLHCSRSNAGVNLSLLSRVMSSRLSRGTYNGGLLSTEAGTLARVVADATITAAGYLGTDMLLNVTLLPPLVITIVSIVATFCTYNTLY

SEQ ID NO: 184002 - protein, 239 aa, Triticum aestivum
  unsure (1)..(239): unsure at all Xaa locations
  Clone ID: PAT_TA_78420.pep
AFDPKDRPTAEEALRDPYFKGLSRIEREPSCQPIRKVEFDFEHKRMSKEEIRELIFREILEYHPQLLNSYINGTERTTFLYPRFXAFLCLHIAVDQFKKQFSHLEESGGNVPSVPTDRKHASLPRTTVVHSNPIPAKEQPLAASSKVRPVSDDSCKNPWEKGSGPGNVPRASLAPQGLQTQAAGSVRVNGSVMNSGYPPHQQIPQAYGYRQMPARLDSTNPSQAMGGYTQQSQAYAFST

SEQ ID NO: 184003 - protein, 48 aa, Triticum aestivum
  unsure (1)..(48): unsure at all Xaa locations
  Clone ID: PAT_TA_78421.pep
RLAEMPADSGYPAYLAARLASFYELLVRKCLGSPDRTGXTIVGAGSPP

SEQ ID NO: 184004 - protein, 64 aa, Triticum aestivum
  Clone ID: PAT_TA_78422.pep
TLEVESSDTIDNVKAKIQDKEGIPPDQQRLIFAGKQLEDGRTLADYNIQKESTLHLVLRLRGGQ

SEQ ID NO: 184005 - protein, 56 aa, Triticum aestivum; identical to SEQ ID NO: 134735
  Clone ID: PAT_TA_78423.pep

SEQ ID NO: 184006 - protein, 87 aa, Triticum aestivum
  Clone ID: PAT_TA_78424.pep
ELHNRCFTAFGTFSSNFLFFLNLLVSLRNDKNLLISCIQDEAWTQRYGIFFHKYTGTFVRDAIVSLVIVTLVCNHVNISSRHPHIAY

SEQ ID NO: 184007 - protein, 130 aa, Triticum aestivum
  Clone ID: PAT_TA_78425.pep
MAGRANIPTNNSALIAIIADEDTVTGFLLAGVGNVDLRKKTNYLIVDNKTTVKQIEDAFKEFTAREDIAIVLISQYVANMIRFLVDGYNKPVPAILEIPSKDHPYDPAHDSVLSRVKYLFSAESVASDRR

SEQ ID NO: 184008 - protein, 99 aa, Triticum aestivum
  Clone ID: PAT_TA_78426.pep
SYCSFQFCTHQILILDPESWNCRGTKTGMGSHIVVFNCNFASGRYLQRNQIQRAGTYLFPTCLAAAAAPARTPPTAPATTAERGPLAARKSAPVPSPAV

SEQ ID NO: 184009 - protein, 159 aa, Triticum aestivum
  Clone ID: PAT_TA_78427.pep
ALPTLYKVLESAIADRGTGSSAQGQVIWIHFGVNSGATRFALENQAVNEATFRCPDELGWKPQRVPIVPSDGSISRTRETTLPVNELTKSLRKIGYDVVPSDDAGRFVCNYVYYHSLRFAEQHGIKSLFVHVPLFLTIDEEVQMHFAASLLEVLASSSN

SEQ ID NO: 184010 - protein, 136 aa, Triticum aestivum
  Clone ID: PAT_TA_78428.pep
MATMPAPVATCFVPATSGVRCRAFSTPIPNYSAPGVVADPPKLLSRPGNLQLTSGGARFSGRFRASAAAVHKVKLIGPDGAESELEVPEDTYVLDAAEEAGLELPYSCRAGSCSTCAGKLASGEVDQSDGSFLADE

SEQ ID NO: 184011 - protein, 126 aa, Triticum aestivum
  Clone ID: PAT_TA_78429.pep
PVSSRCHTPGATRWRRRRRRPRAARRGRPPPPLPLHLPPPPPPPLSVLLLRRSSCAPVLQETLGASARGPQLRVPSSFAPAAQLRSWMWRLLAPPPRVLQRRRRRQVIPSSLLSLCAQAQPPHVIC

SEQ ID NO: 184012 - protein, 197 aa, Triticum aestivum
  Clone ID: PAT_TA_78430.pep
LTMKGVSFEYVEEDLNNKSELLLKSNPVHKKVPVLIHNGKPICESLVILQYVDELFAGRSILPADPFERATARFWAAYVDDKLFPAWYGMVKAQAEEERAEKVKETLAAIEKMEVAFAKCSGNGNAAFFGGDSIGYVDIVLGSFLFWFEAVRRVDGLEIIDASKTPLLAAWAERFGGSVEAKEVVPVPEADLAVQYI

SEQ ID NO: 184013 - protein, 62 aa, Triticum aestivum
  Clone ID: PAT_TA_78431.pep
LSRYYEGKSQSFACMSEVRCLEDLRKKDNPYKQKIKSCKSYVALGGMMAKKQPASTSCVNLD

SEQ ID NO: 184014 - protein, 58 aa, Triticum aestivum
  Clone ID: PAT_TA_78432.pep
ILQWLRLLLYPKWKSSRDKDELQGFAVDRPEPLVHFALSSGSYSDPVVRSAASNAHPE

SEQ ID NO: 184015 - protein, 64 aa, Triticum aestivum
  Clone ID: PAT_TA_78433.pep
QVDLDNIDEKEHPKTAALEFMDCILEEGDLLYIPPKWWHYVRSLSISFSVSFWWRTSDLPSGSS

SEQ ID NO: 184016 - protein, 119 aa, Triticum aestivum
  Clone ID: PAT_TA_78434.pep
VQIHSCFIFIYTDCASTLTRTLPNLGTMMNSRFLNQCHHNCRIQEHAVRSHSWMILLPHHHHHYQILLSPQIPLMGEQNQVTRAGLDPQVGVILDDVSIDHIMDLLDPSSCTLMQLDID

SEQ ID NO: 184017 - protein, 206 aa, Triticum aestivum
  Clone ID: PAT_TA_78435.pep
MARGLKKHLKRLNAPKHWMLDKLGGAFAPKPSSGPHKSRECLPLILIIRNRLKYALTYREVISILMQRHVLVDGKVRTDKTYPSGFMDVISIPKTGENYRLLYDTKGRFRLHSVRDEDAKFKLCKVRSVQFGQKGIPYLNTYDGRTIRYPDPLIKANDTIKIDLETNKIVDFIKFDVGNVVMVTGGRNTGRVGVIKNREKHKGSFE

SEQ ID NO: 184018 - protein, 114 aa, Triticum aestivum
  Clone ID: PAT_TA_78436.pep
TLGSSAASSLTPSSRPSTGAPTTRAPTSTSAHLLPGNHPLPHLPQMQFYTNYSSLCCSVATPRHPGLPLGFISKGRRSPATARAVSYNSPSEEEPPVLLLLHFLYVSIVPDFFI

SEQ ID NO: 184019 - protein, 198 aa, Triticum aestivum
  Clone ID: PAT_TA_78437.pep
QKEYVDFEPYYTHIVCHECCHGIGPHSITLPSGKKSTVRRELQEFYSALEEAKADIVGLWALNFLIKKGLLPKSLSQSMYVSFLASCFRSIRFGLEEAHGKGQALQFNWLYEKGALVLHSDGKFSVDFTKVEEAVESLSREILTIQAKGDKPSAQSLLQSRATLTQPLRVALEKIEHMQVPVDIAPIFGTANKLLANV

SEQ ID NO: 184020 - protein, 80 aa, Triticum aestivum
  Clone ID: PAT_TA_78438.pep
NLHLLHILNFSSRLIGPPNIPHPGNVDETRSKRQILQEEIAKRKLWLCNKHLQVEIRSSSPSPKESQGQISTTLRMNGRK

SEQ ID NO: 184021 - protein, 243 aa, Triticum aestivum
  Clone ID: PAT_TA_78439.pep
SVALQIYCSADQYGSRFIQQKLETATVEEKNMVFEEIMPHALSLMTDVFGNYVVQKFFEHGSAEQRRELADKLLGHVLALSLQMYGCRVIQKAIEVVDLDQKTKMVTELDGHIMKCVRDQNGNHVIQKCIECVPEDSIQFIISTFYGHVVPLSTHPYGCRVIQRVLEHCADPKTQQIVMDEILQSVCMLAQDQYGNYVVQHVLEHGKPHERSIIIEKLAGQIIQMSQQKFASNVVEKCLTFGG

SEQ ID NO: 184022 - protein, 109 aa, Triticum aestivum
  Clone ID: PAT_TA_78440.pep
DKLYCQCKGCSCKNTWGSYECSCGDDNMLYMREHDTCISKKGTTSTVGWSFLWVIFFGLVFAGVGAYAVYKYRLRSYMDSEIRAIMAQYMPLDNQEGANQHQVVHANDI

SEQ ID NO: 184023 - protein, 48 aa, Triticum aestivum
  Clone ID: PAT_TA_78441.pep
SAAELRHVMTNLGEKLTDEEVDEMIREADVDGDGQINYEEFVKVMMAK

SEQ ID NO: 184024 - protein, 62 aa, Triticum aestivum
  Clone ID: PAT_TA_78442.pep
MSKQGGKAKPLKAPKVDKKEYDESDLAYLQKKKDEEKALKELKAKAQKGAIGGSGLKKSGKK

SEQ ID NO: 184025 - protein, 122 aa, Triticum aestivum
  Clone ID: PAT_TA_78443.pep
NMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRMPKKQKATS

SEQ ID NO: 184026 - protein, 59 aa, Triticum aestivum
  Clone ID: PAT_TA_78444.pep
LQLIVHRQSELLQIFQASLAQARVGSRFFTFWNSSNSSVSTSQCCSGSSCFGRRERKIT

SEQ ID NO: 184027 - protein, 197 aa, Triticum aestivum
  Clone ID: PAT_TA_78445.pep
GIEASRLLESEGVQTHLTFVYSFAQAAAAAQAGASVVQIFVGRLRDWARNHSGDPEIDEALKKGEDAGLALAKKVYAYIHRNGYKTKLMVAAIRNKQDVFSLLGIDYIIAPLKILQSLEESVTDPDVKYGYVPKLTPAIGKTYNFTEEELVKWDQLSLSAAMGPAAEELLASGLEGYVNQARRVEELFGKIWPPPNV

SEQ ID NO: 184028 - protein, 211 aa, Triticum aestivum
  Clone ID: PAT_TA_78446.pep
GEHENLSLVNKNGTPSKTWKRSITHVYMCHLIQMHLDKEKASQNRVKPEEVCHSHISRSPDGSTISKNGAQDEKFYALHFDVRLPVQPSCSVCDTTIARQKMVSGNFLNLPTSAALSGVQHVQYLHPPIAPRGAMPYPIQHLPYTRGNLTHTALLLQQQMPQYMCNPNPAIMKIQQQLMPNQHQHQQQQQMWQFQFPQYHHPRPDAAAAAA

SEQ ID NO: 184029 - protein, 118 aa, Triticum aestivum
  Clone ID: PAT_TA_78447.pep
MARAQLVLVALVAAALLLAGPHTTMAAISCGQVNSAVSPCLSYARGGSGPSAACCSGVRSLNSAASTTADRRTACNCLKNVAGSISGLNAGNAASIPSKCGVSIPYTISPSIDCSSVN

SEQ ID NO: 184030 - protein, 111 aa, Triticum aestivum
  Clone ID: PAT_TA_78448.pep
AAVLNLEMAFAEITSSNGGGNDDGAAAGFFGGDSVGYLDLALGCSLPWFGALRAMFGVEVIDVAQAPLLAAWAERFAETAVAKEVLPEPDQAVAYAKKIQAYWASAASAKK

SEQ ID NO: 184031 - protein, 108 aa, Triticum aestivum
  Clone ID: PAT_TA_78449.pep
MEHGSLDDSSSSTFSIMEEDHTLANSVRFVLNQDPRVAFCGYSIPHPAENKVNIRVQTTGDPAKDVLKDALQDLMVMCQHIRGTLDTAVADFRGNKTAEAMDIDLNKK

SEQ ID NO: 184032 - protein, 159 aa, Triticum aestivum
  Clone ID: PAT_TA_78450.pep
PDTKKKGMPDRVWDDKPSNKKLDFTDPADERGDEVTDNVAVIEGESMMDKDEDLSSDSEDEEVEDGPKKKGWFSSMFQSIAGNNVLEKSDLQPALKALKDRLMAKNVAEEIAEKLCESVAASLEGKKLGSFTRISSTVQTAMEDALLRILTPRRSIDIL

SEQ ID NO: 184033 - protein, 178 aa, Triticum aestivum
  Clone ID: PAT_TA_78451.pep
RLRRRRRFRLRRRRRAPPARSEPIMADVEVETEVAAGAQPKKRTFRKYSYRGVDLDALLDMSTDDLVQLFPARARRRFQRGLKRKPMALIKKLRKAKKDAPAGEKPEPVRTHLRNMIIVPEMIGSIVGVYNGKTFNQVEIKPEMIGHYLAEFSISYKPVKHGRPGIGATHSSRVIPLK

SEQ ID NO: 184034 - protein, 227 aa, Triticum aestivum
  Clone ID: PAT_TA_78452.pep
GRYYNRYTLLDLTTFDLDEESPIGPMQFTDSPHKVIETDHFKLSGAVNFLSVKVASSDIGFPIHVYGTVIVRDSIDERCVYHFRCDPDHCQLINSEAESLILTGPKRGLALCGYMYVEIDLKIKDHLGQSREFSKGLLSISDPTNCASMVSMVETISLATRLSTVDVTYAVVNRAAEGFIAVKVLQGGFHGKITAYTTSVKDILVLYDSKEADAMTFDDCGDILQLM

SEQ ID NO: 184035 - protein, 82 aa, Triticum aestivum
  Clone ID: PAT_TA_78453.pep
MSCCGGNCGCGSGCQCGSGCGGCKMYPEMAEEVTTTQTVIMGVAPSKGHAEGLEAGAAAGAGAENGCKCGDNCTCNPCNCGK

SEQ ID NO: 184036 - protein, 151 aa, Triticum aestivum
  Clone ID: PAT_TA_78454.pep
EARFFERFNGRLPGYIGHGYDRGSFSHVDDVVKGHIAAMEKGRVGERYLLTGENASFVQIFNMAANLTNTKPPKFHIPLWLLAIYGWISVFVARITGKPPLISYPGVDCLRHQWAYSCDKAKRELGYSPRSLTEGLAETLLWLKNANLIKF

SEQ ID NO: 184037 - protein, 155 aa, Triticum aestivum
  Clone ID: PAT_TA_78455.pep
MVPAHTALPADLSVKDERELKREKRKQSNRESARRSRLRKQAETEELATQVESLTTENTSLRSEIGRLTESSEKLRLENSALMVKLKDTAALTPAEPSPHTAVTSSSSPGAAAENFLSMIDSAKAAGVSRHTEHGEPKLRQLLDSSPATDVAAVS

SEQ ID NO: 184038 - protein, 88 aa, Triticum aestivum
  Clone ID: PAT_TA_78456.pep
FFFFFFLLFFIELGTWIAFTTSHAGRATNGDRQKGSFLLCSGFFLENYLASSCELPPLHLFSLMSEGETKRNHSSYLQVQQGHKNCSS

SEQ ID NO: 184039 - protein, 45 aa, Triticum aestivum
  Clone ID: PAT_TA_78457.pep
VAYLSVGGFCLFLALLFLVLYMIKPRTLGDPSFLSWNRCTLDYPN

SEQ ID NO: 184040 - protein, 105 aa, Triticum aestivum
  Clone ID: PAT_TA_78458.pep
DALAVLETLEGAFAECSGGKEFFAGDEPGYLDVVLGGFIGWLRAWDKVGGVKLLDGGRRTPRLAAWAERFAALDVARDVIPDPDHIAEFAKVLQARSAAAAAAGN

SEQ ID NO: 184041 - protein, 207 aa, Triticum aestivum
  Clone ID: PAT_TA_78459.pep
ISKIKLKSEHVRVIDRAKLRIYPAGTDKRKLQLELHNLKSILPKVIVKGIPTVERVVIDEVKVKNETERYQLLVEGTNLLAVMGTPGVDATKTKSNHIMETNQTLGIEAARRSIIDEIQYTMKSHGMNIDRRHMMLLADLMTYKGEILGITRYGIAKMKSSVLMLASFEKTSEHLFNASYSGREDQIEGVSECIIMGIPMQLGTGIL

SEQ ID NO: 184042 - protein, 146 aa, Triticum aestivum
  Clone ID: PAT_TA_78460.pep
IISLGESKKAVENSPFLEKLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEIN

SEQ ID NO: 184043 - protein, 141 aa, Triticum aestivum
  Clone ID: PAT_TA_78461.pep
PQSSTASISAAVVSNSKRRRVKETRSIISGGERNKPGRSNDTGEMKMEQVSQRKAPLLVLVILCGLLLLLPLVSSVPLSRSVSLRNHQASVSALEAPVQVVSAAAEERDLDEVAARMVIEVNDYPGSGANNRHDPKSPGRA

SEQ ID NO: 184044 - protein, 92 aa, Triticum aestivum
  Clone ID: PAT_TA_78462.pep
SCSTLKSSLRRISNTLRSWLLTADLHVRQFALLNQLQPHLLVLQFVLLDQLQPGKEMEKPPCSLLHISQTYKQYRISSSCFNNSYVASALCL

SEQ ID NO: 184045 - protein, 194 aa, Triticum aestivum
  Clone ID: PAT_TA_78463.pep
APSMGYSFSYCLPTSSSSSGYLSIGSYNPGQYSYTPMAKSSLDDSLYFIKMTGITVAGKPLSVSASAYSSLPTIIDSGTVITRLPTDVYSALSKAVAGAMKGTPRASAFSILDTCFQGQASRLRVPQVSMAFAGGAALKLKATNLLVDVDSATTCLAFAPARSAAIIGNTQQQTFSVVYDVKNSKIGFAAGGCS

SEQ ID NO: 184046 - protein, 98 aa, Triticum aestivum
  Clone ID: PAT_TA_78464.pep
CYGFDRLRTRLANECSSKHYTFPNLTDRNTSNKHFLRKRFKSIEWRWTSYQSPCRRCVVCCNHTDYIYINASAGPMLIMLYISIAIIITIITIIILVV

SEQ ID NO: 184047 - protein, 53 aa, Triticum aestivum
  Clone ID: PAT_TA_78465.pep
ADQRMYKSTVDCWSKLYKNEGVSAFFKGAFSNVLRGTGGALVLVFYDELKNLM

SEQ ID NO: 184048 - protein, 113 aa, Triticum aestivum
  Clone ID: PAT_TA_78466.pep
STDPYFFSFSFSRCSYSYAITLSVAFKSSATSIAFLKTMYSRLSRRSFKSFASNRSCRRPISRKMQGAAADFALVSWAPFTLAVLGRNLPVALSWAWPLAMARQLRRLRRRMR

SEQ ID NO: 184049 - protein, 226 aa, Triticum aestivum
  Clone ID: PAT_TA_78467.pep
FAPPYLAPNSSAEMMNSGVNYASGSSGIFDETGSFYIGRVPLGQQISYFEKTRARILEIMGEKAATGFLKKALFTVAAGSNDILEYLSPSMPFFGREKYDPSVFQDSLASNLTFYLKRLNQLGARKIVVADVGPLGCIPYVRALEFIPAGECSAFANQLTQGYNKKLKRMIYKLNQEMGPESRFVYANTYEIVMEIIQQYRQYGFENALDPCCGGSYPPFLCIGIA

SEQ ID NO: 184050 - protein, 73 aa, Triticum aestivum
  Clone ID: PAT_TA_78468.pep
HCCDISRDEGCASQRQSTCLGLQLCWFIVFRIRLNSEFIVFRICLNCVEVSFPFGNVCTKLDRVCLVSVVFQR

SEQ ID NO: 184051 - protein, 110 aa, Triticum aestivum
  Clone ID: PAT_TA_78469.pep
KDRYQTIPSYSSIWWYSALQLGLLSQISHTVLLFSIHHRKIFLSVIIRDDSVAIRGGVGRQRFFSSTSIAAGGSHTGYFCWMVSMSSPLSFTTDSTWPLRGLSSLSLAIS

SEQ ID NO: 184052 - protein, 64 aa, Triticum aestivum
  Clone ID: PAT_TA_78470.pep
LDNNVKSTTKNFSTTRHQTHLFQIPQIKLLPDIQIVGAAAPSQKASDSEPPIKEQIYVTNSSLR

SEQ ID NO: 184053 - protein, 163 aa, Triticum aestivum
  Clone ID: PAT_TA_78471.pep
ATNEAFDQEGWFSTGDIGWIVPHHGIGPSRQCGGMIVLEGRAKDTIVLSTGENVEPAEIEEAAGRSNLINQIVVIGQDQRRLGAIIVPNNDEILAEAKRKSILGENGDLAKDKVMNMLYDELKTWTMHCSFRVGPIMIVDEPFTIDNGLMTPTMKIRRDKVTD

SEQ ID NO: 184054 - protein, 73 aa, Triticum aestivum
  unsure (1)..(73): unsure at all Xaa locations
  Clone ID: PAT_TA_78472.pep
RLEEATGLAFRFVIGKSNSKNKMAALNREVEEYDDFVLLDLEEEYSRLPYKTLAFFKAAYALYDSXFYVKAMM

SEQ ID NO: 184055 - protein, 180 aa, Triticum aestivum
  Clone ID: PAT_TA_78473.pep
QIDFSAGTSSKPGVLTKKPAGIDGDGAEVDGLCKDEGPPPALEDRRPRKRGRKPANGREEPLNHVEAERQRREKLNQRFYALRAVVPNISKMDKASLLGDAITYITDLQKKLKEMEVERERLIESGMIDPRDQTPRPEVDIQVVQDEVLVRVMSPMESHPVRAIFQAFEEAEVHAGESKI

SEQ ID NO: 184056 - protein, 76 aa, Triticum aestivum
  Clone ID: PAT_TA_78474.pep
GWELFQLIYISRNKPINPPGIIPGHPIRMKRTGPKGSGGNFLEFISLRKAMIDLSEFWLLYRVVSVWPSAPGLSSS

SEQ ID NO: 184057 - protein, 158 aa, Triticum aestivum
  Clone ID: PAT_TA_78475.pep
MAMQTGFATSKVLILVGAGLTSSIVLRNGRLSDVLAELQELMKGVNQGEGSSAYDIALLQSQIRNLAQEVRDLTISRPITILSGNSDSGGSLSSYILPAAAVGAMGYCYMWWKGLSLSDVMFVTKRNMTKAVESMSKQLDQVSSALAATKRHLTQRLE

SEQ ID NO: 184058 - protein, 194 aa, Triticum aestivum
  Clone ID: PAT_TA_78476.pep
MATRIQFENNCEVGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLGVEVFRQTIAGNILVGSYCAFSNRGGLVHPHTSVEDLDELSTLLQVPLVAGTVNRGSEVIA

SEQ ID NO: 184059 - protein, 153 aa, Triticum aestivum
  Clone ID: PAT_TA_78477.pep
DLPGIRKIIRPLEDSGVLVRRTDAELLEALESFYVVERDGSIIACAALFPFPEEKSGEVAAIAVSEECRGRGQGDKLLDYVEKVALSLGLEKLFLLTTRTADWFVRRGFSECSIESIPEQRRKRINLSRGSKYYIKQLQPKPAGVNANNFVIR

SEQ ID NO: 184060 - protein, 212 aa, Triticum aestivum
  Clone ID: PAT_TA_78478.pep
FQPATPKGPDPKWRYMWRVGPRPANTRFKELNSEPVIPEGLPEWKETMDSWGSKMISAIEVVAEMAAIGFGLSKDAFTSLMKEGPHLLAPTGSDLQRHGSEGTVFAGFHYDLNFLTIHGRSRFPGLNIWLRNGKKMEVKVPVGCLLIQSGKQLEWLTGGDCLAGMHEVVVSKRTLDAIALAKEQNRSLWRVSSTLVAHIASDAILKPLGHFA

SEQ ID NO: 184061 - protein, 99 aa, Triticum aestivum
  unsure (1)..(99): unsure at all Xaa locations
  Clone ID: PAT_TA_78479.pep
RKRSQGIRCHYXIGSATNLIMVTTTTLMLFAGRFGLAPSANRKATAGLKLEARDSGLQTGDPAGFTLADTLACGAVGHILGVGIVLGLKNTGALDQIIG

SEQ ID NO: 184062 - protein, 92 aa, Triticum aestivum
  Clone ID: PAT_TA_78480.pep
FFFFFFLVAKKLPLLTMHVFRLGSDLSLPFIATLHGMQQSYTTPMHCAVYTITTCCNGFSIRPCMQSMAGCSGLAHYANTKVLLLHPASSEG

SEQ ID NO: 184063 - protein, 137 aa, Triticum aestivum
  Clone ID: PAT_TA_78481.pep
RLLFMGLSFAIGILTFLLYLAIWYLCSRRRQLRRRQRGELFAPGVGDTDGDHGMSADAIAALPTFVHGAEAPALDCPVCLGQVEAGEKVRRLPKCAHSFHADCVDAWLRAHSTCPMCRAAVGTAAAATATKQQAEVA

SEQ ID NO: 184064 - protein, 201 aa, Triticum aestivum
  Clone ID: PAT_TA_78482.pep
PYFDPLVDMDPRLVVTMLDLPRDADVNALVLRFGGECELVWLNDKNAIAVFNDPARAATALRRLDYGSAYQGAAMFMPSSAQASSSGNVWTGEHKDGGLTARSNPWKKPDLPSGDWTGVAGHAPAPGWRGANTATQVMGTANRWNVLESDTAASSGSGDERKPAPRTDAAYSAIPNAGNAGPSVTKLQPDVEVDDWEEACE

SEQ ID NO: 184065 - protein, 142 aa, Triticum aestivum
  Clone ID: PAT_TA_78483.pep
EPHSSGLWPLLSLNGSDGSLQGFEELLASVLGKKAGEKGTFKLLKARASAQTYVKMAFTVEKKLVEGEVNWSNIPEWKTKPKRLRAHYEVLARVEEGQAIPERIAQVQPFQADEAMSESVLTGNVTRSKMEIVHPPPVYFTL

SEQ ID NO: 184066 - protein, 125 aa, Triticum aestivum
  Clone ID: PAT_TA_78484.pep
MDTLLGSGRFLARRPPLALAPRCSRGSPEKGGGSDKGDTSSTDWDKAWSTFKKKGKKTLFSEFSPNKYVSWNPRRSEYPLSEEVDPIRRTERSNLMLWTSPKFTLVMAIVIVSTLLIYTIVVPPK

SEQ ID NO: 184067 - protein, 115 aa, Triticum aestivum
  Clone ID: PAT_TA_78485.pep
MSDLDVQIPTAFDPFAEANAGDSGAAAGSKDYVHVRIQQRNGRKSLTTVQGLKKEFSYSKILKDLKKEFCCNGTVVQDPELGQVIQLQGDHRKNVSNFLVQAGIVKKEHIKIHGF

SEQ ID NO: 184068 - protein, 219 aa, Triticum aestivum
  Clone ID: PAT_TA_78486.pep
AFLKFASYYYAREAFCRLMKSDAVFGTDRRAKVSFSETPTKSSKSLLEAKKVYLEHVPVSWDENKIKEYCEEYGEILKVDLFQILKNLEKETISFVEFSSSTGALACVAGINKSKIVDGSFKLCAYLAWPKSALKVNSATPSNAATTTEKDKNHTEKVVVDKNLPHKFQKGDKSKLTSRTKEAIMKTNSSSKLPNDNDTKLTSQGAAEVPQTSKSSEGK

SEQ ID NO: 184069 - protein, 95 aa, Triticum aestivum
  Clone ID: PAT_TA_78487.pep
VITKTHCCLFLLLDTSTWIGSSKKPPPGSNPEETPTKQMVAISPATTTGSSTLAHNNVPKHLFGDTSLGNQDDKSCGEEGHNSTESNGRKQKTNV

SEQ ID NO: 184070 - protein, 162 aa, Triticum aestivum
  Clone ID: PAT_TA_78488.pep
MAAAVAAQLRGPSAAAARRWPAPSGGVLRFAPLATSTVPASIARGSLRGVPAGVVLPKPLIAMCMKAEYTSSPVDPNAVVEHTEDENQQPTTVSPTNAEIDIDQEAVPQHKGAIIHDFCLGIPFGGILFSMGLVGFLFWRSTVSLTFGVAPGLAILALGVLS

SEQ ID NO: 184071 - protein, 197 aa, Triticum aestivum
  Clone ID: PAT_TA_78489.pep
ASKISPSVIFVDEVDGMLGRRENPGEHEAMRKMKNEFMVNWDGLRTKVKERVLVLAATNRPFDLDEAVVRRLPRRLMVNLPDAPNRKKILSVILAKEDLADDVDLEALANLTDGYSGSDLKNLCITAAHCPIREILEREKKERTLAEAENRPAPPQCCSGDVRSLKFSDFKHAHEQVCASISSDSNHMNELVQWNDL

SEQ ID NO: 184072 - protein, 151 aa, Triticum aestivum
  Clone ID: PAT_TA_78490.pep
MADSMVASFWGPVTSTTELCEENYAHSSYIAEFYNTISNVPCVLLALIGLVNAFRQGFEKRFSVLHISNMILAIGSMIFHATLQLLLQQSDETPMVWEILLYMYVLYSPDWHYRSTMPTFLFLYGAAFAVVHFFARFQVVFKLHYIGLCFL

SEQ ID NO: 184073 - protein, 182 aa, Triticum aestivum
  Clone ID: PAT_TA_78491.pep
ANVVKKMTQEQILAFEKCGEISFFGHCLKVDDIKVVRQFKRPENVSEKEIDAAGDGDVLVILDLRTDQSLFEAGVAREVVNRIQKLRKTAQLKPTDPVDVYYESVGNDKNTLEEILKSQGQYVRDTLGSPIIPKEMAPRDVVVLGEESHNVHDMSFVICIARSTPILSPDLLPNASAIMWRH

SEQ ID NO: 184074 - protein, 151 aa, Triticum aestivum
  Clone ID: PAT_TA_78492.pep
MCKISEDVTPPAPVLKALSILSCLLPEAKLFPQKDIGDLAFRDPRKRKVAEYNAISYSDQMRLRTAVELLKATKDIESQLEKISSPLLILHGAADMVTDPQVSKFLYEKASAKDKTLKLYEGSYHSILEGEPDERISTAISDIISWLDSHC

SEQ ID NO: 184075 - protein, 55 aa, Triticum aestivum
  Clone ID: PAT_TA_78493.pep
MNDPLLPPVLHYYYYYYYANGLIICLALPSFSLYKWDSEYHLLLRTVLHMSPLWQ

SEQ ID NO: 184076 - protein, 119 aa, Triticum aestivum
  Clone ID: PAT_TA_78494.pep
AAILNTSRSDPKIKLQTSNRARAWKNEPRGLPLLDKRSGSVATTGGYAQQAASSGETLPLRLPVILTKMNNLPRLPHPLSCRNSPLWLCFTTGLDALGWAAGVYASMLVSIRIIVPVKW

SEQ ID NO: 184077 - protein, 135 aa, Triticum aestivum
  unsure (1)..(135): unsure at all Xaa locations
  Clone ID: PAT_TA_78495.pep
PTPLKDIFHGKKVVIFGLPGAYTGVCSQAHVPSYKNNIDKLKAKGVDSVICVSVNDPYALNGWAEKLQAKDAIEFYGDFDGSFHKSLDLEVDLSAALLGRRSHXFVDDGKIKAFNVEVAPSDFKVSGAEVILDQI

SEQ ID NO: 184078 - protein, 106 aa, Triticum aestivum
  Clone ID: PAT_TA_78496.pep
TSSARSVCRLLSAPPLRPSAKSMPRRGIPRMTSTSASPTSRISKQQHMLPQTRGICSAQQREKSVVIHQVLSSSSVTGCHILCVNGSQLLLLLLQLLSVVLPHLNM

SEQ ID NO: 184079 - protein, 53 aa, Triticum aestivum
  Clone ID: PAT_TA_78497.pep
IVQQASSPQDNKNSALHLLEETFYSKARSKLQTWGNLQQHSLCILMMFLSKGC

SEQ ID NO: 184080 - protein, 166 aa, Triticum aestivum
  Clone ID: PAT_TA_78498.pep
MSSSTFSGDETAPFFGFLGAASALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 184081 - protein, 55 aa, Triticum aestivum
  Clone ID: PAT_TA_78499.pep
YAVLMLWMKRSEDYSCALIRSCPAFTVLMQALNVSTVLSDQSLKLLFSDQKKKKK

SEQ ID NO: 184082 - protein, 124 aa, Triticum aestivum
  Clone ID: PAT_TA_78500.pep
PKRGAEVSLNDIDNLTWERLDGLLDMFLKDFEAGAVESNGWPMYFSAYKVAKAAMNAYSRILARRHPELRVNCAHPGYVKTDMTIHSGLLTPYEGGSRVAMVALLPEGGPTGAFFEDFAESSFV

SEQ ID NO: 184083 - protein, 41 aa, Triticum aestivum
  Clone ID: PAT_TA_78501.pep
FMVKTRRRKGMSEDVSINKFFDEAMMNELAQQAADIHLQMM

SEQ ID NO: 184084 - protein, 198 aa, Triticum aestivum
  Clone ID: PAT_TA_78502.pep
YDEREFWYSSDQLRLHNFSSLSIADSIWSSPSPAAVDHSSNKLALANNSNNNATAKTYFNKSVGRPANNNFNFNYNSNSVVVDAFNGKKKAAVDAPAGGGGGGRNSNKKNSSSNDNKMSSRLKKSQLPASESVPKEEAIGGYIFVCNNETMEENLKRQLFGLPSRYRDSVRGIRPGLPLFLYNYSTHQLHGIFEATSF

SEQ ID NO: 184085 - protein, 81 aa, Triticum aestivum
  Clone ID: PAT_TA_78503.pep
LTNKIIAPKIPWDRHKPECDSLSDSSRRSEDQDECGLVDALTAAITRVRISEPKRSRLCSPAITIQQECSSNLKNNLCTAF

SEQ ID NO: 184086 - protein, 49 aa, Triticum aestivum
  Clone ID: PAT_TA_78504.pep
ISSKVKSVWSSFIHKLSMNIVAIDHKKFKYNVLKVFSSNVSLFLEVIRL

SEQ ID NO: 184087 - protein, 58 aa, Triticum aestivum
  Clone ID: PAT_TA_78505.pep
VDLIEPLAMTNADKQLPHFLTVAGRLSYHIDPTKMLLTSITIAILTKSEIVWQITQRK

SEQ ID NO: 184088 - protein, 223 aa, Triticum aestivum
  Clone ID: PAT_TA_78506.pep
PSGNACGDIQLQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRK

SEQ ID NO: 184089 - protein, 65 aa, Triticum aestivum
  Clone ID: PAT_TA_78507.pep
LCLPRNTPLYSIFIFILCTAHEILSAPGALQRIRRGSPFKCAPFAQVRIVHVSSIRLSAQFNSYI

SEQ ID NO: 184090 - protein, 58 aa, Triticum aestivum
  Clone ID: PAT_TA_78508.pep
GLHALFLNPHKFKIHDFGVKVANVFAGLALRIKVRILTKALSVTLQQTGLAHFASALH

SEQ ID NO: 184091 - protein, 99 aa, Triticum aestivum
  unsure (1)..(99): unsure at all Xaa locations
  Clone ID: PAT_TA_78509.pep
RAYSLQHLXIGGTFITDESLYAVANSCTNLKSIILWSCRHVTEAGLVALVNKCRRLECINVGGMRVPPESFVGLLSISPALQIRSIHRILNAGVGVQVS

SEQ ID NO: 184092 - protein, 177 aa, Triticum aestivum
  Clone ID: PAT_TA_78510.pep
QSSNLRKFTFGELKGSTRNFRPDSLLGEGGFGSVFKGWIDERTLTPVKPGTGMIVAVKKLKLDSFQGHREWLAEVNYLGQLSHPNLVKLIGYCFEDEQRLLVYEFMPRGSLEHHLFRRGSHFQPLPWNLRMKVALEAARGLAFLHSDQAKVIYRDFKTSNILLDSDYNAQLSDFGLA

SEQ ID NO: 184093 - protein, 188 aa, Triticum aestivum
  Clone ID: PAT_TA_78511.pep
KSVLIAKIDCDEHKSLCSKYGVSGYPTIQWFPKGSLEPKKYEGQRTAEALAEFVNTEGGTNVKLATIPSSVVVLTPETFDSIVLDEAKDVLVEFYAPWCGHCKSLAPTYEKVASVFKLDEGVVIANLDADKYRDLAEKYGVTGFPTLKFFPKGNKAGEDYDGGRDLGDFVKFINEKSGTSRDTKGQLT

SEQ ID NO: 184094 - protein, 174 aa, Triticum aestivum
  Clone ID: PAT_TA_78512.pep
MGGFVKTQKTHAYFKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIP

SEQ ID NO: 184095 - protein, 59 aa, Triticum aestivum
  Clone ID: PAT_TA_78513.pep
PGVVSHNEILEMYKKYINPDFKWTNFTLEEQAKVIVAPRSNNEMDASKLKAEFPQLLSI

SEQ ID NO: 184096 - protein, 199 aa, Triticum aestivum
  Clone ID: PAT_TA_78514.pep
YTGVACNPTTFLKGIQAYATQTTFAAGCKDVSCNSTELFGEAIAAAKRADIVVVVAGLNLTEEREDFDRVSLLLPGKQMSLIHAVASVAKKPLVLVLLGGGPVDVSFAKQDPRIASILWLGYPGEVGGQVLPEILFGEYNPGGKLAMTWYPESFTAIPMTDMNMRADPSRGYPGRTYRFYTGDVVYGFGYGLSYSQYSY

SEQ ID NO: 184097 - protein, 195 aa, Triticum aestivum
  Clone ID: PAT_TA_78515.pep
IKGVKGPTTKCYRQANPGEPALERASTKERAMASIICSSKLSGTLLEPMLDPTEVDELPTPASTITSASAILVPASATSDHRPLELEYSEPSIVRCVLLLDGSSTLESEELLPTTLRSSVEDLSDLLRISNLGVWQADALEDSPCICCCSAKAATAKANPPEEAASGVVVIAPSKGLEGIDDGVVLTHPEFPKAS

SEQ ID NO: 184098 - protein, 214 aa, Triticum aestivum
  Clone ID: PAT_TA_78516.pep
FPRESVHLFHSSYCLHWRSQEPEGLEAWRKTYLNKNNIYITKTTTPFVVKQFQKLFYKDFSLFLQLRHEELVHGGQMVLIFLGRKNEDVYNGDLNQLFALVARSLQSLVLKGIVEKEKLESFNLPIYGPSVGEVKELVMQSHLFNMDLIKQFEMNWDPFDDLEGDDVEDNTRSSMNIAKFIMSVLKYLIVHHFGETILDAWFAEFKCLVGEHLE

SEQ ID NO: 184099 - protein, 62 aa, Triticum aestivum
  Clone ID: PAT_TA_78517.pep
GGHGDKTPPGRVTGEAAIPSNPTPRMHGFEAPWAGEFSIRCVPSQVLITSALIEGTKLSEAV

SEQ ID NO: 184100 - protein, 133 aa, Triticum aestivum
  Clone ID: PAT_TA_78518.pep
SEGWLKTGDLCYFNEDGFLYIVDRLKELIKYKGYQVPPAELEHILNSHPDIMDAAVIPYPDEDVGQLPMAFIVRKPGSNLTKQQVMDFVAKQVAPYKKVRRVAFVSAIPKSPAGKILRRELVEQAVSMVTSKL

SEQ ID NO: 184101 - protein, 236 aa, Triticum aestivum
  unsure (1)..(236): unsure at all Xaa locations
  Clone ID: PAT_TA_78519.pep
REARNKPLPLGCHDIIPRVLPMFSKAVEEHGKPSFTWFGPTPRVMISDPESIREVMSNKFGHYGKPKPTRLGKLLASGVVSYEGEKWAKHRRILNPAFHHEKIKRMLPVFSNCCTEMVTRWENSMSIXGMSEVDVWPEFQNLTGDVISKTAFGSSYEEGRRIFQLQAESAERIIQAFRTIFIPGYWFLPTKNNRRLREIEREVSKLLRGIIGKRERAIKNGETSNGDLLGLLVESN

SEQ ID NO: 184102 - protein, 38 aa, Triticum aestivum
  Clone ID: PAT_TA_78520.pep
DEMKEFAAYGKLRLERMNKKHLGARQKKAAEAEKEDKK

SEQ ID NO: 184103 - protein, 101 aa, Triticum aestivum
  Clone ID: PAT_TA_78521.pep
MDGSAFLSLSPELRDALAKVAVFVLVQGLVYLILRSSSDVFSKDGGGLRSLSFRPMRSMSVRRVLAPLSDVPVGTDEPSPSPSWSMSPAASSSRRRAARED

SEQ ID NO: 184104 - protein, 104 aa, Triticum aestivum
  Clone ID: PAT_TA_78522.pep
QRALAALVGGRHRGYRSDRTAVRRIIPVFSCVLLSSSCGDDWATADGRCLLETSTQQIVKENQKLHKVNIEIEDEISEQKGEILQVEEGFRGTLLTSSVSPQLC

SEQ ID NO: 184105 - protein, 89 aa, Triticum aestivum
  Clone ID: PAT_TA_78523.pep
RSQRIWAEHCLGCDHVNHLTSAEHPNSRSVRKFPKSPSTIPVYFGSGIGFKNFQIQGGTNGQWNRDGLWRQQLWLEILSQLLCVTSAET

SEQ ID NO: 184106 - protein, 74 aa, Triticum aestivum
  Clone ID: PAT_TA_78524.pep
RGAAVSSPGRAPTATPTRTSTSSPPRTPPPTPSPPLPPPPPTAAATRSPATTSSRQAAAASPGVARSVFIPSQS

SEQ ID NO: 184107 - protein, 90 aa, Triticum aestivum
  Clone ID: PAT_TA_78525.pep
IQKLTYQRLPCSMGVRSKSLLSLLTRPVLVACPPWRQLKLCLAYQRCLVITNNLADYFGIVFSGAVRNCGVSMCSASIVETNMFPSREDI

SEQ ID NO: 184108 - protein, 72 aa, Triticum aestivum
  Clone ID: PAT_TA_78526.pep
ISNGDKIVRYSLPLTKPFDEPFRRFFTLKTTVTQEGNQLIFRSKLSDGNIITRGYHFSNSRIQADYSQKKYG

SEQ ID NO: 184109 - protein, 75 aa, Triticum aestivum
  Clone ID: PAT_TA_78527.pep
LDRSKVNVNGGAIALGHPLGATGARCVATLLNEMKRRGRDCRFGVVTMCIGSGMGAAAVFERGDSVDQFSNVRHH

SEQ ID NO: 184110 - protein, 219 aa, Triticum aestivum
  unsure (1)..(219): unsure at all Xaa locations
  Clone ID: PAT_TA_78528.pep
FCRECRVVRXGLAGDLKKAMKDGKPIIIEGIHLDPSIYLMDEEKRDGNSRTEKTVMDSENPGISVERKTEHQSKNGLAENRMNPTEDNKNFVKIKESMLEGSRTRKGLSYAESHETKIHDSACSQERNPKDESDGHKDLDQQKNNTTKKDKPAAEPIVVPIVLRMSDFDHKALLEEWIATRAFRDNCIPQDHRKLINNLKLIQDYLCSFESQGLTIVDI

SEQ ID NO: 184111 - protein, 111 aa, Triticum aestivum
  Clone ID: PAT_TA_78529.pep
VPCIFSCLCNATLSFSFPSPNTTYLGQKKIRKNKVKKKKRATRRLLHKTVVVQHQHQQQTAGPSLSMCRVEKRGRVPLQLALQIDPDPVHLLLAPVQLLVGDLRHAQHPRH

SEQ ID NO: 184112 - protein, 198 aa, Triticum aestivum
  Clone ID: PAT_TA_78530.pep
MLGVARRRLGSGCALGQLMQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAA

SEQ ID NO: 184113 - protein, 217 aa, Triticum aestivum
  unsure (1)..(217): unsure at all Xaa locations
  Clone ID: PAT_TA_78531.pep
LGVSGVNXQNVHDFCSAIACHKTHLESLSVWFNKDINRAGCLDAISSSPMKLHSLELYGHQDNKLPSWMKLRPVHQNPLSKLDLHMTTIPQDEIDHVLGDLPKLRILRISFEEFQDGHLQIRGGFKALQLLEISLNHGLQTVTFHSWAMNNLEVLKLCCSDNVDVHPSLRFSGKNCLNSLYQVMLSGYCQDAMKQQLRELPWPWEIPPVVTADSRSS

SEQ ID NO: 184114 - protein, 50 aa, Triticum aestivum
  Clone ID: PAT_TA_78532.pep
FYIFVKIKRRYFRINNIHTALIFYNTILILPGNKLVNICLYNIILLWYMF

SEQ ID NO: 184115 - protein, 106 aa, Triticum aestivum
  Clone ID: PAT_TA_78533.pep
SEMSRCPAGGGRPARRRPIDRSLGPPKQQVHHLVRLAAAVRRAPPRRCRRRGRGRGRAGYPQLLAGVARQRTQRRRELPPALAPAAHGESTTAFSLALLAMLSSSC

SEQ ID NO: 184116 - protein, 63 aa, Triticum aestivum
  Clone ID: PAT_TA_78534.pep
WMITGVLILQTLAQALVVIEREINKLAKVKYQIGSNHHRCAWQYSITAHNCIMRYSVSFHISR

SEQ ID NO: 184117 - protein, 215 aa, Triticum aestivum
  Clone ID: PAT_TA_78535.pep
VYGFESFFFVSRWAMHQLLVECPSIYEMLPNPEFKWREKPIIQVWRKDPEKDGIVELVQYEATDCVSLFEEALRNNELTYNGKKVALPFNMSVFKWATKTRQILDNAELPDSVSFYNICGTSYETPYDVCYGSESSPIGDLSEVCHTVPAYTYVDGDGTVPTESARADGFSAKERVGVEADHRGLLSDENVFKLLKKWLGVSEKSEWRCVSNPKW

SEQ ID NO: 184118 - protein, 145 aa, Triticum aestivum
  Clone ID: PAT_TA_78536.pep
LGGRKPSDVLFSKDRPRWYDGRREVHIHPSSVNHSLKAVQYPFLVFLEKVETTKVFLRDTSVVSPYSLLLFGGSMVIQHQTGVVVIDGWLRLSAAAQTAVLFKQLRITLDAVLKELTRKPEMATFVDNEVVRSIIHLLLEEDKAR

SEQ ID NO: 184119 - protein, 137 aa, Triticum aestivum
  Clone ID: PAT_TA_78537.pep
NRGKSISYKICKFSVCFSSPRDKLDNHSWLFDCTHDKWLQLAVQNRSLTVKNRFLCCFCTMAENSRHGRRSNTGSESCTLLFAEVCTVVGAGFQLLGVVQLPDSLHEVLMDNVVPFSTNCSHTRFSADVAKISPIEA

SEQ ID NO: 184120 - protein, 180 aa, Triticum aestivum
  Clone ID: PAT_TA_78538.pep
LVGKGAKAFFRDKEGRRISEEEMRKAKEPEKPKEIHIEWGKGLVQKREAEARLKEIEAEKKKPFARTRDDPELDNMLKERIRWGDPMAHLVKRKDPEFILEDLGDDEKMKESGFIVPQNVPPHSWLKRGVDAPPNRYGIKPGRHWDGVDRSNGFEKDMFKLKNEKQAMEQEAYLWSVSDM

SEQ ID NO: 184121 - protein, 71 aa, Triticum aestivum
  Clone ID: PAT_TA_78539.pep
KCRLLFTNKEAGKDLKDPLHLKLYQWDMISPIPFRSFVQRSFSCEDMVSNNLIMLLHLSMPPMSVSDGQSC

SEQ ID NO: 184122 - protein, 78 aa, Triticum aestivum
  Clone ID: PAT_TA_78540.pep
QERLQTEGSNNTTCSTAFQCTMFPVGGQHHPTTTNPTQLQNPLQAHLHPRAWSVGPCRQLFLNLIISHFFPSFRTLSP

SEQ ID NO: 184123 - protein, 60 aa, Triticum aestivum
  Clone ID: PAT_TA_78541.pep
RTRREAGENSYSSGYAECLVLGSKESKEATWHEVGFQIFMGSGLNAIAIQCFTHPVFPCP

SEQ ID NO: 184124 - protein, 140 aa, Triticum aestivum
  Clone ID: PAT_TA_78542.pep
GSRLQGQNLVVTIEDDSETTPGQAGDAVDEHVDILLSLTLGRYPRHGHQRSSNISTSPVIHIIDTPSNALPEPEKAVPKEPTFNCPVCMNELVEPSSTICGHIFCKQCIKASIQAQKKCPTCRRKLTMNNFHRVYLPSAE

SEQ ID NO: 184125 - protein, 56 aa, Triticum aestivum
  Clone ID: PAT_TA_78543.pep
STTYELENVCLGPRWSHVQIPIYRLFRPICFIAQCLLLAQSRWRLKKELFYFAKLA

SEQ ID NO: 184126 - protein, 62 aa, Triticum aestivum
  Clone ID: PAT_TA_78544.pep
AQTLACTHTILVCICMYLEPLYKLANLCVLKRKNECYGPSNAISPVAGPSMQSCLQTGHVRC

SEQ ID NO: 184127 - protein, 146 aa, Triticum aestivum
  Clone ID: PAT_TA_78545.pep
EKQAGDGFRLTAAKPAAITLAERQPIPIPTCSCSCTVAKKSRSDRLAWRVAVASGDADAEADGAEASAGAGQAPTARAGRRARLSARRRERVPLPDGVSGVSVGEFLRHPDAVESLLNTGALESFAPAGTGPGTITCGLRRIGLPG

SEQ ID NO: 184128 - protein, 232 aa, Triticum aestivum
  Clone ID: PAT_TA_78546.pep
ELSLPFFHHEVVKRALTFAMENISSQPLILKLLKEAAAGCLISPNQISKGFSRLAEGVDDLSLDIPSAKALFDKLVSTAMAEGWLDASFGKSAAPDEEMQNTSAVKMKHFKEESAHIIHEYFLSDDVPELIRSLEELSAPEFNPIFLKKLVTLAMDRKSREKEMASVLLSSLRLELFSTEDIMKGFIMLLQSAEDTALDIVDAPSELALFLARAVIDEVLIPLNLDEISIKL

SEQ ID NO: 184129 - protein, 167 aa, Triticum aestivum
  Clone ID: PAT_TA_78547.pep
MASPSAPGPKLQKAMVAVDESEFSHHALEWALRNLAPTIAPPLLVLTVQPLLPLGYVSAASFGSPLGTPVVAPELIKAMQEQQQQLSQALLDKAKQICAQHGVAVETMIKVGDPKEMICQAAEESKVDLLIVGSHSRGPVQRLFLGSVSNYCMHHSKCPVLVVKKQE

SEQ ID NO: 184130 - protein, 96 aa, Triticum aestivum
  Clone ID: PAT_TA_78548.pep
LTTGTQKKGQAAVFDFKFPLYVVNIDLATIYVLDTDYNNFIVLAGGVSLGPIGYIKFAWVNSRTQDLLPEYRERAYKALVNSGFTTKDMVRVPQGC

SEQ ID NO: 184131 - protein, 155 aa, Triticum aestivum
  Clone ID: PAT_TA_78549.pep
TACIITLKDQGIHAVNLGDSGFVVVRDGRTVLRSPSQQHDFNFTYQLESGGGSDLPSSAQVFHFPVAPGDVIVAGTDGLFDNLYNNEISGVIVEALRVGLEPQIAAQKIAALARQRATDKNRQSPFASAAQEAGYRYYGGKLDDITVVVSYVKSA

SEQ ID NO: 184132 - protein, 80 aa, Triticum aestivum
  Clone ID: PAT_TA_78550.pep
VEEMIINNIINVIGTNNWLLVRSTSYFAKVSCFLYFLEIHQIYLGYLFYPSFGFCCSCSEVPCSYHRTIVVFPPWKPLFC

SEQ ID NO: 184133 - protein, 76 aa, Triticum aestivum
  Clone ID: PAT_TA_78551.pep
NSYPDHTRKKIHTCCPLAHLFQHLFNDHMIYRCHMGEQNNGRSKVLILILPETCRWLWCRINYLLFCCSLGVVGLH

SEQ ID NO: 184134 - protein, 130 aa, Triticum aestivum
  Clone ID: PAT_TA_78552.pep
EALRSDAAEPPVPSSVPRSVPVRVAYELQQAGHRYLDVRTEGEFSAGHPEGAVNIPYMNKTGSGMTKNTHFLEQVSRIFGKDDEIIVGCQSGKRSLMAATELCSAGFTAVTDIAGGFSTWRENELPTTIH

SEQ ID NO: 184135 - protein, 98 aa, Triticum aestivum
  Clone ID: PAT_TA_78553.pep
LGRTYFSWSGDSICSSFISRFCFLISFSGQLLLPNPYLLLPSYDCRLEIINKCFSKKTVEEIIASLEQEAPNVADEWIASAIQSMRKASPTSMKISLR

SEQ ID NO: 184136 - protein, 71 aa, Triticum aestivum
  Clone ID: PAT_TA_78554.pep
SIYCQVKGLLFCKILFSLYLILLLAYVLESSFHTVVKKSKIEEANANLSMFASFIWEFACYGCIKCRAVFV

SEQ ID NO: 184137 - protein, 90 aa, Triticum aestivum
  Clone ID: PAT_TA_78555.pep
MASLTGSALSFARPVKAISIKSSSFSGLRKDNVAFRLQPVPQRFAVCCPAKKETVDEVCKIVKKQLALAEGTDVCGSSKIQELGADSLDT

SEQ ID NO: 184138 - protein, 93 aa, Triticum aestivum
  Clone ID: PAT_TA_78556.pep
SLDEFAALNATVAGDAAAVEEDLRHAFRVFYADGNGTISAAELARVLRGLGESASVAQCRRMIEGVDQNGDGLISFEEFKVMMAGGGCFAKIA

SEQ ID NO: 184139 - protein, 100 aa, Triticum aestivum
  Clone ID: PAT_TA_78557.pep
KQASRPLLVHETAHCTERAAGPKMTSLGPDLLAPWNACPYTCPSTKWGRWPPWPKILSPWPWTASCTEPPREGHGLEHYMSNFFFGHLTPPRVLAPALHL

SEQ ID NO: 184140 - protein, 96 aa, Triticum aestivum
  Clone ID: PAT_TA_78558.pep
VCTCISLGSVGLVLSIAVPEGGNNWFWLMTLSPLAGVYYWTKASRKEEIKVKMILSDDGSLSEILVQGDDVQVEQMRKELKFSEKGMIYVKGIFET

SEQ ID NO: 184141 - protein, 168 aa, Triticum aestivum
  Clone ID: PAT_TA_78559.pep
MAFLACLCRCPQDEDDDDKEGEQFRINRQVASVDYSKSPESCPLKTERAVHMEGAQLIGRHDEATIFTLRQLAEATKNFSEDYLLGRGGFGCVYKATLSNGQVVAVKQLDLNGFQGNREFLVEVLMLNLLHHRNLVNLHGYCVDGDQRLLAYEYMPLGSLEDHLHDLA

SEQ ID NO: 184142 - protein, 102 aa, Triticum aestivum
  Clone ID: PAT_TA_78560.pep
LRSLIELASTDTKPRPIGAFLIWADPLYATLTTCSVGTTQNSNQKNAIRRAPRLAKLLTLPIPWCSHIAAKGDLVCNCFSNVFMACAKSRCTNKSLSVKRML

SEQ ID NO: 184143 - protein, 55 aa, Triticum aestivum
  Clone ID: PAT_TA_78561.pep
CFNEFSSNRSRKIIIIHMKHWLYIVCRVTYYIFINTKWILVNINMLIFISGSFHN

SEQ ID NO: 184144 - protein, 113 aa, Triticum aestivum
  Clone ID: PAT_TA_78562.pep
KGMAGGELVVVPVDKTGFVPEDATIVGNTCLYGATGGQVFVRGKAGERFAVRNSLCQAVVEGTGDHCCEYMTGGCVVVLGKAGRNVAAGMTGGLAYILDEDDTLLPKVNKEIV

SEQ ID NO: 184145 - protein, 113 aa, Triticum aestivum
  Clone ID: PAT_TA_78563.pep
FNAKGTIDCYEGDMEVLPDAGARRREIAFNMIDGDFKLFQGKWSVEEVDGSIVEGGGNSEEQEFQTTLSYLLELEPKLWVPVRLLEGRICSEIKNNLVCIREQAQRIQRLQHE

SEQ ID NO: 184146 - protein, 188 aa, Triticum aestivum
  unsure (1)..(188): unsure at all Xaa locations
  Clone ID: PAT_TA_78564.pep
MEMYRRIXRGDVKYPQWFSSDLRRFMSKLLDPNPNTRITIEKLVEHPWFKKGYKPAVMLAQPHGSNSLKDVQVAFSTADNEGGSKVEQPAGSSVKPSSLNAFDIISHSKGFDLSGLFAVDQEQKASNSRFMTQKPASAIVSKLEQIAETESFMVKKQDGLVKLQGSKEGRKGQLAIDAEIFEVTPAFY

SEQ ID NO: 184147 - protein, 46 aa, Triticum aestivum
  Clone ID: PAT_TA_78565.pep
CTKFNLVPCYLFVPLERGIDTCTIACHLFGSIQQFDLTKKKKKKKK

SEQ ID NO: 184148 - protein, 135 aa, Triticum aestivum
  Clone ID: PAT_TA_78566.pep
PFSSIGIAIGKAYRRMWAVLKGLNHNRPINGTVLNRLSWRHYFKTPFLKQVHRPVSSLNIINHKSIPQQPFKLSHLKTYLISRAKHTKHFHKAGIKVNMEIIKVDNAANRIHSTPIHLMHHINSSDINNFMKIQG

SEQ ID NO: 184149 - protein, 102 aa, Triticum aestivum
  Clone ID: PAT_TA_78567.pep
SHSLHSSKPSPPIGFGERDAKQDVPRRGPASPEQGGCVQAAAVAPRHHGLLRRRHPRRPLHPPLPHPRRRCPGAQARALGPSVPMPPPKVLQRQSSFETTAK

SEQ ID NO: 184150 - protein, 143 aa, Triticum aestivum
  Clone ID: PAT_TA_78568.pep
KERLGDRITALHQIVSPFVKTDTASVLQETIGYIRFLLSQIEALSFPYLGHGNGGNSMQQHNLLLNHSTGNDMVEVEGSTKQEEEEVINGVDGSRKDLRSRGLCLVPVSCTSHLADDNGASDFWAVAAAPPPPPPPLAGIIWR

SEQ ID NO: 184151 - protein, 77 aa, Triticum aestivum
  Clone ID: PAT_TA_78569.pep
NEIVFSGLGFLPSINEVQVGVYFPLDWDRIRAARDHETQYKIIEEEKQEERRKRGELKKKIQEQLAQNTNEPIVTVD

SEQ ID NO: 184152 - protein, 257 aa, Triticum aestivum
  Clone ID: PAT_TA_78570.pep
SSAFSSSPAQQTSGYGSSFYQSLPNGVKGSQNSQIQQQQSDAESLPNQTSQPAFASFSASVKGSAPVAPQTQQNFDDGYSSGFQAPIASSAPVQQTQSERGYSSVPQSSGVKGGQQVASSYEQSPLPNVSGTKSSLNQPKVPLTIPNYRTKAGRSQLSSTKSSKTAPSNQKSPISSYPSFPISQQTQPEQQQDTKGAVKPQPQPNTKTALKNPSTSYLPALSPPSATKSTYSAPPQSKSPQQGSSYFPLPVNSQQQL

SEQ ID NO: 184153 - protein, 162 aa, Triticum aestivum
  Clone ID: PAT_TA_78571.pep
AAFYSTKYLNLPQVQTAMHANVSGIIDYPWVLCSDPLYYNWTDTPASMLPIYKELIGAGLKVWVFSGDTDTAVPLSGTRRSLAALGLPVKTSWYPWYIVSTEVGGWSMEYEGLTYVTVRGAGHEVPLHRPEQAFFLFKQFLKGQPMPAEAKDASLILLPSEK

SEQ ID NO: 184154 - protein, 122 aa, Triticum aestivum
  Clone ID: PAT_TA_78572.pep
RERERERERERERERESCPLCSSGESSWAGSTGSWPSTSPASSCPSSRRPVPSGSDFNLSLSISSVFLPSFFFFFSLHLPEMMASSCFNPGRWIDRVYCITSRRMRWHSRTLIFFFFIYFFN

SEQ ID NO: 184155 - protein, 213 aa, Triticum aestivum
  Clone ID: PAT_TA_78573.pep
GTEVEVEIIATKDDGIDHVQFSIKEKRSNGQRIAEPLVEEFEYLNLDNRISPITFCKAFPFHLIFDRNLQVKQAGTSISRVLPALQLTNCRVNTVLEMVRPHMEFAFKNILSHINTVFVLRIITDMISTRPPDCPHKATNVKLRLKGQMIHIPENDLVLFLCSPSVVNLEDLNNQGLYLDDIPLHDATRDLVLLSQQFEAEYELTQNLEILTD

SEQ ID NO: 184156 - protein, 99 aa, Triticum aestivum
  Clone ID: PAT_TA_78574.pep
LKITRLFTIQLRNDQQYPEKPSTLTFSNYTGYNKPMVINLAECEYSDERYRHEYEHTTCHLAFFPNGMAVTEGAVLFLLKALVLLSVSPLSSSLSSFTS

SEQ ID NO: 184157 - protein, 118 aa, Triticum aestivum
  Clone ID: PAT_TA_78575.pep
YNRRCQQQQKQDQGSKRNHHQQQQLQYYYDYYRYHQQQQHHYFHSSEAAYAATEHHQPFLLRGFHGSSPSSTEMTVSSGFMGVGPPLPPSTSNLGWSDVTCLQDSGSTWDELGRIMEI

SEQ ID NO: 184158 - protein, 70 aa, Triticum aestivum
  Clone ID: PAT_TA_78576.pep
TQFYDLPLVNAFSLTYMCFLNNHLVLDVFICNRSHLRTESVLLAWISDYGFMVVIGREARLYPSWIWNLL

SEQ ID NO: 184159 - protein, 56 aa, Triticum aestivum
  Clone ID: PAT_TA_78577.pep
FFLFFHPLHHRETPLQIGMAKFLIESAMESTLNVSMFLAQRMFGLGCLLGNNPISR

SEQ ID NO: 184160 - protein, 195 aa, Triticum aestivum
  Clone ID: PAT_TA_78578.pep
RFIEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPAMRITIPEIRNHSWFLKNLPADLMDDDSMSNQYEEPDQPMQTM

SEQ ID NO: 184161 - protein, 91 aa, Triticum aestivum
  Clone ID: PAT_TA_78579.pep
HALKLQIHEQMMIDTLLRPLRSSGNFLTMCQFMSVHSPLCSAHSFYNPLSYEHISILSEVKLCLHCVWLKILYLGFVHVASRIDTFNCYTN

SEQ ID NO: 184162 - protein, 182 aa, Triticum aestivum
  Clone ID: PAT_TA_78580.pep
MAKRHLLLVTTCLWALSCALLLHASSDGFLRVNLNKKRLDKEDLTAAKLAQQGNRLLKTGSSDSDPVPLVDYLNTQYYGVIGLGSPPQNFTVIFDTGSSNLWVPSAKCYFSIACYLHSRYNSKKSSSYKADGETCKITYGSGAISGFFSKDNVLVGDLVVKNQKFIEATRETSVTFIIGKFD

SEQ ID NO: 184163 - protein, 96 aa, Triticum aestivum
  Clone ID: PAT_TA_78581.pep
YNQAVGVVGPGQASAAVAKHGVNVTQDAVPGGRIVTEFVAGLVVGQYAVAEAAPPSPQQQEQDGAGHKAAGNEGGAGHGDGGAPGGRAGATAARRD

SEQ ID NO: 184164 - protein, 181 aa, Triticum aestivum
  Clone ID: PAT_TA_78582.pep
PAPTAPPPPPAQNQPPTHFPGHVSHPQVPSMPPALPAPSVTTIPQESYYPPSAQPTEATHQQYQAPPAPQQPQAPQPAPPQHYQTLPQYAQYSQPFPSASVNPTAALPPPVPQQPEEPAPYGPPSQGYPPNVRAPPPYMPPPSGPAAPFYGPNPGMFDVSAARPNSGPPPPYNAGYKPPAA

SEQ ID NO: 184165 - protein, 135 aa, Triticum aestivum
  Clone ID: PAT_TA_78583.pep
TNSSCFIKHQNIMFLTMYFFILQVLEDQIDHVNRLLEAERSNTRELNEQLGKAANEKNKLMTELETNNDGLTKIQGCIHKSLSARISRLKGVAAMTNLGHYQHLLARMDALGQVKEHLPKILETIEVATSLSAYS

SEQ ID NO: 184166 - protein, 126 aa, Triticum aestivum
  unsure (1)..(126): unsure at all Xaa locations
  Clone ID: PAT_TA_78584.pep
MSSMLSAFSQWFVNPRRNPLARLHMQAISSRLRKYGLRYDDLYDPKHDLDIKEALERLPREVVDARHQRLKRAMDLSMKHQYLSENDQAQQTPFRGYLSDMMDLVKKERLXREELGALPLHQRTLP

SEQ ID NO: 184167 - protein, 99 aa, Triticum aestivum
  Clone ID: PAT_TA_78585.pep
LYYIILLKRELLCVAYRCRLKLFVLGVLGSWNSVLSFDYKTLVLSLHPYSKTYRCSRSMLYASMFNWSHVNLDTHSCLVPWCLVTMFQNLRFFGTMFFF

SEQ ID NO: 184168 - protein, 63 aa, Triticum aestivum
  Clone ID: PAT_TA_78586.pep
VGSRVCNEISVVFCYLSKIAMGDHDEFRTSEILLLSDDPTNLKISNWAPRDQGCCDSGNAFNV

SEQ ID NO: 184169 - protein, 98 aa, Triticum aestivum
  unsure (1)..(98): unsure at all Xaa locations
  Clone ID: PAT_TA_78587.pep
SPPPRCPQSRRRPPRPRRRRAPXSPRPRARRDPPPRRRSWSTRRASPSGCAAPCACSCSPARHTDAAGAAAPTPRRVGVGVGLADGGAGARDARAEAS

SEQ ID NO: 184170 - protein, 141 aa, Triticum aestivum
  Clone ID: PAT_TA_78588.pep
FERRLSIVKDGVKPRADKPKRRPTTSTHTGRSSVPDKSQRSRSMSFSPDRVRVRGRSPAFNALAANFENPNARNLSTPPPVVRKQVPKPVSPDSSKPTPRTASIAAISSTFERPKATLIPKSIKSSPDASKPQIEASKPKL

SEQ ID NO: 184171 - protein, 105 aa, Triticum aestivum
  Clone ID: PAT_TA_78589.pep
AGIENLLRLENRAEPWLVVLYAPWCPFCQAMEASYVELAEKLAGSGVKVAKFRADGEQKPFAQAELQLQSFPTVLLFPSRTPRPIKYPSEKRDVDSLLAFVNSLR

SEQ ID NO: 184172 - protein, 181 aa, Triticum aestivum
  Clone ID: PAT_TA_78590.pep
FQPSDDFPEFKLPDVPAPLAENLNGKHEPKSPKAAPRSPKAATHPTFATSVKKPIGAKKVGAKTGGLGVRKLTTKPNESLYEQKPEEPKPAVPALAASTTAKGGPSLHSRFEYVENVPSADLRTGGSGSRVTGHVAPPKSSDFFQEYGMGNGFQKKSSNASKTQIEETDEARKKFSNAKAI

SEQ ID NO: 184173 - protein, 82 aa, Triticum aestivum
  Clone ID: PAT_TA_78591.pep
RRKEVVREREISRQPQVLASNCGSTFEATKSVRLRRVIARVQIPTHQHAPAFLACLVPWLPSPHHSGARHHHPTFSPIAVDL

SEQ ID NO: 184174 - protein, 88 aa, Triticum aestivum
  Clone ID: PAT_TA_78592.pep
ALAVSLATSVRLQTKVFFSLCHGKGAGGGEDHDRGGAAAAGVGDAAEEAGGEEPRHYRRGRQGADAPGALRRRRPPPRRQEAGRSDQL

SEQ ID NO: 184175 - protein, 129 aa, Triticum aestivum
  Clone ID: PAT_TA_78593.pep
MAAADVAYAPPMKSGKAGFEAGLMDPQHRIRITLSSRSVKNLEKVCGDLVKGAKGKDLKIKGPVRMPTKVLHITTRKSPCGEGTNTWDRFEMRIHKRVIDLISTPDVVKQITSITIEPGVEVEVTISDA

SEQ ID NO: 184176 - protein, 50 aa, Triticum aestivum
  Clone ID: PAT_TA_78594.pep
YEKLNRGFLHHGCLYGTSLGALISLLCLFSYLFFCCCSTICARLQDEENQ

SEQ ID NO: 184177 - protein, 70 aa, Triticum aestivum
  Clone ID: PAT_TA_78595.pep
SIKALSPYACTERLFRSCHRIRCCKYVLYYLHVIARVAYVFSLTALTLTMMNQTSRESFQANLMAHVHEL

SEQ ID NO: 184178 - protein, 61 aa, Triticum aestivum
  Clone ID: PAT_TA_78596.pep
LLLRVYREFLSPKPPKLPEPELPKPPPNRPEPDSPNPPERPKPDPPPLERPNPESPNPPLP

SEQ ID NO: 184179 - protein, 129 aa, Triticum aestivum
  Clone ID: PAT_TA_78597.pep
RHRGLPLLPRRQQGPGHSHRHEARPGAPRRVRRVQRRLQQVQHFRAFPSRSTCTIIHRWGIVEWRGGRITTQSRGSQFSNDGDRSGGCRGGSPARLLLPLLRISVACLACYAAVQAVAERLCIMTINLP

SEQ ID NO: 184180 - protein, 70 aa, Triticum aestivum
  Clone ID: PAT_TA_78598.pep
IFVGVCICACFKLQGFFFVENGVVVNKPNKNVHIVLKQNLVFNHKVHMDLFDLLLYMDQTWRLVLELMSP

SEQ ID NO: 184181 - protein, 153 aa, Triticum aestivum
  unsure (1)..(153): unsure at all Xaa locations
  Clone ID: PAT_TA_78599.pep
VDLNLSISQPASQSPKRDKSCLGLQXTMDHLRAPNRKKTKIDTPSELSGHPHRFPLMTEHPPAWPAQSHPFFTNHESTSSRDLNRRPEGGAPSWAWKVTAAPPHTLPLPLFSSSSSSAAASSGFSNTATTAAPSASLRFDAPPSSSSSHHHRR

SEQ ID NO: 184182 - protein, 157 aa, Triticum aestivum
  unsure (1)..(157): unsure at all Xaa locations
  Clone ID: PAT_TA_78600.pep
YNFGFDHYEMSRRKVGFSGLINLLVGHTGPFASGDWILPDLTIQGSMKLNSRLRTFPNTFYFSYATKKTRKLFGITVPSRVLGVHPMLFLRVLQMCMWRDPQSAPLPYKGYRDEDWEDNDGAFNTISMTHPRIPIEHPHRAXKNDSDCHPLQPGICY

SEQ ID NO: 184183 - protein, 130 aa, Triticum aestivum
  Clone ID: PAT_TA_78601.pep
LGWAAMEELKWGDDNHKWIRPGHLFTCGPGSYKIPSVNDIPLNFKVSLLKGVPNPKAIHSSKAVGEPPFFLGSAVLFAIKDAIFAARAEEGHLEWFPLDNPATPERIRMACVDSITKKFAGIDYRPKLSV

SEQ ID NO: 184184 - protein, 106 aa, Triticum aestivum
  Clone ID: PAT_TA_78602.pep
WAGRRKMNSVWTLLVWMPVPPCSLTMSAMSSRLCPVFFACAHAPVHPGPSPSPLYLGSSLQSHFPSPKSSSYGHGGALCDAWWMAKCQITLRPSGKENGSFLNYNF

SEQ ID NO: 184185 - protein, 93 aa, Triticum aestivum
  Clone ID: PAT_TA_78603.pep
APASTVATLKETIIAQWPKDKEKGPRTVNDLKLINAGKILENNKTLSECKSPICDFSGMTTMHVVVRAPTSSKQSDKRAAKKAKDFRCGCAIM

SEQ ID NO: 184186 - protein, 61 aa, Triticum aestivum
  Clone ID: PAT_TA_78604.pep
MVRVATYFAMTFGAFLFWQSMDRVHVWIALHQDEKKERMERELEIKRMQAELMAQAKENES

SEQ ID NO: 184187 - protein, 93 aa, Triticum aestivum
  Clone ID: PAT_TA_78605.pep
HGGISMLAKPTAYIGKTIKVDGFDGKLDGCNIKEAILRSTGLCINSSSWTGIPDHCRFSFALESSEFERAMGCIVRFKELVLGSKAFHQINGN

SEQ ID NO: 184188 - protein, 93 aa, Triticum aestivum
  Clone ID: PAT_TA_78606.pep
EDEACQKLASCPKRLQEHGSAYAVGIQVTKLPRARGDISSDHLHLACPRCSGVAATVPRVLDSQRRRLPALDRSLQDMVQACWPGSSRCRKLR

SEQ ID NO: 184189 - protein, 170 aa, Triticum aestivum
  Clone ID: PAT_TA_78607.pep
LCWENKMPLARTAMYAKGIQIYCAPTADASPTWVASMTHIALEGGCFVVSANQFCRRKDYPPPPEYTFGGLDEEPSPETVVCPGGSVIVSPSGTVLAGPNFEGEGLVTADLDLGEIVRAKFDFDVVGHYSRREVLSLVVKTDPKSAVSFTASADGERAPAGKKGDDSVYK

SEQ ID NO: 184190 - protein, 107 aa, Triticum aestivum
  unsure (1)..(107): unsure at all Xaa locations
  Clone ID: PAT_TA_78608.pep
KPKKKAASTGQAETHAPVGGPISYQQHLSSXACQGHHHLVEPILQGMVLTNQQHIHLNSRVHPPMSSLPLSSHHMMTHFRSYHLTCXQGLQMMPWIWNWXVASSNFS

SEQ ID NO: 184191 - protein, 134 aa, Triticum aestivum
  Clone ID: PAT_TA_78609.pep
PSMRQANPHTPQNSSLQVKQQAMLHKQSKPLSSDSGPGRPLRAAPQQKPFVEMKSRLAREQVAVERKPAASHVDKSRLPAQPSAGVKLESAKPKIYDGLESNTRLEAPKRRLQERYQEAENAKRQRTIQGMELG

SEQ ID NO: 184192 - protein, 68 aa, Triticum aestivum
  Clone ID: PAT_TA_78610.pep
PSYAHAQEQPSYGHAQLPSSYGLAQASFPFAPAQGVSPYGSGAQPPQYGAGQAATNPGSAYQAPHGRK

SEQ ID NO: 184193 - protein, 119 aa, Triticum aestivum
  Clone ID: PAT_TA_78611.pep
PKHPSATAAPGFDGTVPAQYKEGNQFVSLQQSENAAMWMHGASSRTMPPLAANALYGYQGQQGHQGGLRQGQLPSQFGAPLAPTQPGLGHEHRNPSDGNLSSAAAAAAAQANQMWPNSY

SEQ ID NO: 184194 - protein, 87 aa, Triticum aestivum
  Clone ID: PAT_TA_78612.pep
FCFRYINDFIFKMKAYSHVDRIRFKYFLNPKRIQHVICEGADLFDMLPEEYTFQEIIAKLGPIPRTFSAVHLPAYLLEHNDRYTYLL

SEQ ID NO: 184195 - protein, 199 aa, Triticum aestivum
  Clone ID: PAT_TA_78613.pep
KQEKDHKDQRPQGLFHQINLYLHCCSEFPLSIILVGVGDGPWDMMKEFDDNIPARSFDNFQFVNFTSIMSKKTSQSKKETEFALSALMEIPLQYKATLELGILGRRFAKSPERVPLPPPFASYNTISRAAPSRANSFRSMPSHPRDEAPVDSAITASVTSPPSVDARAAEPQLCPVCLSKPRDMAFGCGHQTCAECGPQ

SEQ ID NO: 184196 - protein, 51 aa, Triticum aestivum
  Clone ID: PAT_TA_78614.pep
NPTHLFIVLGPQPPPPPLLLHYSSSTSFPPIPVGKLYKKKEIKNQTRSRTA

SEQ ID NO: 184197 - protein, 207 aa, Triticum aestivum
  Clone ID: PAT_TA_78615.pep
MAADHLVVAMLLLLALSPPAVADDTAVLGRKGGVVEGQAAGPGRYAVILDAGSTGTRVHVFRFDNKLDLLKVGDNIELFAKVDPGLSSYAGRPQDAANSILPLLDKANTVVPARLMNKTPLKLGATAGLRLIGDEKANQILEAVRDVVHTKSKYQYNPNWINVLEGSQEGSYTWVALNYLLDKLGGDYSKTVGVVDLGGGSVQMAYA

SEQ ID NO: 184198 - protein, 157 aa, Triticum aestivum
  Clone ID: PAT_TA_78616.pep
ALRRGGRIPRKATKSKEGEPQPAVAAQEEPVLAPAAPASALTEAEVGELPKAIVRRLVKDKLSHVAGGEGAEVIVNKDAMAAFAESARIFIHYLSATANDMCKESKRQTISADDVLNALDEMEFSEFVEPLRTSLQEFRNKNADKRSEANKKKKKKK

SEQ ID NO: 184199 - protein, 79 aa, Triticum aestivum
  unsure (1)..(79): unsure at all Xaa locations
  Clone ID: PAT_TA_78617.pep
TSDPQVPEYCEMLKSEDWPVCACINYDCNPMNASEEAHNLETSQLVWEKTLEMIGLPPDALKKLIAGXTDQCRYGQQEA

SEQ ID NO: 184200 - protein, 180 aa, Triticum aestivum
  Clone ID: PAT_TA_78618.pep
GDDFEKKADQKLSGWGLFGNKYEEAADLLDRAGNFFKLAKNWSRAASVYKKIADCHLQGDSKHEAASAYVEAANCYKKFSPQDAAQALNNAVNLFLEIGRLNMAARYSKDIGDIYQQEQDLENAAVYLNRAADLFDSEGQSSQANSMTQKIAEIYAQLEKYQKATELFEEIARKSINNNL

SEQ ID NO: 184201 - protein, 157 aa, Triticum aestivum
  Clone ID: PAT_TA_78619.pep
LLLLTTGIGAACSLYCLLVFSLETAVSYAFGVGFSCLYLQLLCRHADNLSKEDIPEVFLRKKVKKIGITSEDLKNTIEKTLGGAGVALSSPRLVIPAVIFGLSALSDHFQNSFSFEVLPGMMGFLAYKAAALVQVYRDNEDLRLILPEEEGADSDST

SEQ ID NO: 184202 - protein, 175 aa, Triticum aestivum
  Clone ID: PAT_TA_78620.pep
MMLQCLLPGYPPPLVSRFNIYILFSFALCRLHYLLVKFAPGVLCQVFHHILCLVCAVYAMLSGEGQLYAYMFLISETTTPGINLRWFLDVAGKKNSKAYIVNGVAMFITWLMVRIVLFIYLVYHILTNYDQVKQMDTFACVLISVAPTILFTMNVIWFSKIVKGLKKTLAKRHAE

SEQ ID NO: 184203 - protein, 57 aa, Triticum aestivum
  Clone ID: PAT_TA_78621.pep
CIFLLYYITTMGSFLVPFGFLHLRQALIYFEFCMLAFISYLHPRHPEGFFSAVRCGQ

SEQ ID NO: 184204 - protein, 141 aa, Triticum aestivum
  Clone ID: PAT_TA_78622.pep
LGSRRTYFHVNGCKSAKLYGNASSVDERHRHRYEVNPDMVPDFERAGLQFVGKDESGKRMGIIELPSHKFFIGAQFHPEFKSRPGKPSPLFLGLIAAASGQLEPLLQRSNLTTKACPISKIPKLKLYPTGPVNPLNSLFVL

SEQ ID NO: 184205 - protein, 108 aa, Triticum aestivum
  Clone ID: PAT_TA_78623.pep
ESYNEEQEMLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 184206 - protein, 215 aa, Triticum aestivum
  Clone ID: PAT_TA_78624.pep
MQNSSFDYSVPSTPMQKSLFDSIPGTPVQRSVFDSVPSTPMQRSVFDSVPSTPTQKPFFDSFPSTPMQRSLFDSGPSRAESPTASSMYGKEQKGFFDSSVPSTPMYNSSYTPRYSEAGDDSFDTMSQYSSFGMHENNSFGQRDSFSRFDSFTSNADNGGNDTFARFDSFRSTSDQGGGNSFMRYDSMNSSSDHDRGDPFARFDSMKSSDYNSRGY

SEQ ID NO: 184207 - protein, 77 aa, Triticum aestivum
  Clone ID: PAT_TA_78625.pep
SSPEVRQQFAQVGMTPEEVVSKIMANPDVAVAFQNPKIQTAIMDCSQNPLNIVKYQNDKEVMDVFMKISQIFPQING

SEQ ID NO: 184208 - protein, 181 aa, Triticum aestivum
  Clone ID: PAT_TA_78626.pep
FLSLCFCFMTICVCSNLLFLYISISISISISISISISISISISISISISISISIDIFLSGLFPKPASTRSHLIPNPSRTGGGRRRAIRQSSFAASRRVGARAPSSRGLAPGRRSWHTPWLRRAEYKPALLAPVTWQTEISAHGTRRRVAREDLDGGDSNNVGQQWRRRGLPTSDGGEDAGS

SEQ ID NO: 184209 - protein, 105 aa, Triticum aestivum
  Clone ID: PAT_TA_78627.pep
KKGTQPRDNQSIQNSYFDIPLLCLEHLREGLFICIVYNCAHSEGALVYELRENLTANVVPVKKNIQYQASGITRSGGLSQCGLIRYTISWVSLRLFLSCVRFSFP

SEQ ID NO: 184210 - protein, 140 aa, Triticum aestivum
  Clone ID: PAT_TA_78628.pep
QIYQTSRTNCVLVLHIHLKHLLVLSRNCKLHSSMAEHARMHRSPATIWTRGKRRCREEWMRRRREGEKGKPIALPREPRMRRRRRERVAAVGSYGCAAAAANGMPPSVATDVPPPPRTGCCRRQLWMCRRHRERDTTAAT

SEQ ID NO: 184211 - protein, 184 aa, Triticum aestivum
  Clone ID: PAT_TA_78629.pep
EAEEVVVEDEEDDDEDDDDDDKDDDELDGQEEDASGKSKQSRSEKKSRKAMLKLGMKSITGVSRVTVKKSKNILFVISKPDVFKSPNSDTYVIFGEAKIEDLSSQLQSQAAEQFKAPDLSQMISSPETSGPGQEDNEEEVDETGVEAKDIELVMTQATVSRSKAVKALKASNGDIVTAIMDLTN

SEQ ID NO: 184212 - protein, 228 aa, Triticum aestivum
  Clone ID: PAT_TA_78630.pep
MRSNGDQATVPLEEDELGTSEAGTCGVVGYVWTSVDTGIVEEWRQSIAPIPKEKLEELRHAASDDDGSEDESNNRTLPDKDDSSDSVVDDDDHISKFEKEVEETFQRALGGGVNRDNLILEINGLRLAYSLQHADCAGAVFYSVMKSALVAAQSTNDTLLKTTADALGKWKDLLRNYTKTVDEEMEILLKFEEMCQETTKEFSPLFPTILPYLYDREVVSEDAILRWA

SEQ ID NO: 184213 - protein, 95 aa, Triticum aestivum
  Clone ID: PAT_TA_78631.pep
LRRPFDGRCRFKTLMNKCHTEDTDCARNGNYREDWTCICKTISLVNAEQEQFFSLVLNKQLALPSLHQNSDLQQEATSPTATQSKTEKKMRKQAI

SEQ ID NO: 184214 - protein, 133 aa, Triticum aestivum
  Clone ID: PAT_TA_78632.pep
TRERDRRSSKKDHSSSRSHRHHHHRSSGDDSGSESEERGRSRHKKHHRSSDEDATSDSNNHKHRRSRSLEESSDDAAAGEYEKVRNGKRPHKTGHHRHHHRHHHHHHDHRSSSEPNDKKRQDGQKALEGGNVD

SEQ ID NO: 184215 - protein, 230 aa, Triticum aestivum
  Clone ID: PAT_TA_78633.pep
RKLGISCVPLIFKVEPRPAPGRVSVLNDGSIVLEVGGIEIGQGLWTKVQQMTAFALGKLWPDGGESLLERVRVLQADTLNLIQGGLTAGSTSSESSCAATLQACNMLFDRLKPVLDRLQQQSENVSWDTLISQASKDNVNLSASAYWVPGQVSNKYLNYGAGISEVEIDLLTGAITLIRGDLVYDCGKSLNPAVDLGQIEGSFIQGIGFFVYEEYITNSDGLMISNSTWD

SEQ ID NO: 184216 - protein, 91 aa, Triticum aestivum
  Clone ID: PAT_TA_78634.pep
TRYPIYFSHTSNFIDVNLTLHRLFSPGTLDAIIKMVRYEGLHGFYKGMGTKIIQSVFAASVLFMVKEELVKLAVLLVARSRTMLITTSKKQ

SEQ ID NO: 184217 - protein, 92 aa, Triticum aestivum
  Clone ID: PAT_TA_78635.pep
HAGTKHWDDWDIVGFPGAELLSTSEKNLCCQNRLLPNHYLKMQEVLMQEIFKGSVAKKEDAHVLFKVDPAKVDNVYDMVTKKLGTNEEAPTV

SEQ ID NO: 184218 - protein, 64 aa, Triticum aestivum
  Clone ID: PAT_TA_78636.pep
EKIELLVDKTENLRSQAQDFRQQGTKVRRKMWLQNMKIKLIVLGIIIALILIIILSVCHGFKCK

SEQ ID NO: 184219 - protein, 203 aa, Triticum aestivum
  Clone ID: PAT_TA_78637.pep
MASGRIALLCLLGLLLVAASPAAIAAKDDKIFYQITFMWPGAYCAQTKAGCCMPKTDVAPASDFYVAGFTVYNATTNSSLSSCSNTPFDMNQIGDATRLMQYWNNIRCPSKSGQKGWKNAWETSGVCSDLTESAYFDTALALRDKINPLSRLVSNGIKPDFGLYSVKKIKEVIEEGIGAPALIQCSKGPFNKFQLYQIYVCVA

SEQ ID NO: 184220 - protein, 158 aa, Triticum aestivum
  Clone ID: PAT_TA_78638.pep
ARGPALQQSTPLIYPPATQTTHQAALTSNNNYDNNVMNNSNLPIAAVDAVIAGSDNSGVKKRNKRVMAVDGAAAESCFDDGSSDSFSSKKLKLPSDSRIAGHFGTTASSYYYCNNQLQLVDSAMSSGFHQYSSLLLSSSNPFLNQQQQLLLNSHIGMQ

SEQ ID NO: 184221 - protein, 106 aa, Triticum aestivum
  Clone ID: PAT_TA_78639.pep
SGSDLKNLCTTAAYRPVRELIQRERKKELEKMKREKGKTPSDLPEKKEKEETIILRPLNMTDLKEAKNQVAASFAAEGAIMSELRQWNELYGEGGSRKKQQLTYFL

SEQ ID NO: 184222 - protein, 102 aa, Triticum aestivum
  Clone ID: PAT_TA_78640.pep
IALVDSMVAASWGCTYKMAASRPRSFLLGEAVRGKKIYRSQPRVVEPYPTWLVICYAAAKGQASTTMPNSCTSCVPHQHNLNEAATSLGCDVAAIFFPGDMI

SEQ ID NO: 184223 - protein, 70 aa, Triticum aestivum
  Clone ID: PAT_TA_78641.pep
VARKICIEKYISKQEHMPRQQEGFRFSSSTISQMVALELPIGWCFIWMSSGLQVFKLYYLQMVALELPIS

SEQ ID NO: 184224 - protein, 54 aa, Triticum aestivum
  Clone ID: PAT_TA_78642.pep
ETKRLCAMCPSLARNLNCTQDDCPPYHVKTNVIFTMSDEAFNRFATIVNIIFLY

SEQ ID NO: 184225 - protein, 66 aa, Triticum aestivum
  Clone ID: PAT_TA_78643.pep
MASGGKGLNATGEFFRRRDEWRRHPMVGNQLRHATPGLGIAIVAFGIYLVGEAAYNRLSRPSGDHH

SEQ ID NO: 184226 - protein, 72 aa, Triticum aestivum
  Clone ID: PAT_TA_78644.pep
IATVVVRYILNQTSVAGSMVGVRLGLSEHIKDTNAIFSLELDEEDMNSITEVSKKGRNLMDIIGDCGDEYRA

SEQ ID NO: 184227 - protein, 72 aa, Triticum aestivum
  Clone ID: PAT_TA_78645.pep
LWPAGGSDSDEPLQTVVVVFDAGEPLPFLLPLPMIFVLFCSVVRIFFHAQFMGVKLASPLYRSDVRMMRCKA

SEQ ID NO: 184228 - protein, 90 aa, Triticum aestivum
  Clone ID: PAT_TA_78646.pep
FFFFFFFFFFSGRNMIQYSQKGFILICCPATALNRTLQGTPGGIKHNQLQAIASDGGGAVLPPSVTTCRPRLPQLELLHELGVHVLGGLP

SEQ ID NO: 184229 - protein, 80 aa, Triticum aestivum
  Clone ID: PAT_TA_78647.pep
GEIQELWSQLGVKIIPVLSRPDDSWNGERGHVQDAFFKNKNIVNPSSTGAVLCGQNEMQEEITSALVADGVSRDKILTNY

SEQ ID NO: 184230 - protein, 135 aa, Triticum aestivum
  Clone ID: PAT_TA_78648.pep
KEYLPPCTYCYPHVLQFSYITMTDLIHRCVTLPYHAHAYTSFLLIADRNSTLQTKKRKNEKENDFFNTRIECTTTRARARASNLVPHPPAADLLAVLLVVVRVLVVVVVAVVGEEDAGVVGVVAAALVAASAASC

SEQ ID NO: 184231 - protein, 208 aa, Triticum aestivum
  Clone ID: PAT_TA_78649.pep
GCFGCGTEFNLGVTKELVRYESPIEHSPSVDAVKQVLNGTANSFSIIDAYPRYFRVTGSGEVRRLEAAIDSVSGELLLNNGTPSWWSFYDTNPSDLAGCQGLNGPMAIVVSEETPQGIIGETLSKFSIWSLYITFVLAVARFIRLQCSDLRMRIPYENLPSCDRLLDICEGIYAARAEGELEVEEVLYWTLVNIYRSPHMLLEYTKPG

SEQ ID NO: 184232 - protein, 68 aa, Triticum aestivum
  Clone ID: PAT_TA_78650.pep
RRRCPGENLSMRTMGLVLGALLQCFDWTRIGDAEVDMATATGTIMSKAVPLEALCKPRANMSAVLQKI

SEQ ID NO: 184233 - protein, 126 aa, Triticum aestivum
  Clone ID: PAT_TA_78651.pep
LSSINFYWRFFSAVCTSSTSCLSLVQQSPVLENSMSPTRDIGISDSSNGAKEGPYFESHTVVSAKRLKTVNGHALAYLKCGPSSQVPVAVSAVMVEHPQGQRGRCRRLQLPDQCALARLQELVEQQ

SEQ ID NO: 184234 - protein, 163 aa, Triticum aestivum
  Clone ID: PAT_TA_78652.pep
MLRAATVQARLLLLSRSYVGQAKAASSWPLVRRKPSRLGSVRPFYQMDTRGQDENKILTARGCHSSPESQELAMKSCVPCNSKDLHPMSEDSAKKLLEQVNGWELITEGGVLKLHRAWKVKNFVKGLEFFQLVAAIAEEEGHHPDLHLVGWNNVKIDVWTHSV

SEQ ID NO: 184235 - protein, 66 aa, Triticum aestivum
  Clone ID: PAT_TA_78653.pep
FFFFFFFFFFLEQKVDCRKIFFFPKPIPWHLKIYFLSGPTFHEHKKCITRRALILAEAAPRLHTGL

SEQ ID NO: 184236 - protein, 217 aa, Triticum aestivum
  Clone ID: PAT_TA_78654.pep
HGLSNGDTSTGKDVSLKNLPHPRSEVDDGAENHASQMLPSFEFSTVSPPSIITEGSSGGPWRKRITDLDGTESDIPWWIVDCVEHNRFPKENTKCGFYLHPAEGSPAPNITQGKLSAPRILRIHKVANYVVEKLDRPLDGNADSTFGMGLTSGQSQFSALDSSSRLGLKPWQKLKPSVEILCNSQVLAPEMSLATVRAYVWKKPEDLILNYKVVQSR

SEQ ID NO: 184237 - protein, 101 aa, Triticum aestivum
  Clone ID: PAT_TA_78655.pep
ITTAESAELGTHSSLNGNSRALATVTAIIDGTGSVGAAIGPLLTGYISSKSWSAVITMLMAAALLAGLLLTKLVCAELKGKTPSNASKDVADAQGTYSDEV

SEQ ID NO: 184238 - protein, 57 aa, Triticum aestivum
  Clone ID: PAT_TA_78656.pep
GFAFASQLPSRHLELSSSGFWNSSVGTLVIDADDANRVVILLVLRTYVSPSPKNFFC

SEQ ID NO: 184239 - protein, 236 aa, Triticum aestivum
  Clone ID: PAT_TA_78657.pep
RVLHSLIDELVERGIEIHVTLYHLDFPQILEDEYHGWLSPRVIDDFTAYADVCFREFGDRVRHWTTMDEPNVLSIAAYDSGAFPPCRCSPPFGANCTAGNSTVEPYVVAHNSILAHASVTRLYRDKYQATQKGFVGMNIYSFWNYPFSSSSADIAATQRALDFMVGWILDPLVYGDYPEIMKKKAGSRIPSFTEEQSELIRGSADFIGINHYTSVYISDASNGETVGPRDYSADMA

SEQ ID NO: 184240 - protein, 74 aa, Triticum aestivum
  Clone ID: PAT_TA_78658.pep
LFGGKKRYGTRRPHHIHAAGKILRYSLQQLEKLGVVSRDKKCAEKKFARVITANGQKELDVIANNLGKEIYKRK

SEQ ID NO: 184241 - protein, 46 aa, Triticum aestivum
  Clone ID: PAT_TA_78659.pep
LGKMSKDEADVSGDLSGLTDKELGVLADWETKFQAKYPVVARLADA

SEQ ID NO: 184242 - protein, 81 aa, Triticum aestivum
  Clone ID: PAT_TA_78660.pep
LANATEPTILDKLCAALNINKRSVDRDLDVYRNILSKLVQAKELLKEYVEREKKKREERSETPKSNEAVTKFDGSLNSMRH

SEQ ID NO: 184243 - protein, 238 aa, Triticum aestivum
  unsure (1)..(238): unsure at all Xaa locations
  Clone ID: PAT_TA_78661.pep
AAQNSRERARAPPLLQSSSSFQMLRVSPSPAAANQLAGAAVAPAPAPVPVRVAAPRGGVSPSAAAACRAAGKGKEVLSGVVFQPFEEIKGELALVPQTPDKSLARHKFVDECEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPHLTDXIESEFL

SEQ ID NO: 184244 - protein, 125 aa, Triticum aestivum
  Clone ID: PAT_TA_78662.pep
RVKISLNEKGGLSATVSYTSIFSGNKEKWSFSAYPIQGSRSQFNIAFPPNALQRKTIGIILDTDYVNFYVLEMLQTTEDGKTLQYAWIVTKTPTVDDQILMRANRALAFAGINPASLERIPQYGC

SEQ ID NO: 184245 - protein, 106 aa, Triticum aestivum
  Clone ID: PAT_TA_78663.pep
MIEVLKALQELNVSWKKNGHYNMKCRWLPGFPEVHDMLDASNSFLGDSTIMDNDDANGRLPAVIKFEFQLYKTKEDKYLLDMQRVTGPQLLFLDFCAAFLTKLRVL

SEQ ID NO: 184246 - protein, 130 aa, Triticum aestivum
  Clone ID: PAT_TA_78664.pep
PNQFHMDDTNTIRSSPCHHRLRCYLAKKSFLHLCNVPFRPLVDVFYRNYIPRPAGVLNLLPACDFMMTSSRILPGCRSWVIQFWLGEDVVDEINLVNFLNPHLTISRRSHGGLGASKHYQLVFGWMLERD

SEQ ID NO: 184247 - protein, 97 aa, Triticum aestivum
  Clone ID: PAT_TA_78665.pep
FFFFFFFFSFEPTCHVLQVATALNTRKKEGTNPIRDCRIESLFLYTPLTILFVYHPPVRAPQHGVPLTPTSGGCLGHPARWAASLLQWQKITRCPRA

SEQ ID NO: 184248 - protein, 177 aa, Triticum aestivum
  unsure (1)..(177): unsure at all Xaa locations
  Clone ID: PAT_TA_78666.pep
PERVAAVVFLTAAMPPVGRPMSATTEEFLLIVRSTXNYVGAEFFLDSMELEQQNADIPGNPVIFGPNFMAQILYHLSPQEDLTLGLSLIRPTNKFTGDALMRDPGLLTKERYGSTRRVFVVVEDDRGIPVEFQRRMIAENPGVEVVDFAGADHMAMISSPAKLAELLVRIADKAHEP

SEQ ID NO: 184249 - protein, 221 aa, Triticum aestivum
  Clone ID: PAT_TA_78667.pep
MANSPTLTMLVFLAIGLSLVLSAAGVSVESVVTEAFFNGIKNQAPNGCAGKSFYTRQSFLNAARSYSGFANDRTNDDSKREIAAFFAHVTHETGHMCYINEINGANMDYCDKSNKQWPCQPGKKYYGRGPLQISWNFNYGPAGKNIGFDGLRDPDKVAQDPTISFKTALWFWMNNVHQVMSQGFGATIRAINGALECNGKNPGAVNARVNYYKDYCRQFGV

SEQ ID NO: 184250 - protein, 143 aa, Triticum aestivum
  Clone ID: PAT_TA_78668.pep
SLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGTGIAGSAGGCWVSDAFEEPYRTAVGMLLKRRTYSLEMNSF

SEQ ID NO: 184251 - protein, 127 aa, Triticum aestivum; identical to SEQ ID NO: 124219
  Clone ID: PAT_TA_78669.pep

SEQ ID NO: 184252 - protein, 72 aa, Triticum aestivum
  Clone ID: PAT_TA_78670.pep
LVSSFFFFFFYANNASLYLLGLTLSTIYYTHHSIVSSYTTQTFACQVLQEHYYYFCSMIQCAATVSCLQALF

SEQ ID NO: 184253 - protein, 38 aa, Triticum aestivum
  Clone ID: PAT_TA_78671.pep
ARGGGLLIGDMMSDASAYDAGYDAGFDDGGGFDGGFDF

SEQ ID NO: 184254 - protein, 97 aa, Triticum aestivum
  Clone ID: PAT_TA_78672.pep
EAATFKLERFEAGTIDFKGTDFEYTPFGAGRRMCPGMAFAQASMELVLAALLYHFDWKLPDGMLPSELDMTEEMSITARRKHDLYLQPVVSVPPHAV

SEQ ID NO: 184255 - protein, 42 aa, Triticum aestivum
  unsure (1)..(42): unsure at all Xaa locations
  Clone ID: PAT_TA_78673.pep
MVPDMXPFPANRYMATLTPPIEGYIEKVREAAKKHSVKEKLR

SEQ ID NO: 184256 - protein, 113 aa, Triticum aestivum
  Clone ID: PAT_TA_78674.pep
LVTPADKKVQKQTTQTHFFLLFMDGSRDQRATTRQQRSKTTGPPHALAAGQACMHAPPADRSNQLRQCVRQKQRRRKPRHLPSGKPSVLQTLAQFSRRTQGPRNLWLYDWPSC

SEQ ID NO: 184257 - protein, 78 aa, Triticum aestivum
  Clone ID: PAT_TA_78675.pep
QRVELIGICTGNVINDSHRKTNGSATAEQKRYVDTMQPHQKLKLIDYESHDTGLHDQLTINSNTNTKIHKMSIANDHI

SEQ ID NO: 184258 - protein, 78 aa, Triticum aestivum
  Clone ID: PAT_TA_78676.pep
FFFFFFFFFFFFFYLLFIPFCHFNRTIVTFMVTTAMSHKHIVVQICLQILFIQARSSKHKTDQAHHDLRKFNALSGAI

SEQ ID NO: 184259 - protein, 146 aa, Triticum aestivum
  Clone ID: PAT_TA_78677.pep
MADSTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITSQGRRDLDQVAGRVDVTIA

SEQ ID NO: 184260 - protein, 170 aa, Triticum aestivum
  Clone ID: PAT_TA_78678.pep
SGSSAPVVTPLAPISSSSSSKVGIQVTIKPEFRIDPPPQLPPQMVEIPRSTFNFDFEYERRILAEAEKENPNWTKFVVERQAPPPVAQQARPASSGDPVVDRYVSMGLGREAVSFAVLNYGDNPTKVKEFVKSYNILHEMGFTSPNVPELLAIHDNDPDKVIQRLLSSPS

SEQ ID NO: 184261 - protein, 135 aa, Triticum aestivum
  Clone ID: PAT_TA_78679.pep
YEFVCLLVCICKIFVSCLFFCLPGKGKIQCLLPYDCCPNFSTVNTTQQKVIHSFRRLVIDDAVFSALQPMTMSPSSSTTTSMHHQPKEFFDSWEDIFSRFAWLQADLMNHRTLRHRPRLHNTAGRRTSTARSRYR

SEQ ID NO: 184262 - protein, 212 aa, Triticum aestivum
  Clone ID: PAT_TA_78680.pep
MAGIRWPPEDPEIFPSRMVSGGAWIPVAPPGEMASDDDRSVAADSWSIKSDYGSTLDDDQRYADTAEVLLASSSASSAAAPSASVAVHPSSDFSFDKDVPDSSDVEPRLLGLQNFQDGAYAEDLANFHERSHADDWFGTEIMDIRVGWTKNLCSSRDLPSCSVLDIGTGSGRLLQQLAKQGFSDLTGIDYSEGAIELARNLAIRDGFEHINF

SEQ ID NO: 184263 - protein, 177 aa, Triticum aestivum
  Clone ID: PAT_TA_78681.pep
ASTSLPLPHVIRSHTSTTCNRKLRSLTPKAHCLNFTYSELIVLSIIGLKLNTSSMNTFNLSTPSGTLHRACRMALIKLVNHSLVDILDCTMPTCLPIASISVVVLGSSILTMVAAKHLGASPAERTMGRRRQPCSKAGYCERNAECSADCSRDAPPLQGARSRRGRGQDTESMGEMW

SEQ ID NO: 184264 - protein, 228 aa, Triticum aestivum
  Clone ID: PAT_TA_78682.pep
MATLSSCSRLSTGGGAVQRRPRWPASAATITCHRSSSSSSSARVVRTGAAAAPAAATAPAVPQTNECSLPTWAEFELGKAPVYWKTMNGLPPSAGEGLILFYNPAATKMTPNAQFGIAFNGGFNQPIMCGGEPRQMTLQERGSADPPIYTIRIRVPQHAMTLVFSFTNGVDWDGPYTLKFRVPKPWLNKPLSFFNEGLADELNREGACDRAIFPDENVVITSCEMGSY

SEQ ID NO: 184265 - protein, 113 aa, Triticum aestivum
  Clone ID: PAT_TA_78683.pep
VGGRTLEAVLSNMRNHGRIPTCGMISQYNLEEPEGVHNLFQIVAKRLRMEGFIVMDYYGQYHKFEQEMAGYLKEGKITYVEDIADGLEKAPAALIGLFTGRNVGKQLVAVARE

SEQ ID NO: 184266 - protein, 112 aa, Triticum aestivum
  Clone ID: PAT_TA_78684.pep
ANSYDWRIMIVVDLSKHHSIFSKAHLQLSILYLAFFQLSVMEMQFFSVIIILSHVFSTLTVLALLHWKDSVIWSSLMVKKKSLFSRRLPFQQGIKFCLTFCCSNVGSNGHTY

SEQ ID NO: 184267 - protein, 67 aa, Triticum aestivum
  Clone ID: PAT_TA_78685.pep
RLFCVHNIHYSFSFFRSSAPFVVFAFHCCSEDFSLPFVHRLVYVVTQQYVKCKSSYAAILHQKKKKK

SEQ ID NO: 184268 - protein, 148 aa, Triticum aestivum
  Clone ID: PAT_TA_78686.pep
SQTKKICSGQLSTTLTGEAGAPPDPDADGFGLQPHDKQKGHTSCSFFDKTTSCSCSSWSRNQGEHTGGSGSGLPPRLGIYRAQSPHGTAARPGRERALPLLDLISRPLPPAPFELFDHMSARLFFFSVVTTSPTISYTCSQMPLGGWL

SEQ ID NO: 184269 - protein, 90 aa, Triticum aestivum
  Clone ID: PAT_TA_78687.pep
MAQPAFLSSLRSRLRSPQPQAPALPHLQAPRRGFHVELGAREKALLEEDTALKRFKSYKNSVKQVSKVGNILTGVVLFACAYEIVALANS

SEQ ID NO: 184270 - protein, 253 aa, Triticum aestivum
  Clone ID: PAT_TA_78688.pep
TRVSVKPAMDLIMRCVGASSTDFFPDESMENTLVPHEWVNHRHSYWSSGGKDNPDAPESLTYRLSSDLCVIDEIRVRPYKAAFQHGHPIYSSKAVRIRLGHSKLDPGTETFVSAENENLTAIADENYTWTYTSPEFPMLQENVLQTFKLPRPALCIGGIVKIELLGRLQKQSTDDKYYICVCHVQVMGRSLSPDLMIDISDPADYSNLKYLPGAGNLRPEDLLSSDAKEDSSDWRSLVSRYRQMRQLAMMYML

SEQ ID NO: 184271 - protein, 85 aa, Triticum aestivum
  Clone ID: PAT_TA_78689.pep
EGKALANALATAPSMWTLGNAGMGALQRLAQDPNYAVARAASSAIDELKKQWELEEGDSLRFVMNQNLASEDTDGDDNSAADDDT

SEQ ID NO: 184272 - protein, 127 aa, Triticum aestivum
  Clone ID: PAT_TA_78690.pep
MAGDPGDAPEVGEGGIRSVLTMGSLVDPSGNEVQFPEIDGKMIGLYFAANWYPKCEAFTPVLAAAYEQLKERGAGFEVVLVSCDEDRPSFERFHRTMPWPAVPFGDLRCKKRLSERFQVEGIPRLVV

SEQ ID NO: 184273 - protein, 73 aa, Triticum aestivum
  Clone ID: PAT_TA_78691.pep
CLDNSRYCRLSSAQSSPLGLGVLGFTEREGQGGEGRGGEGSGVTWWMLVAGEGPDENLATGGGVRRQERRAES

SEQ ID NO: 184274 - protein, 128 aa, Triticum aestivum
  Clone ID: PAT_TA_78692.pep
KVRVEAYFWDVSKPVEMEEIDSMEKLDDALRWSVENNQPIIIDWMASWCRKCIYLMPRMEKIAGEYPGVRFYFIDVNKVPQAVVKRGNVTKMPTIQLWKDGEWKAEVIGGHKAWLVMDEVREMIQQNK

SEQ ID NO: 184275 - protein, 188 aa, Triticum aestivum
  Clone ID: PAT_TA_78693.pep
GEKIAAPPDTVVEISNLNLGKLYAASIMYGYFLKRVDERFQLEKTMKTLPPNPKQQIVFENLQPNPFWDMESLVQITPDGEEISLDDEGSNPNKLKSYVSKLDADTLQRYATIRSKEAVSLIEKQTQALFGRPDIKVLDDGSVNAKDGRMVTITFTELNHLVLEAVTFGSFLWEAESYVESKYHFVNS

SEQ ID NO: 184276 - protein, 114 aa, Triticum aestivum
  Clone ID: PAT_TA_78694.pep
TRAGVARSRRGRRIAGKGCWCMAATRRPTTGSTTSTSSRPFLKLRPQASARVWQTGSGEMCSSAICRACMYVCMYVVVNCEFVTHHLCGRLVFLLFSFGRFVGFMLRDCIETGD

SEQ ID NO: 184277 - protein, 60 aa, Triticum aestivum
  Clone ID: PAT_TA_78695.pep
EFTGGVVLVSHDSRLLSRVCEDEQRSEIWVVEDGTVNTYDGTFEDYKDELMEEIKNEVEE

SEQ ID NO: 184278 - protein, 148 aa, Triticum aestivum
  Clone ID: PAT_TA_78696.pep
MAPKAEKKPAEKKPAAEEKAEKAPAGKKPKAEKRLPASKSSGKEGGEKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSN

SEQ ID NO: 184279 - protein, 158 aa, Triticum aestivum
  Clone ID: PAT_TA_78697.pep
MAAEPEPRILELSNGKITARISNWGATITSLLVPDAQGSIADVVLGFDDLDPYVKGMSPYFGCIVGRVANRIKDGKFRLNEVEYSLPVNNGPNSLHGGLRGFDKVVWDVVDHKDGECPSITFQYHSKDGEEGYPGDVTIRATYSLPEAATLRLDMEAT

SEQ ID NO: 184280 - protein, 199 aa, Triticum aestivum
  Clone ID: PAT_TA_78698.pep
HNFLSKEECEYLIGLAKPHMVKSTVVDSTTGKSKDSRVRTSSGMFLQRGRDKVIRAIEKRIADYTFIPADHGEGLQVLHYEVGQKYEPHFDYFLDEFNTKNGGQRMATLLMYLSDVEEGGETIFPDANVNASSLPWYNELSECAKRGLSVKPKMGDALLFWSMKPDATLDPLSLHGGCPVIRGNKWSSTKWMHIHEYKA

SEQ ID NO: 184281 - protein, 74 aa, Triticum aestivum
  Clone ID: PAT_TA_78699.pep
WWWNAAGLVQRQPAGGGGTRLLPAGLARRDARRRLPPRPGRFLLPHELTTTTVHNSLGCNICISQYYIYLKEQN

SEQ ID NO: 184282 - protein, 103 aa, Triticum aestivum
  Clone ID: PAT_TA_78700.pep
SLPPASPSCCRVHVSSPASWFLAMGKSSKGTVLDCYCVVCCRAPEDLTYYTVAIVSCSLALRIPGRLCGGRAGLCASDSPLTPSAFADRLRPLLVSIFFKDFL

SEQ ID NO: 184283 - protein, 157 aa, Triticum aestivum
  Clone ID: PAT_TA_78701.pep
TRKISLRKQTLDGRKHTVPLRKPLQIFFLREGISSIIEYFLNFCHELSSCSKQKSLSPVRCYTPFRSCESMTCYLSSSLESLFRHIDSSFRLASVLAYHDPNRGRVHRLSFSRPLLGYKSMTARSNPQGHKSPYTVVPLAHVIKWEMSIWWLLVIFM

SEQ ID NO: 184284 - protein, 143 aa, Triticum aestivum
  Clone ID: PAT_TA_78702.pep
FHINFWARSRKSKKIKRFFAEVHYKPPSSSSSVCSYLPFPVPGAERPPSSSSVSSDLLLPLPIPVVEACTIIEEPLGQYRKSCAFCRGHLDILHPMGRKFVCGNDKDRFEQQLLPCGSIGLEMPFTCRLGPASVNSSHGEKED

SEQ ID NO: 184285 - protein, 71 aa, Triticum aestivum
  unsure (1)..(71): unsure at all Xaa locations
  Clone ID: PAT_TA_78703.pep
FFFFFXSLTKTSLISCLIQKLRWTDSQESTLYLSFTLQGQPAAACRPTTACARARNNQPITHSMHAHKNPP

SEQ ID NO: 184286 - protein, 130 aa, Triticum aestivum
  Clone ID: PAT_TA_78704.pep
LRVLQSKFDSQSRSFAPDKEIAEALKECPIGQEMNLKQVLKLCMPFIKDKKDEAKEVGPQALDLKLPFSEMDVLQENLELIKRQLGLEQVEVLSASNEAARAKAGEHASLLEEKPPSPGVPIAIFLSKQS

SEQ ID NO: 184287 - protein, 158 aa, Triticum aestivum
  unsure (1)..(158): unsure at all Xaa locations
  Clone ID: PAT_TA_78705.pep
STKSAASRAPFAKLVEGKYSCYPPLSFPPRIGLYPEEINAESNSFLSLSLHLTLCFSGSNPLVPPPRHXKPPPSPACEQPPRAAACIVAAASRRRRXRCARWSRSSXRPLPAVAGRRRPAAAVDRIAAAAQARRRPSFVVVRRCSLHRFRRSGGERFR

SEQ ID NO: 184288 - protein, 120 aa, Triticum aestivum
  Clone ID: PAT_TA_78706.pep
VLVNASRGPVIDEVALVEHLKANPMFRVGLDVFEDEPYMKPGLADMKNAVVVPHIASASKWTREGMATLTALNVLGKIKGYPVWGNPNQVEPFLDENSTPPRACPSIVNAKQLGLPSAKL

SEQ ID NO: 184289 - protein, 131 aa, Triticum aestivum
  Clone ID: PAT_TA_78707.pep
AATSKPAAISFVQNHNNCNIYVHCLDRSCALNQISIRSLQLHGNPGITANPCCCVAGTQDVADDEGWFTRSTMPLLLVRCRRRRPRHSSGSVLARSRRRRRRPQALLWISASRVSSSLPTPPLGIPPDQRW

SEQ ID NO: 184290 - protein, 130 aa, Triticum aestivum
  Clone ID: PAT_TA_78708.pep
RGKIRFQQIHEAYQVLSDDKRRALYDAGMYDPLDDDQEDVEGFHDFVQEMVSLMATVGREEPVYSLADLQSMLDGMIKDFTAPPQPEPSVFYTGGASGKPSSKEQSTASSRMHPQGFGDAACFSRTAFSR

SEQ ID NO: 184291 - protein, 59 aa, Triticum aestivum
  Clone ID: PAT_TA_78709.pep
TEYILLIKCTNGIFFSLLVSVTFLEMWLYDSPIQAVSLLAQLFGFVILIVCYQKKKKKK

SEQ ID NO: 184292 - protein, 45 aa, Triticum aestivum
  Clone ID: PAT_TA_78710.pep
TRLHWSLPDGMKPSELDMSDVFGLTAPRATRLYAVPTPRLNCPLY

SEQ ID NO: 184293 - protein, 147 aa, Triticum aestivum
  unsure (1)..(147): unsure at all Xaa locations
  Clone ID: PAT_TA_78711.pep
MYTPYPDSESLKTLNGQATSDLXCTLNFPIQLYQIQEPESRATXNVHRPLDRALLLAVTAAGVAEALHRGDVLVVHRGELRVAVPRRSDSVAPKHITEGEEDESKELEVGELLGALLRGARMAVDVAVGVTRAPGGEHGTVERERRR

SEQ ID NO: 184294 - protein, 220 aa, Triticum aestivum
  Clone ID: PAT_TA_78712.pep
MVAATTAGMFLVCFESLCPCFRSKRKDGSEDHVLAEHSNSLNSSEMRSISDRIPASPLRVPASPSRFSLSSSPPSRNEPLNLSLEHVVKLTHNFAPALMIGEGYFGKVYRVELRDGRVVAIKRAKKENFVSLRAEFSNEVTLLKNIEHKNLVRLLGCIDKANERILITEYVSNGTLREHLDGQHGLVLGFNQRLEIAIDVAHGLTYLHLYAERPIIHRGC

SEQ ID NO: 184295 - protein, 218 aa, Triticum aestivum
  Clone ID: PAT_TA_78713.pep
REFHSFARPLLSPRGAASNVEERLINDTVNFQNMWSSEQEIRSRCKLLSKQVADDGRVFSIWRPLCPSGYVSIGDIAHVGIHPPHVAAVYKNVGGNFALPLGYDLVWRNCGEDYRNPVSIWFPRPPEGYVALGCVAVSAFEEPPLDSAFCVSERFAEDAVYEEQIVWASSDAYPWGCYVYQVQSKSLQFMAMRRPKEECELKPKKVSESYAQQALERS

SEQ ID NO: 184296 - protein, 54 aa, Triticum aestivum
  Clone ID: PAT_TA_78714.pep
FLFPLFPVAANYIFKPLYMLCNFIGSLICISCYICYGTGSWELIKILRILIRGY

SEQ ID NO: 184297 - protein, 148 aa, Triticum aestivum
  Clone ID: PAT_TA_78715.pep
MASKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQRQRYEETARAWTQKYAMG

SEQ ID NO: 184298 - protein, 157 aa, Triticum aestivum
  Clone ID: PAT_TA_78716.pep
MRRVIDAYQMLSGNQEMMVERNNVDPFDEPECEARDIFVNELLCIGTGCPYSCVKRAPHVFSFSDDIGTARAISQGNGEDDLVQLAVGQCPRKCIYYVTPCQRTILEDVLASVLMPPYDIAEAAVLDSLLSKAKFENNRYRKPKRGAKSSSDYVDWM

SEQ ID NO: 184299 - protein, 199 aa, Triticum aestivum
  Clone ID: PAT_TA_78717.pep
SCPQQTDAGELCISSSSIPLPVWDFHGHTVVKVACGNEHVVAAVSVGETYTEGDLVCYAWGNNNHGQLGLGDKESRSRPVLISAFSEGSSWEVYEIACGASHTAVLANKKSSDQIESRCWTFGLGDKGQLGHGTTATICSPQPVDGLPTGSFLISLDCGLFHTTIVSSDGEVWCWGMERGLGLCPDASFSGVDEGDALY

SEQ ID NO: 184300 - protein, 93 aa, Triticum aestivum
  Clone ID: PAT_TA_78718.pep
VRSQGRGWDAAVKSGGSSKDRERDGLASLNISQCTALTPPAVQAVCDSFPALHTCPERHSLIISGCLSLTSVHCACALHPHRAGRVILSNHAY

SEQ ID NO: 184301 - protein, 151 aa, Triticum aestivum
  Clone ID: PAT_TA_78719.pep
RLNSLYIPKTTRLQERKPGEATVVPGWPVPTFASTWCRQAGIVCVHVSIVLSVVVRAGGSLLRPCRGCPAGAWSPARRRRPHRSRGQEKEGKRKIVEASAWIVEGCGWSGKPPFGGTHSDEEGDHVPQRRRSLLTAVAELHLIVGENSCGA

SEQ ID NO: 184302 - protein, 49 aa, Triticum aestivum
  Clone ID: PAT_TA_78720.pep
LAVLFSHICNNNTCVGGTVCMHICKHHPLISCCLYWAATTTSSAAPCCV

SEQ ID NO: 184303 - protein, 154 aa, Triticum aestivum
  Clone ID: PAT_TA_78721.pep
HMYWKGLSLYRPLPLGAVQVSWVGGRWRLSWRCIPPWRRHLCGSHSSHLSTLPSVHPRWRWCFWLSWRQWVCVGEKWILILSRPPPLHSLASWYPGVHVVLCGLALLETCGALAAPSFWPNGGRSCSVAPSSVLGCFPADGVWWMVQLPACDML

SEQ ID NO: 184304 - protein, 129 aa, Triticum aestivum
  Clone ID: PAT_TA_78722.pep
MEEVTEGVNNLAITEPHKKNRIQVSNTKKPLFFYVNLAKRYMQQHEEVELSALGMAIATVVTVAEILKNNGLAVEKKIMTSTVDVKDDTRARPIQKAKIEIVLGKTDKFDELMAAADAEREAAEAEEQS

SEQ ID NO: 184305 - protein, 47 aa, Triticum aestivum
  Clone ID: PAT_TA_78723.pep
HISGDEKKNKEMVHGSVKDRRTLAAASWFPMTDLGTGTLSGRRRRRH

SEQ ID NO: 184306 - protein, 121 aa, Triticum aestivum
  Clone ID: PAT_TA_78724.pep
MAHPMYGSGPLRSRNAANSDEIQLRIDPVHGDLDEEIDGLHSRVRMLKGVAQEINSEAKFQNDFLHELQMTLAKAQAGVKNNMRRLNKSIIQQGSNHVLHVVLFALFCFFVVYLLSKFSRR

SEQ ID NO: 184307 - protein, 67 aa, Triticum aestivum
  Clone ID: PAT_TA_78725.pep
VLLYCTYSHGFNSSFWALHMDLLPGTAGTYMALSDQNHVRFQKAPNNLCMLSHTFKRCKACPNQHGS

SEQ ID NO: 184308 - protein, 58 aa, Triticum aestivum
  Clone ID: PAT_TA_78726.pep
LQPLLMNIDKCQFNECVPLGLDTDRYPGRGVFIAGTAFFEPYCTLIIYLQRAIWKQIG

SEQ ID NO: 184309 - protein, 126 aa, Triticum aestivum
  Clone ID: PAT_TA_78727.pep
MPSSTGKSAQVPEQCIDVLPSQFGRQNQDQVTTNQVFEVDQGMDCAAVSEGEWADTLTDISVGYLLTEASRGANTDCPGTSVVKNTLLLENPCSYDSFDAAVALHASRYKSAEQPALASHSTIWGA

SEQ ID NO: 184310 - protein, 67 aa, Triticum aestivum
  Clone ID: PAT_TA_78728.pep
VCHDHVTVLGRSIYYAHVSALPFSFQLLHSVFNRRIHPSCCSSIRISQFIDYLSIIQVLAYLIGGVE

SEQ ID NO: 184311 - protein, 137 aa, Triticum aestivum
  Clone ID: PAT_TA_78729.pep
PPETLNAFHLISLSAGFDLSPLFDVEGGPARCHNREGGMRFATRESASGVVSRLEEVAARGGGRMRVTKSGARGVRLEGAERGGRKGRLAVAADIFSLSPSVLVVDVKKDGGDTLEYRSFCSEELRPALKDIVWAAD

SEQ ID NO: 184312 - protein, 198 aa, Triticum aestivum
  Clone ID: PAT_TA_78730.pep
PIAAEVLKQKGVYNPKKLFGVTTLDVVRANTFVAEKKNLKLIDVDVPVVGGHAGITILPLLSKTRPSVTFTEEETEELTKRIQNAGTEVVEAKAGAGSATLSMAYAAARFVESSLRALAGDPDVYECTFIQSEKTDLPFFASRVKLGKNGVESVVSADLEGVTEYEAKALEALKAELKGSIEKGIAFANKQQEAAASV

SEQ ID NO: 184313 - protein, 72 aa, Triticum aestivum
  Clone ID: PAT_TA_78731.pep
WLFCQPNPIAVNTALAQLGVARPVFRLPYVPLPLEKRIEFVRIVEAIGRENFVGEKEAQVLDDDDFVLISRY

SEQ ID NO: 184314 - protein, 199 aa, Triticum aestivum
  unsure (1)..(199): unsure at all Xaa locations
  Clone ID: PAT_TA_78732.pep
MAKHFKYVILGGGVAAGYAAREFAKQGVNPGELAIISKEPVAPYERPALSKGYLFPQNAARLPGFHTCVGSGGERLLPEWYSEKGIELVLSTEIVKADLASKTLTSAAGDTFTYETLLIATGSSVIKLTDFGVQGAESNNILYLRDIADADKLVAAMQAKKDGKAVIVGGGYIXLELSAALKINNFDVTMVYPEPWCMP

SEQ ID NO: 184315 - protein, 127 aa, Triticum aestivum
  Clone ID: PAT_TA_78733.pep
GPNVAQSQLVCTGCRNLLMYPAGATSVCCAVCSTVTAVPAPGTEMAQLVCGGCHTLLMYLRGATSVQCSCCHTVNLAMEANQVAHVNCGNCRMLLMYQYGARSVKCAVCNFVTSVGASPGAEQKPSS

SEQ ID NO: 184316 - protein, 92 aa, Triticum aestivum
  Clone ID: PAT_TA_78734.pep
HQRPLRPRRAQRCGQWARPPPHLTQPRCTVRLPCRRPDPDSLANRQPPTSVKPVNSFQVTCLCVLLQSMLFQLPLPEHADPTTFHVQSENVE

SEQ ID NO: 184317 - protein, 43 aa, Triticum aestivum
  Clone ID: PAT_TA_78735.pep
RLEAFHRQTEPVIDYYSKKGLVANLPAEKPPKEVTAEVLKALS

SEQ ID NO: 184318 - protein, 217 aa, Triticum aestivum
  unsure (1)..(217): unsure at all Xaa locations
  Clone ID: PAT_TA_78736.pep
MSMIAAATEGLVLMTRKVATTRPTLEIMAAAVTTTVVTLASSTSPATTTMKVATRTPTLMNMAALVATTSPTPTTXLAASTNPAQMTTVVAAATTNLAPTTTAAAVATANPALTTTAAAAATTNPATMTTVAVVVATTSPALATMAASTRTPAPATMVVVTNTRNQAQTTMMVATRSQAATMMAMAEAATASRAPATTTVVRTPPTLMDMVAVATTN

SEQ ID NO: 184319 - protein, 69 aa, Triticum aestivum
  Clone ID: PAT_TA_78737.pep
GRAHLAYRSDSFSAIVSNSIMLSHLVILERIQGHLHLDACELADWRREENNQRVDKKSSQKDPSVNKRL

SEQ ID NO: 184320 - protein, 186 aa, Triticum aestivum
  unsure (1)..(186): unsure at all Xaa locations
  Clone ID: PAT_TA_78738.pep
MMREMYMDVLPPVDHIAARSNWFPAAARLWTAEENKRFESALAGLDLCHPDWEKVAQAIPGRTVREVVSHFKNLQLDVQQIESGQVPLPVYGSGASSFTLQWDGNGGYGPGDFRHGYRFGGGCGKRHHGRTPEQERKKGVPWTEEEHKLFLLGLKKYGKXGDWRNISRNFVQTRTPTQVASHAQKY

SEQ ID NO: 184321 - protein, 140 aa, Triticum aestivum
  Clone ID: PAT_TA_78739.pep
MADQETPAVVEAPTPVLGEPMDLMTALQLVMKKSGAHDGLVKGLREAAKAIEKHAAQLCVLAEDCDQPDYVKLVKALCAEHNVHLVTVPSAKTLGEWAGLCKIDSEGKARKVVGCSCVVVKDYGEESEGLNIVQEYVKSH

SEQ ID NO: 184322 - protein, 86 aa, Triticum aestivum
  Clone ID: PAT_TA_78740.pep
SRPIDPAAAAAAAFFSHRRNRSAPDGTTSSVAISPDLKPVPDPTRHARAFGVSPVLRSTRSKLDSSRRKTPNPAIRSEPAQHEANR

SEQ ID NO: 184323 - protein, 101 aa, Triticum aestivum
  Clone ID: PAT_TA_78741.pep
PCLLELLPGGASSHSHSQCNCTAANFQSSSSYLAIPQLTSQISTSFPHHPLSSQGSHGHRRLHPHRSRHLREHRRARRLQERARVQGGREETRRVGSVGEV

SEQ ID NO: 184324 - protein, 82 aa, Triticum aestivum
  Clone ID: PAT_TA_78742.pep
FFFFFFFFLSHARRTDLWVLYEWIHKLTALECTRWGLAFELSEFVHKCKPIQGTNTDAQIFSHKQANSAFLCVPSVECFPRA

SEQ ID NO: 184325 - protein, 79 aa, Triticum aestivum
  Clone ID: PAT_TA_78743.pep
MDDMREEARRYGNLVKVVIPRPDPSGPPVTGVGKVFLEYADVYSATRAKMALHGRKFDGKPMVANYYPELKFANLDFDG

SEQ ID NO: 184326 - protein, 113 aa, Triticum aestivum
  Clone ID: PAT_TA_78744.pep
MGCAGSTLKPEDNGKKLKKPKPWKHTQAITPAQLRQMRDEFWDTAPHYGGQKEIWDALRAAADSDLALAQTIVDSAGIIISNSDMTLCYDERGAKYELPKYVLSEPTNLIKDG

SEQ ID NO: 184327 - protein, 63 aa, Triticum aestivum
  Clone ID: PAT_TA_78745.pep
KVVYNVLNICDALRLIMSDLFPLLQHEIFFLNLILFKAYSVIVVVIIMIICQKLLISDKILVH

SEQ ID NO: 184328 - protein, 58 aa, Triticum aestivum
  Clone ID: PAT_TA_78746.pep
LWLFVCSFENLSPASRHALSLHVVDTEGCEWSKDNWLVHNGTIEVFFFYNTVLIFLYV

SEQ ID NO: 184329 - protein, 184 aa, Triticum aestivum
  Clone ID: PAT_TA_78747.pep
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAIT

SEQ ID NO: 184330 - protein, 83 aa, Triticum aestivum
  Clone ID: PAT_TA_78748.pep
RDATDAMRTCTTTTSIESVLRSMARRRHVRPPVVCIAEHSMSCHVRPPCLAARILQIIISFPCVCSRALQDDRSCSCSREDDE

SEQ ID NO: 184331 - protein, 108 aa, Triticum aestivum
  Clone ID: PAT_TA_78749.pep
SVVIPGAAVSALQFNIIKEEPFMVHNLEVLIPLPVWHGQGYRSLGFRFGDVCYISDVSDIPEETYKLLENCELLIMDALRPDRSSSTHFGLPRALEEVRKIKPKKTLF

SEQ ID NO: 184332 - protein, 116 aa, Triticum aestivum
  Clone ID: PAT_TA_78750.pep
MPSAVFSFTSATPSIPNPPTPIFGHPTVQMNGGNMVVDGNGSPSPATSPFGLRSSASQLTPTFSMPATQFASGTSGSAGVFEVGQYSQVSSGGFSMGSSGGNDKSGRRTIRVKRRK

SEQ ID NO: 184333 - protein, 205 aa, Triticum aestivum
  Clone ID: PAT_TA_78751.pep
YGSLKIPEFETDWKKIIEEHGLGENGCLSSLYEHRQLWAPAYLRDKFWAGMSISQRGESISSYYDGFVYPKTSLKQFFSKYEMILENKYKKEWQADEESSHRSPLTVTKFYMEEQLAKAYTINMFRKFQDELKATMYCDGMPIKVDGRLVTFEVKECSYMEDGKDTESRTYEVYFCKEEPKVEIECECGFVQFTGILCRHALSVL

SEQ ID NO: 184334 - protein, 161 aa, Triticum aestivum
  unsure (1)..(161): unsure at all Xaa locations
  Clone ID: PAT_TA_78752.pep
PRPRPTSPLSLDRPGSSPPSHSPPTPXRPTCVARSGESPSAPTPSPSPSTPDPPPTPSPSPPTPTCVARSGESPSSSPPTPSPSPPMPDARIAWSGESPPTPSPICALTSPSPSPDAVVRRTSPTCVAHLSPATVLEAVNPAFLQVLESPSPLRFLLRVTE

SEQ ID NO: 184335 - protein, 157 aa, Triticum aestivum
  Clone ID: PAT_TA_78753.pep
VTGLLVCHRGMVAGLLLGFSATRKRWPTTVLLYSLPAQPNSNKGQRRKLHIRLFPFSDFQSTNPKIMRYCSKATTKQQQRPEAQTPHQVVPIFRFPIYQSQNNAVLQQSYNQTATKARGANSTAAEFRASRVADEKRSTWDDFITLIADADVRIIKK

SEQ ID NO: 184336 - protein, 166 aa, Triticum aestivum
  unsure (1)..(166): unsure at all Xaa locations
  Clone ID: PAT_TA_78754.pep
MSRPARSDAHLSPEGEAAMEAEVREYYDEAAPKRHSKPSRSEPSAVYTDALVPDDSHPELDRFQQLEAHTEKLVCEGGKAGDEFVETEYYKDLGCVGKQHHTTGTGFIKMDKPSADASFHLSDDPDASERHASCMGNPATNEWIPSADTLLVXVYPASDKPNRSDS

SEQ ID NO: 184337 - protein, 261 aa, Triticum aestivum
  unsure (1)..(261): unsure at all Xaa locations
  Clone ID: PAT_TA_78755.pep
DEAHDNLPAFANKYIIFRRGIGIDTDNCTIFFMEKXVDVIISRAWRSLLPVTRIDRLFXKKQVRSRKDTKKTDEINDDVEEPDLYVERVRLEKMELSIKNLLRKMTIQEPTFERMIVVYRRASSESKPDRGIFVKHFKHIPMADMELVLPEKKNPSLTPMDWVTFLVSAVIGLVTLIGSLEMPKADIWVVTAILSGLIGYCAKIYFTFQANMVAYQNLITKSMYDKQLDSGRGTLLHLCDDVIQQEVKEVIISYYILMEQG

SEQ ID NO: 184338 - protein, 115 aa, Triticum aestivum
  Clone ID: PAT_TA_78756.pep
LMPGADVGAEQEPTPAAAARGEEMAGPASTAAPLTIFYGGRVVVFEDFPAEKAAEVMRLAAGGAERAAVPAPAPAPRDDLPIARKASLQRFLAKRKDRLVERAPYTRPSPSPAEE

SEQ ID NO: 184339 - protein, 252 aa, Triticum aestivum
  unsure (1)..(252): unsure at all Xaa locations
  Clone ID: PAT_TA_78757.pep
LGIIEDTANRARLAKLXLRFQTSGLEKGKMVSLGDYVKRMKEKQEHIYYMAGSSFEEVASSPFVERLLKKGYEVLYLTDPVDEYCISAIPEFEGKKFQNVAKDGLKLNESKEKLEALQKQFEPLTKWLEGTALKEKISKASISQRLHDSPCALVASQFGWTGNMERLAKSNAHSKSNDVTREYYLSQKKALEINPRHPLVKEMLRRVEGDPDDETAKNMAALMYETATLRSGYMLSDTQSFASRVESLLRKH

SEQ ID NO: 184340 - protein, 106 aa, Triticum aestivum
  Clone ID: PAT_TA_78758.pep
HTVRLPASEVASHARPPRPPRRATGRRSTAEGAMQRRRPATSDDRPAVAGCPGGCLALARPLVQSRYSYSCCLCPPVTATAHLPVTPVQVQHSSRHASISKLLCEQ

SEQ ID NO: 184341 - protein, 95 aa, Triticum aestivum
  Clone ID: PAT_TA_78759.pep
GNQQMFHNNQAMQSMLATHQLQQLQLHSQPQQQSQHSQHQHQHQQLHSIQAQQQQQQLHSLQAQQLQQVARDLKMKAHLAGQGQWGDGKSGSSGS

SEQ ID NO: 184342 - protein, 136 aa, Triticum aestivum
  Clone ID: PAT_TA_78760.pep
GWFIENEGPWNLQDISNNEDNGLQNLQDVNNNEDVNNNAPVKSKVEWDSDNDNIIDLESDDEVSFMGCNTVLGFHPYKDVIFLNFALERAVAYHLNTSVVQDLGKVRPDYYCGYAAELLSSFLYTPCLMAEFPEEG

SEQ ID NO: 184343 - protein, 53 aa, Triticum aestivum
  Clone ID: PAT_TA_78761.pep
LICFGPRGLRTVLDFAFEVGYEERELNKISVKSENLSLCNLLYGSMKVQTRCF

SEQ ID NO: 184344 - protein, 50 aa, Triticum aestivum
  Clone ID: PAT_TA_78762.pep
ARELAAVAALCVQYEAEFRPNMSIVVKALSPLLQQRPAPATAEPAPQPVS

SEQ ID NO: 184345 - protein, 93 aa, Triticum aestivum
  Clone ID: PAT_TA_78763.pep
CMITTGKVVQDCNVRVLRKGKEVYVGSLDSLRRVKEAVKEVGAGLECGIGVDDFDEWQEGDIVEAFNTVKKARTLEEASATVTAALKDAGVQL

SEQ ID NO: 184346 - protein, 228 aa, Triticum aestivum
  Clone ID: PAT_TA_78764.pep
EANNETNGNLESTQEGQSNPTSMIHYRDTQRKIVEFIRKRYHLLERCLNLEYAVIKTKTPVPDDLAEQDFPGGHRPAVPDYSEMLRELPVLEPISKEVAPEGTTDQSQVSHLYNKMCFVLEDSAVPALNSHFGDKAASSGLANSLHKFEAVCEDVSRILRSHENGTTPKEEVMLDASSKETTSPKDPATEVPSSASKEATPPVQDPVIEAVKEEPPTVKAEDKMEIDS

SEQ ID NO: 184347 - protein, 158 aa, Triticum aestivum
  Clone ID: PAT_TA_78765.pep
IVKDQLVENSERSHFDEKTNHLHGSAPIGEKVERHARNRDRPDRGVWAPRRYDKSTSGGGSHASSSDFPQIQSHSGDNVSQIADGHGDRKTDTRGHGGSRGVPVENGHRHANRRGPPRGPKETEISASVPDGKNSKRGSASYGAHERQVWVQKSSSGS

SEQ ID NO: 184348 - protein, 123 aa, Triticum aestivum
  Clone ID: PAT_TA_78766.pep
EELLQPKDDTWSDCAKNGYAVKPVKGDALLFFSLHPDATTDSDSLHGSCPVIEGQKWSATKWIHVRSFDISVKQGASTDGCEDENVLCPQWAAVGECAKNPNYMVGTNEAPGFCRKSCNVCAQ

SEQ ID NO: 184349 - protein, 76 aa, Triticum aestivum
  Clone ID: PAT_TA_78767.pep
NNKSPTDLFPAEWGVGAIFGEECQKRGMLVRVAGDAIMMSPTLIMTSAEVDELVSIYGEALKATEERVAALKSKKN

SEQ ID NO: 184350 - protein, 79 aa, Triticum aestivum
  Clone ID: PAT_TA_78768.pep
EGWSCWPRQRTSCEEVDSSWRHAAFLVCLRNEDVAVDVRTLSRSQNCPNVQFNGLRRMQPVVIESDVLTVVGSLHAVFS

SEQ ID NO: 184351 - protein, 117 aa, Triticum aestivum
  Clone ID: PAT_TA_78769.pep
ISVEIHLKYCGICDSVQWTKKQGKQFIYIYMYIYTEIYTLHDSKIRHGYNNLFLVKNQFIVHAQIHQAKKNIFLKTLRQTHAGSAIPLISNKTRYRIVICMDAHCATHCAKRQCIYS

SEQ ID NO: 184352 - protein, 168 aa, Triticum aestivum
  Clone ID: PAT_TA_78770.pep
MQDHHAELRSRDFHHADDAFADSVSTDFSEATSSEWSLFTSSDESSFTTESTRDSFSVVDYGDNAGLDPISSIFGPSYAPEHPPGNFVSCTRFSPSNPQTRYFSESTGFVSDSSMPAHPSGIVHRGRYPDRACASSAEPLASAHQRSGYGRYPLSRDGFVQTSGFCQM

SEQ ID NO: 184353 - protein, 50 aa, Triticum aestivum
  Clone ID: PAT_TA_78771.pep
FRSNYCGEFDNAGALLSIDESLMCSFQILKPTDMGPPHARKQIPNKPARG

SEQ ID NO: 184354 - protein, 247 aa, Triticum aestivum
  Clone ID: PAT_TA_78772.pep
ERDLWERYGGVDISLDPCSFGQANTLSFNSLLHKLNKYVPRGSTVVDLYSGAGVIGLSVAASRKCRSVKCVEINKQSKMSFETSASRLPANLGCTITWHNTDASVEPVHWLEGSSVVIVDPPRKGLHPSVISALQKVALSERKAYKAKSSLAKVKDEKRPWILRAREAAVHVDSTTTEEGSETWPETLIYISCGWESFKKDCKSLISSKAWQLENAHAFNFFPGTDSIEILAIFKRESEAGQKKKKK

SEQ ID NO: 184355 - protein, 57 aa, Triticum aestivum
  Clone ID: PAT_TA_78773.pep
GTRILRRGSCLFPAFLVLMHLELVVSRHCSMQARRAQMIWSKDRTADVVVHEHNAHR

SEQ ID NO: 184356 - protein, 49 aa, Triticum aestivum
  Clone ID: PAT_TA_78774.pep
LPPFEHSSLELLSFCSILLRKNFCSRFFENIKQVLELSYKKKKKKKKKK

SEQ ID NO: 184357 - protein, 51 aa, Triticum aestivum
  Clone ID: PAT_TA_78775.pep
RKVTTGHPMEVPIDLPPPKSSSNPDGQWQAKYVACGGRHTLAIAEWTEPTA

SEQ ID NO: 184358 - protein, 74 aa, Triticum aestivum
  Clone ID: PAT_TA_78776.pep
APKIQRLVTPLTLQRKRARIADKKKRIAKKKSEAAEYQKLLAQRLKEQRDRRSESLAKRRSKLSSAAKAAASTA

SEQ ID NO: 184359 - protein, 101 aa, Triticum aestivum
  Clone ID: PAT_TA_78777.pep
PVLHFDCRRLGGDEEERGAADYAINAVRYHSAPGAAGEDEYEGPEFRDLDPRLQAALREYLVARGVNPKLATSILQHLLEKERSQYVNWLKALEQAFAKDR

SEQ ID NO: 184360 - protein, 202 aa, Triticum aestivum
  Clone ID: PAT_TA_78778.pep
EAALLLVLSADLLWMWLCVGFCSSCNSKLFWLLFFEPLSIAFDTLQSIMVHGFQLLDIWQRHLMESGTDFLDFQKSYKQAAGSFSEWRGKLTRNFGFAIDLISLLMSLGHYSMIFWLRGMAFHLVDAVLLLNLRALIVSFLKRIKTYIKLRKALSSLDGALPDATYDEICAYDDECAICRGPMGRAKKLSCNHLFHLACLRS

SEQ ID NO: 184361 - protein, 105 aa, Triticum aestivum
  Clone ID: PAT_TA_78779.pep
KPHETLSRNHFIDLVAAMSEGVAGVEEVMVCSDVVYGAAVAAVSFLSPSLGCLWHHAAATSIDLDLGIGLGCWCRSWRVGRKDRLSLSLSLSLSLSLSLSLSLSS

SEQ ID NO: 184362 - protein, 95 aa, Triticum aestivum
  Clone ID: PAT_TA_78780.pep
ALFQREIEKERERERARMASLLSLYGSGGRRRMSRSSGTAAPVRRLLRRLRSSFGRSAARPRRRSAVRFGYDLHSYSQNFDDGVASSAPAAMACA

SEQ ID NO: 184363 - protein, 228 aa, Triticum aestivum
  Clone ID: PAT_TA_78781.pep
KPREIHNLFSHRPAFDHCLLEYTGRANQVVAFVTFFTHEAALSAMTSLNGTIFDPETGYRLHIELAKSTSRRPRGGGEVYRVIDKRTNKTEGNADENVGDEVDEEVWGGDEDGANDDNGDGESDEPSGTENENSSDKNELPADQSDQPRHKKQNGKSLSNDGRDKSSNDIPPCSTLFIANLGDTCTKDELNEVLSKEPGFDVLKMRRRGGMPVAFADFTDIESSTAAM

SEQ ID NO: 184364 - protein, 107 aa, Triticum aestivum
  Clone ID: PAT_TA_78782.pep
NKLLCLSLSSQEEGSKMLLYYSTTAAARFGDNPQSPENKQASMQISQPRFRQIVIIVRSSKQQQQHRSGGESWCRLREKGRTKYFSPFPLSLSSGSLNELDVTAAAP

SEQ ID NO: 184365 - protein, 58 aa, Triticum aestivum
  Clone ID: PAT_TA_78783.pep
QGSIFPPFTNIRKISARIAAAVAAKAYELGLATRLPPPRDLVKYAESCMYTPVYRNYR

SEQ ID NO: 184366 - protein, 154 aa, Triticum aestivum
  Clone ID: PAT_TA_78784.pep
HEGKAYAYARFSYYPPCTRPDLVFGLKPHSDGTFFTLLMVDNSVGGLQVLRDGVWYDVPTRPHTLLINLGDQIEIMSNGIFKSPVHRVVTNAEKERLSVALFYSIDPEREIQPADKLIDENHPALYKKVKIKEYIAGLYEHVARGEMVIETAKI

SEQ ID NO: 184367 - protein, 194 aa, Triticum aestivum
  Clone ID: PAT_TA_78785.pep
LVSAMKGTRAKNGIIAKLSVSWAPDVYDPPITSDSHTVRGHHRSSMKSNYKYKSSKSSSRSTTGSKKDKKHSRHSSSSGGGSKRDRKHSSHSTSSASSSRAVTSGSQYRNTYCGDGISSSRTVTCVPESAKVSPLVLAENAAPQEPVPVLKTLEPIKCATSCSKEKPFALLSRQFSPARYKGMFSFWSQNQLAS

SEQ ID NO: 184368 - protein, 147 aa, Triticum aestivum
  Clone ID: PAT_TA_78786.pep
EALEPGKPVKSDKAAILSDATRMVIQLRAEAKQLKDTNESLEDKIKELKAEKDELRDEKQKLKVEKETLEQQVKILTATPAYMPHPTLMPAPYPQAPLAPFHHAQGQAAGQKLMMPFVGYPGYPMWQFMPPSEVDTSKDSEACPPVA

SEQ ID NO: 184369 - protein, 210 aa, Triticum aestivum
  Clone ID: PAT_TA_78787.pep
KLAIHLQHLCSLPQIIQLEDDTYNPQTPEAEIRKYYEPIGSWKHFSHVCTAPVDSDDSSIVTGAHLEVVSHGFKKILFLRLHFSKVCNATSVKNPEWDGSPNLGQKSGLISTLISTHFSTAALKPAPRPAEVNINSAVYPGGPPVPVQTPKLLRFVDTTEMLRGPQDLPGYWVVSGAKLHLERGKISLRVKYSLLTVNSPDDEFSPDEEF

SEQ ID NO: 184370 - protein, 202 aa, Triticum aestivum
  Clone ID: PAT_TA_78788.pep
VRANDEWVSYSPSQASVSKERAIESAKAVFLKDYDHLEPYRIHHASRLVAILEAYAIYDQEIGYCQGMSDLLAPLLAVLEEDDEAFWCFAGFMRKARHNFRLDEVGIRRQLNMVARIIKYKDFHLYRHLEMLQAEDCFFVYRMVVVMFRRELTFEQTLCLWEVMWADQAANRAEIAKSSWRKLQLGAPPTDDLLLYAIAASV

SEQ ID NO: 184371 - protein, 192 aa, Triticum aestivum
  Clone ID: PAT_TA_78789.pep
VRALRKPHLMTKLQDEVRKNTTTKMVSEDDLNNMPYLKAVVKETLRLHPPVPLLLPRLSMAQCNANGYTIPANTRVIINVWALGRDARCWENSEEFMPERFMDSGDTIDNVDFKGTDFQFLPFGAGRRICPGMNFGMASVELMLSNLMYCFDWELPVGMDKDDVDMTDQFALTMARKEKLYLIPRSHVIKIT

SEQ ID NO: 184372 - protein, 129 aa, Triticum aestivum
  unsure (1)..(129): unsure at all Xaa locations
  Clone ID: PAT_TA_78790.pep
GDGYAPIAAXLKKYDAALNFTCVELRTMDQHEVYPEAFADPEGLVWQVLNAAWDAGIQVASENALPCYDRDGFNKILENAKPLNDPDGRHLFGFTYLRLSNVLFERPNFFEFERFLKRMHGEAVLDLQV

SEQ ID NO: 184373 - protein, 165 aa, Triticum aestivum
  Clone ID: PAT_TA_78791.pep
EDGTYFVETEDGSSPGLDVKVDSRGDHDFRVDVGGLQTDVTLAFYSKDNCNHIHIWHGKHHHHYRQTLRAEQSPDDSSQPSASSEARSHPKGSVLAPMAGLVVKVLLKDGARVEEGQPVMVMEAMKMEHVVKAPCAGYVEGLKATAGQQVFDSSVLFTVKENKPN

SEQ ID NO: 184374 - protein, 178 aa, Triticum aestivum
  Clone ID: PAT_TA_78792.pep
GLLLLRLDDWVLCRIYKKPNPQQLSPFYEPSPSPSRSSMDASLGLGHHHHHQYHHHQQQQQQEDTSSSSRMLPRNPSVSDYLVDYSAVSELFDSMPPPPQPETASSVGHFFLGTTAGASDGEASTARKRQATADSNNDGEMSSLHASKRWLGSDGSMTMMNGGFSIFGPDQPSQQDRI

SEQ ID NO: 184375 - protein, 132 aa, Triticum aestivum
  unsure (1)..(132): unsure at all Xaa locations
  Clone ID: PAT_TA_78793.pep
MEETGANRNISDNGEPVSKRKATELKSLGNKAVEKKDYLSATGFYSXRSLCWHHMGNGGKALLDAYECRKLRPDWPKAYYRQGAALMLLKDYESACETLYDGLKLDPGNSEMEDALREALESLKTSASTEAR

SEQ ID NO: 184376 - protein, 72 aa, Triticum aestivum
  Clone ID: PAT_TA_78794.pep
VWGGEPELFMASHVLQMPITVYMHDKEAGGLIAIAEYGQEYGTEAPIQVLYHGYGHYDALQIPGKGGPRSRL

SEQ ID NO: 184377 - protein, 78 aa, Triticum aestivum
  Clone ID: PAT_TA_78795.pep
DAEEFRPERFENSSVDFRGNDFEFTPFGSGRRICPGITLGLANLELALVSLLYHFDWTLPDGVKLEEFDMAEIFGITL

SEQ ID NO: 184378 - protein, 48 aa, Triticum aestivum
  Clone ID: PAT_TA_78796.pep
EIDFFGEVSGITLSPDDESLFVGVCDRVYASLLQYRMIHAFDYLDSYV

SEQ ID NO: 184379 - protein, 117 aa, Triticum aestivum
  Clone ID: PAT_TA_78797.pep
LKLQGACGSCPASVTTMKMGIERRLMEKIPEIVAVEPIADEETGLELNQENIEKVLDEIRPYLAGTGGGELEFVTIEEPIVKVRLTGPAAGVMTVRVALTQKLREKIPKIAAVQLLP

SEQ ID NO: 184380 - protein, 112 aa, Triticum aestivum
  Clone ID: PAT_TA_78798.pep
EGQGFRDVDDHVQSGPETAVRQGFRDVDDHVQYGPETAVTLQKSSFPSSRKERSSNNKYHRRLPQMHDPQDDPTKNKQRSIPRTNAVSIGLAMIDRPAGSGLGGLVRSALNL

SEQ ID NO: 184381 - protein, 69 aa, Triticum aestivum
  Clone ID: PAT_TA_78799.pep
AEIRSGDPEAQGEPQEGSKGKRGVPEDGAEPGQQMCYPVGYLLEVSVGLIVLPRLLSVVVPFSSLCDNC

SEQ ID NO: 184382 - protein, 87 aa, Triticum aestivum
  Clone ID: PAT_TA_78800.pep
SGARAAPSMRYAVATHVESLCLHSSFSPVSPWNTGHCIGIPVRLKRHPVTTPPIKFYLYSIQKSECSFSRLFLEDSIDQPINQHNLL

SEQ ID NO: 184383 - protein, 46 aa, Triticum aestivum
  Clone ID: PAT_TA_78801.pep
SNCIPSPAIKHGERYSIYTTPTKLPLVPPQWQQEFNRVNADKQGYY

SEQ ID NO: 184384 - protein, 82 aa, Triticum aestivum
  Clone ID: PAT_TA_78802.pep
KNPFVGEPHLVLAQVYLNMERYGDAQMQAEEGLKLLLEWGSSWDKRMTWEGWVSWGRAMLTKASEKDWPHTAFGIINLGLVK

SEQ ID NO: 184385 - protein, 152 aa, Triticum aestivum
  Clone ID: PAT_TA_78803.pep
ADKKRPKSHILELVAWLHHLISRSKSANGERSPIKSPVRSPTQRGHTITLSPNKASSNSSPLLTQEDQDMLRDVKYRKFIPGISKSQEFETKSRHSKQSRLSKSNSHSPSSGNMKELLSIRRMLPVIDFEIDRTKAMDVIDRVDNLKSTVRT

SEQ ID NO: 184386 - protein, 144 aa, Triticum aestivum
  Clone ID: PAT_TA_78804.pep
LFLGNPWKLNLPFDGDSFQQWLAGHAPGRVSGDIDACTRWLVDEFKAAGVSKKLGVVGFCYGGGRLVETLARDADSCFSAGVCFYGSRMDASLGDRIAAPVLFVCGDGDPLCAVETVRELERRARGGARAAVYAGRGHGFAHRP

SEQ ID NO: 184387 - protein, 43 aa, Triticum aestivum
  Clone ID: PAT_TA_78805.pep
SSSSRPRTAKKCTSHATNRSPFIHRKRRKVRKQQFLLRVNEHL

SEQ ID NO: 184388 - protein, 194 aa, Triticum aestivum
  Clone ID: PAT_TA_78806.pep
SYSSMTPWMKLVLYTAGHCGPVSAVFMKGLRFRLLPEPLAGCEKALIWSWDGSSVGGLGGKFEGNLVKGNLLLHCLNSMLKQSAVLVQPLSIHDLNTSGNLVTVDIPLPLKNDDQSIESVVAQTNLPKEQILDLTSVLKDLSSKFELSTLGYLRLLRLHRIDEPDKFDPENVSYQWVPLSLEFGIPLFSPKLCE

SEQ ID NO: 184389 - protein, 216 aa, Triticum aestivum
  Clone ID: PAT_TA_78807.pep
GTPLHSANSPFVPSPSPPVAPSPMPVDSDKPLSNLSSLTSAGQAHQQTSLAPQTQSIAVNTPGISASPLLAEFTSADGSQVNLPTQVPTKSAAERPLDRLLKALRTTQRESLSAAVSDIGSVVSMIDRIAGSAPGNGSRAAVGEDLVAMTKCRLQARNFITHDGSGASKKMKRDTSAMPLNVSSAGSVNDSLKQSYTVGTPELQSTATSRVKWQRA

SEQ ID NO: 184390 - protein, 196 aa, Triticum aestivum
  Clone ID: PAT_TA_78808.pep
MVLINAVYFKGNWKKKFDPSQTIKKSFFIDNNSSIDVPMMKKLDNLNYGLLDEYDAQFVEIEYDSEDDNDEISMIIILPNNVDGLKKIEDKLNEINYGKIRESGDKRQVELSLPKFKIESSIDLQPALTKMGMSEMFTDNANFSKITKKIPLKISKVIQKAFIEVNEEGSEAAAATGIIMIKSYPASSHTYNIFYN

SEQ ID NO: 184391 - protein, 150 aa, Triticum aestivum
  Clone ID: PAT_TA_78809.pep
WRIGWACAPANIASAIRNIHVKLTDSAPAPFQEAALVALTSPPDFYSSLKQDYTARRDFILQVLTDFGFRISFKPQGSIFVFVELPRSWQLSDMDFVTNLIKNAGVAAVPGRGFFHSSTDDPSYHHRYVRFAFCKSNDTLNAAAEKMRKL

SEQ ID NO: 184392 - protein, 50 aa, Triticum aestivum
  Clone ID: PAT_TA_78810.pep
RRTPFGRSSHMKASGRKLRVHNWVADLKDPVGCMQFWLQNCFCLVNFHVT

SEQ ID NO: 184393 - protein, 151 aa, Triticum aestivum
  unsure (1)..(151): unsure at all Xaa locations
  Clone ID: PAT_TA_78811.pep
RQDLLQLTLNNNNDHWTCIWNSGFTVAKAYKHLSGHRTIHWSFKXIWNCSCQNKHKVLXWLILVERLSTRELLRRKNMALEDHNCVLCTSSTEESLVHLLIDCPFASTCWNWLGLQINPQANIFQNLESFRRQLQVPFFTEIILMCWSIWE

SEQ ID NO: 184394 - protein, 54 aa, Triticum aestivum
  Clone ID: PAT_TA_78812.pep
SKLGLADMTVVPCCLNVRVVYHSCPTEFQAVCQIFYCEFVIVFNDDLFQTVSIT

SEQ ID NO: 184395 - protein, 83 aa, Triticum aestivum
  unsure (1)..(83): unsure at all Xaa locations
  Clone ID: PAT_TA_78813.pep
RAKSMKFKDGYXISSGQPVNEYIDSAVRHVLLRQGVLGIKVKIMLDWDPKGKVGPITPLPDLVTIHTPKDEDELRPPVLAPEV

SEQ ID NO: 184396 - protein, 143 aa, Triticum aestivum
  Clone ID: PAT_TA_78814.pep
RYTSRVILDFKRRKKVVQEHKKGMRLGSINGLRCKQLKLVILAFFMMFLLWKWERGTYYTTEILRPDSLILAHPANSKFVDQHTSSEEDFPNADTLTQSVVKVEQQVSDAPPPMSIASDSADVADEREPPPSGKKDCNYGNGK

SEQ ID NO: 184397 - protein, 191 aa, Triticum aestivum
  Clone ID: PAT_TA_78815.pep
WTPLNLSYEFSNTHLDDYVRSKLLSEKELLSYNESSKDQPRTLVEVVALACAVVGGDTIQTYLWSSLAVVVAPLTGQAILHNSLMFIQALMGSVPLAHVEDVCEAHVFCMEQASMSGRFLCAAGYPNMRDIVDHFAAKHPDLEIKLTEVTGEGVRIVPNTSKLEDLGFRFKYGVEETLDCSVECAKRLGEL

SEQ ID NO: 184398 - protein, 146 aa, Triticum aestivum
  Clone ID: PAT_TA_78816.pep
CYSRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMTSDPLEAGSQASTLVQDIRKRKGLKEQMTPLSDFEDKL

SEQ ID NO: 184399 - protein, 78 aa, Triticum aestivum
  Clone ID: PAT_TA_78817.pep
NIEKVVSTNFFLTSCYSFVQSFGRSFLLALPFRLCTTREVTGKEVAEVVEVRRRLYAYTDRWIIFIERPQKFECCNRS

SEQ ID NO: 184400 - protein, 154 aa, Triticum aestivum
  Clone ID: PAT_TA_78818.pep
EEKTQYYPGKEIKRRKRHRRKQYVDQEPCIMRGVYFKNMKWQAAIKVDKKQIHLGTVGTQDEAARLYDRAAFMCGREPNFELSEEEKQELRKYTWEGFLAVTRNTITSKKQRKVGLPRRSKADLFMGQSDGDTEMANGGGSSNSDNGDAETSAS

SEQ ID NO: 184401 - protein, 88 aa, Triticum aestivum
  Clone ID: PAT_TA_78819.pep
NGPVTTGFTVYADFPSYKSGVYQKTTDHVLGGHAVKIIGWGTENGVDYWLVANSWNELWGDKGFFKIRRGNDECGFEDNVITGLPKLS

SEQ ID NO: 184402 - protein, 83 aa, Triticum aestivum
  Clone ID: PAT_TA_78820.pep
ALRAAAAVAAASEQRALLHGGMLSRPLLLLPIGSLLLRSKLRTACSGKPLGTLDITGIGLLVKNRRYHESITSLPSPIVLFVR

SEQ ID NO: 184403 - protein, 82 aa, Triticum aestivum
  Clone ID: PAT_TA_78821.pep
DPSTVCLYHHHHHIVESLLRMHRGRRPTMSEGRQDRTGCYAHLDRHRDRKLGRPNPRRYRTLDSRRELPWELFLCIRLVNLE

SEQ ID NO: 184404 - protein, 197 aa, Triticum aestivum
  unsure (1)..(197): unsure at all Xaa locations
  Clone ID: PAT_TA_78822.pep
IDDSSSVTVVWQVILVGHSAGGLSVTHAMHLFRDKIKQAIFIAATMLPFGYQTEQDIKDVIQNFPXLIAWFNSYLYLRFGLGDGCPPTSVALREEHQRIIHHEQRXLQDSTLASILLRPWPAALSTARFGHVDDGAESAVNAVPRVYIKTTNDHMVKQEQQEAMIRRWPPREVVAMDTDHSPFFSAPERLLELILKS

SEQ ID NO: 184405 - protein, 102 aa, Triticum aestivum
  Clone ID: PAT_TA_78823.pep
FFFFFFFFRNKTLYCFYFTLADAIYRIERVSNCSKKTSQVYKRCKTTTTMDWTSSADRCMSKSTEAEGHRSFISVMKMVNILKMVARIARSRARPPCSLLPS

SEQ ID NO: 184406 - protein, 100 aa, Triticum aestivum
  Clone ID: PAT_TA_78824.pep
HTGYHTVVAVCLFQKRIKRGSQAAITSHTYMSMPKEQRFADGLWRNPFWVRILLYARKKLDLSLSEINGDLSHSQSPCPNCFAPVKNMLFFRFIYTQRGS

SEQ ID NO: 184407 - protein, 68 aa, Triticum aestivum
  Clone ID: PAT_TA_78825.pep
EQAAKVTGMLLEMDQTEVLHLLESPDALKAKVAEAMEVLRSAQHLQQSNASPEQQLANLSLNDGVVSS

SEQ ID NO: 184408 - protein, 109 aa, Triticum aestivum
  Clone ID: PAT_TA_78826.pep
SSSALQGPSQLVAAAPVSLSSKYGQTSGANNSVDDNIPPASVVDKFSGLPDRNASAPSTGNLQGGETKSIGADLRIKESHELSQANGSRGCSVNTLNSSAVPQLVTVPI

SEQ ID NO: 184409 - protein, 51 aa, Triticum aestivum
  Clone ID: PAT_TA_78827.pep
CAPPPSCKLGQNLHESTILPTLHDIILQDSIRKDSTSGWTESTSLSLDCHG

SEQ ID NO: 184410 - protein, 55 aa, Triticum aestivum
  Clone ID: PAT_TA_78828.pep
LSKNGLERIWYKEVSFLREVDAVISSGVTPAERLLNLYETKWQRSVDPVFQELLY

SEQ ID NO: 184411 - protein, 97 aa, Triticum aestivum
  Clone ID: PAT_TA_78829.pep
SFRSSNQSAIWQLMAIIYNYARQLFSANQATVGHRRLTVTLHALVPDRAEQQPLQPHQIALPCRLRPHVSVAAVAVVTSLALADGWSGSLVDRRLFN

SEQ ID NO: 184412 - protein, 226 aa, Triticum aestivum
  Clone ID: PAT_TA_78830.pep
RLSILTEIVHDVPAKKEEVSYNVASPAVSGVRSVSVAPQVAPVNKVVSAPAQYSAWSGEVAAPAPASGSWVSDVKPATWTSEVKPATWTSEVKPATWTSEVKPATWTSEVKPAVWASDVKPSSWASEVKPVGWTSEIKPASWAWAQPKPSYRQGAWADVKPASWSSWSEPKPLNAYVSQPAFYGAEYPQTIYTNAHHAAPWSSTWSSAHPVAWTEPIQKRSERKQF

SEQ ID NO: 184413 - protein, 180 aa, Triticum aestivum
  unsure (1)..(180): unsure at all Xaa locations
  Clone ID: PAT_TA_78831.pep
QISCGAAHFVLVAGDGYRMWAWGRGRXGVLGRGQTADSYIPCVVMWPPLDENFQEIHEDQAGGSTSRVNDRTSTELTQKLSAASEELQFLRSKLTLMERYANILHISIFRKPLDERALPRSLQESSVFDIRKEFENILDAADTDELNRLEIFYRSMLSGVKDKLLKRRVQEMVQQCIISL

SEQ ID NO: 184414 - protein, 120 aa, Triticum aestivum
  Clone ID: PAT_TA_78832.pep
GCRNVTWSFFANIQLSHPNSYLFPSQSSLARKSTLSHPLPAIEAENRREKISLPAPSSCILACPADCRRWRAPCRKVAQFCRKSRKSRSSPTSILDPRAEEVGGGATIDHHVRRAARPAS

SEQ ID NO: 184415 - protein, 202 aa, Triticum aestivum
  Clone ID: PAT_TA_78833.pep
KSLEKRFGQSPIFIASTFMTQGGIPPSTNPASLLKEAIHVISCGYEDKTEWGKEIGWIYGSVTEDILTGFKMHARGWISIYCMPLRPCFKGSAPINLSDRLNQVLRWALGSVEILLSRHCPIWYGYNGRLKLLERLAYINTIVYPITSIPLIAYCVLPAICLLTNKFIIPEISNYAGAFFILLFASIFATGILELPWSGVGI

SEQ ID NO: 184416 - protein, 88 aa, Triticum aestivum
  Clone ID: PAT_TA_78834.pep
IPPTTISPTNNLSPLLTGDTTPRFDRTACIPLLVPGWVWEDGVLNITPGSGRYVMMPPFGYVFDGIQRSDAAYRASLRAPVQRGKASA

SEQ ID NO: 184417 - protein, 158 aa, Triticum aestivum
  Clone ID: PAT_TA_78835.pep
MATAISSLVTPPALHRRCLSPASVSVSAPIRISFRAAAASQAWRRGLTLRVSASSAVLEAPEVVAARKLYVGNVPRTVTNDELRDMFAAHGTVERAEVMYDKYTNRSRRFGFVTMSTVEEANAAVEALNGTEVGGRKIKVNVTESFLPNIDRSAPESE

SEQ ID NO: 184418 - protein, 42 aa, Triticum aestivum
  Clone ID: PAT_TA_78836.pep
LPEGREIDRVEKMICCVDQNHDGRVDFFEFKHMMQSVVVHTS

SEQ ID NO: 184419 - protein, 181 aa, Triticum aestivum
  unsure (1)..(181): unsure at all Xaa locations
  Clone ID: PAT_TA_78837.pep
DEREKELXEMLKRNNQQRSSTVQVLEGLLASQREACAEANKRAEDLSLMLQATQGKLDMLQQETTLDSKLKTSARRLRGEATESVHDMDIDEDSVRRRKRSKSTTSPFKSTHTEDGGSVFVGEDTHNGSQQGTETEDYTKFTVLKLKQELTKHGFGAQLLQLKNPNKKDIVALYEKHVVGK

SEQ ID NO: 184420 - protein, 159 aa, Triticum aestivum
  Clone ID: PAT_TA_78838.pep
DFDKFDNYVTAKEVVSEWSQMEEMNERLRFFVEECDHIQGIQFLVDDSGGFASVAAQFLESIADDYTNTPVMLYCVRNPDSSGSSRNQRETIIRSLHDAVSLSKLSYSCNLMVPIGLPSLSYLSPLLSIKDDKHFHSSAICAAAIHSLSVPFRLQHVGP

SEQ ID NO: 184421 - protein, 146 aa, Triticum aestivum
  Clone ID: PAT_TA_78839.pep
MENAAGAPAPAITKPSLSKKPSPSFRLRNGSLNALRLRRVFDLFDRNGDGEITLDEMASALDSLGLGADRSGLEAAVGGYIPAGAAGLRFENFESLHRALGDALFGPIPEEVPEDDDEGDMKEAFRVFDEDGDGFISDAELQAVPQ

SEQ ID NO: 184422 - protein, 143 aa, Triticum aestivum
  Clone ID: PAT_TA_78840.pep
RWKPSQIIDRNRVQEREYATSLAYRWDSRPPCGTPSVPVVRVMRNSMRNSPSLQIGPDPPHVGGGASPFSLLRGSRFVFNLLRELHANLCAEARSTEGRVRAEAGDWYIAHRILRGGLCAEGWGGRRLVEAVWMVRVGDGQAA

SEQ ID NO: 184423 - protein, 132 aa, Triticum aestivum
  Clone ID: PAT_TA_78841.pep
EFASRLDRVVADLGRKPLKVLVQVNTSGEESKFGVDPSGCVELAKHVKLNCPNLVFSGLMTIGMLDYSSTPENFKTLANCREGVCKELGIPEEQCELSMGMSADFEQAIEMGSTNVRVGSTIFGAREYPKKN

SEQ ID NO: 184424 - protein, 60 aa, Triticum aestivum
  Clone ID: PAT_TA_78842.pep
YYTEGFLVDILNSHKLLCSSTELIHGELRPSSACSAASCSCSFQPSNSCIFSAISCSSRQ

SEQ ID NO: 184425 - protein, 187 aa, Triticum aestivum
  Clone ID: PAT_TA_78843.pep
GTESSGFMYPSAVDHFKKQFAYLEEHYAKGSTGTPPERQHNSLPRPSVVYSDNRSQTTANITEDLSKCIIRENTQKPHQHSAYVASKFPPHVPQGVVARPGKAVGSVMQYNPYPASAAEQYEQRRIARHPAVAPNNIPSGSSYPRRSQTCKSETGDAERMDVNQAGQPKPYAANKLPATVDGRGGHW

SEQ ID NO: 184426 - protein, 89 aa, Triticum aestivum
  Clone ID: PAT_TA_78844.pep
PFLVLFTQSKCTSPFLVEMTATRWWQLIIPTRMEGFTKYEEAQREHPGLSWGLCVSETSWQTAHQGLCCYCEQEQEPVAAAAAAVADIE

SEQ ID NO: 184427 - protein, 129 aa, Triticum aestivum
  Clone ID: PAT_TA_78845.pep
LKELEHQKSESQKMTAMVAERDALYQELLQARANLEFEKKAKPELTAQVQAMEKDLVAMAQEAEKLRADIAKRNTPSSFSTRGTYGASLSTPAMGLQGMYDGSYPTVGSRYGSGTGAWSSHDPHGYPHL

SEQ ID NO: 184428 - protein, 94 aa, Triticum aestivum
  Clone ID: PAT_TA_78846.pep
FFFFFFEQVTSRCKMICISLFLGLYVRCTQTVSASHQSSWLSSEARRNSGMDISNEIKYNLRLQSVDKRHPIPTTQLCVWSRSLPIGYNSTSGR

SEQ ID NO: 184429 - protein, 84 aa, Triticum aestivum
  Clone ID: PAT_TA_78847.pep
VFLLNCSSNSDLCVQAERSWCGVLQDERLAVYVKHLRRGQVRLLHAAEVGHRVGGCSDGALQIVSPTAVLHDGSHGGQQAAVGD

SEQ ID NO: 184430 - protein, 58 aa, Triticum aestivum
  Clone ID: PAT_TA_78848.pep
VKCFGKTEKIGLEFSNIYVAVCVQFATVTIISVNSLLLCGRYLHCICVVAKKKKKKKK

SEQ ID NO: 184431 - protein, 173 aa, Triticum aestivum
  Clone ID: PAT_TA_78849.pep
HAAAYRFLLPSNASHNSLKQTLLMEDFSEAMHGFLPVAMRDLRKYAPDDKDGGWEDVGGLNEAVTIIKETLELPSKYPNIFTKAPVRLRSNILLYGPPGCGKTHIVRAAAAACSLRFISVKGPELLNKYIGSSEQSVRDFFAKAVAAAPCLLFFDEFDSIAPQRGTHSAGVSD

SEQ ID NO: 184432 - protein, 147 aa, Triticum aestivum
  Clone ID: PAT_TA_78850.pep
SHTAFFCHAASPVSPYVCPLSCRFRAIYELSYLYQLPALARVTTTYRVCTAGARQGAHLRLISLFLRIMRADLQQGRREDGDHLAERVSGVAVPHLRQREASALHCVAQLIHGVEELVGKDSERLLMLFALAEGDHTAEVNVQEGGL

SEQ ID NO: 184433 - protein, 188 aa, Triticum aestivum
  Clone ID: PAT_TA_78851.pep
SLAAGCRRAGTGCYAAELRVALLLGAPLRRLRWSRGCFGCAQPTPIIAVDEPAKGLRIQGRSVKRHNLSDDFWSSSPHEMENSALQSRHSMSSISTAAQPNDQHASGSSSSPNDFVNQGLLLWHQTRQHWIGKRRRNSQGQQSQEPKISGNATYESLLGSSKPFPQPIPLGEMVDFLVVSWEQEGLYD

SEQ ID NO: 184434 - protein, 51 aa, Triticum aestivum
  Clone ID: PAT_TA_78852.pep
QPSPNQFSSASRRSFIRTPWFLECFTIVAVEAHVPMAGAPVPPSALPCLAF

SEQ ID NO: 184435 - protein, 98 aa, Triticum aestivum
  unsure (1)..(98): unsure at all Xaa locations
  Clone ID: PAT_TA_78853.pep
NALSPRPASGTRPPSPSPPAWPPPSPSPPPPRPSPPPRPRAXAPPPGAPARPRPAVPGPGPPRGLRPRREPPVGRRPRRDGRLRRPGPGHHHPSSRCH

SEQ ID NO: 184436 - protein, 188 aa, Triticum aestivum
  Clone ID: PAT_TA_78854.pep
MAAPKPIARLISHVILDLDGTLLNTDCVVSQVLKPFLVKNGKKWDSKKAHKLVGKTPYEAAAVVLEDYGLPYSTEEFLSMLTPMFNEQWCNIKALPGANRLIKHLKSNGVPAALASNSPRSNIDAKISCHQGWKESFSAIVGGDEVEKGKPSPDIFLEAAKRMNTNPPNCLVIEDSLPRVAAGKAAGM

SEQ ID NO: 184437 - protein, 125 aa, Triticum aestivum
  Clone ID: PAT_TA_78855.pep
NCHRRYPASFPWPQHRAPAPHPPTPRLRPARVPRSAPAPLASNDETTPSRLSPPPLPHNYPRCLPLSHGPSRVTRPTGQRHGKLPLSAVNPTARPRLTRLGFGLIIPHRDSAATFLTTHKKKKKK

SEQ ID NO: 184438 - protein, 89 aa, Triticum aestivum
  Clone ID: PAT_TA_78856.pep
RPAAMAPVLTWCWCSHCGVDRRLRREGDYASCSSCGKVLLQLRGDDDAAAAEAPRLRLLLGPRMRRTKKRAAAADAAGGGGVAAGGGGG

SEQ ID NO: 184439 - protein, 170 aa, Triticum aestivum
  Clone ID: PAT_TA_78857.pep
QCIFGRIGSVRVRTLPSVPENNETDASFDIDVQMGSGTGFQYEAPEEYYTAGSVTLHCPTTASSEIIASVALDQTALANHQEDYQMSFTNNGPSLGHWYPEQEHLMASQYASPFPLIMQAGDPVLSTQSSFNIDEFIKDLPHDKYQFCAPDVSMLPTDIGCSMTKLPAYR

SEQ ID NO: 184440 - protein, 58 aa, Triticum aestivum
  Clone ID: PAT_TA_78858.pep
RGVKQSSWSPRAPRFMAVVGTGSRVVVHLDVHPRRHLAEVSIFHRTLILLGRHLQSRV

SEQ ID NO: 184441 - protein, 76 aa, Triticum aestivum
  Clone ID: PAT_TA_78859.pep
PQYKENNYQDECIKEVSVAKRIQVSHDQNKTKMLSINANETTNLQGNHVYGYHRTHEHGPDDVYNQERKHTTKIRE

SEQ ID NO: 184442 - protein, 186 aa, Triticum aestivum
  Clone ID: PAT_TA_78860.pep
ADVLLWKDKKTSAVVIGGATVIWVLFEVLDYHLLTLISHALIGVLAILFLWSKATTFIRKSPPDIPVVQIPEDLVVNVSRALCNDINRALHLFHEIAMGHDLKKFLFVIVGLWVNSVFGSSCDFLTLIYIAVLLLHTVPILYDKYQDKVDHFAGRAHTEALKQYEVLDAKVLSKIPRGPVKSKKQN

SEQ ID NO: 184443 - protein, 112 aa, Triticum aestivum
  Clone ID: PAT_TA_78861.pep
AVAASNKSSSKPRLSYPDLEEQALQFILDCCEPNIAKYTKYLEGGGGSPEVSMNAKQANRTLLLKQVARDLCISERRILYRTQYILRRRLRDMRGGELRALSLFNGLRKLFK

SEQ ID NO: 184444 - protein, 214 aa, Triticum aestivum
  Clone ID: PAT_TA_78862.pep
ARGSEYPKGVVIEEVVDDASEPSSSQRSSSPGYTVSQPPEEGNSRPSGSSSIDANGLSKLGMQGMSPELVKTASDMIGTMKPEELQKMFEAASSLHGTSSSPPNLGPNMPEMSPEMFKMASDMIGNMSPDELQNMLNFASNMGGPSASPLRPENKLQSSSRATTSSTSQRSVDNSQPSSSQNVMENPHEILSNQRMGESSSPGAPSTADMQETM

SEQ ID NO: 184445 - protein, 167 aa, Triticum aestivum
  Clone ID: PAT_TA_78863.pep
SSFLPVNPQDPPLDPFLVHTLTIRFEPKKQRPGDSSEGASDQRNFELKMEFIKALPSGQETEIVLVSCTGSGIEANRREQVLKAKKAGEDALRRSGLGYTFVRPGPLQEEPGGQRALIFDQGNRISQGISCADVADICVKALHDSTARNKSFHVCYEHVSEQGSERI

SEQ ID NO: 184446 - protein, 78 aa, Triticum aestivum
  Clone ID: PAT_TA_78864.pep
TNCNQLTPWRVVLSLNYMDPYYRHQSMGVVGWNCMVKRVLLVSVAKLHTLNRDIEQTGLVIELHTYICITGMRIACIM

SEQ ID NO: 184447 - protein, 183 aa, Triticum aestivum
  Clone ID: PAT_TA_78865.pep
RLGDFGLAKLYDHGIDAQTTHVVGTMGYIAPELARTGKASPITDVFAFGVFLLEVTCGRRPVEHNRENNTVSMLVDWVLEKWHKGLLTKVVDPRIQDEFDINQTILVLKLGLLCSHPVPDSRPTMRQVMQYLDGDMMLPEQMPESLTLGMQFMMQSEGFDSYIMSQATTMVSHGTLTDISGGR

SEQ ID NO: 184448 - protein, 33 aa, Triticum aestivum
  Clone ID: PAT_TA_78866.pep
SEKQYHHDQYLNILKNLVCCSTNQIVLDFNIAN

SEQ ID NO: 184449 - protein, 72 aa, Triticum aestivum
  Clone ID: PAT_TA_78867.pep
LCTSEKRKIHLLSCTIIAPYRAYQYKMDIFKQVTSVIIHRALSLISSRSAEQALTRFCHELNFVTSISCMNH

SEQ ID NO: 184450 - protein, 210 aa, Triticum aestivum
  Clone ID: PAT_TA_78868.pep
FVDQCHGSIPSTDYYYMSARSLSSSPVPTAGTWLGSNRQSSRTPPQTNDQRGSLVGEIAPAHSAPSTVTKNALSVAPWMGLLLGMCLLHILVGNTHREMPSGTVIPVGRRLLLFVDDHGNSSLSHGSGSEIGSFLGWAMAIIYMGGRLPQILLNMQRGHVEGLNPLMFAFALVGNSTYVGSILVNSMDWSKLKPNLPWLVDPGGCVLLDS

SEQ ID NO: 184451 - protein, 72 aa, Triticum aestivum
  Clone ID: PAT_TA_78869.pep
LALLAEVKFLRRKYQSFLKGGSQQKHYKLKKQARYMPSPLGSNKATALGDHGARTKVPSTSKNSNLHLNQDS

SEQ ID NO: 184452 - protein, 136 aa, Triticum aestivum
  Clone ID: PAT_TA_78870.pep
RLSVTTLPPSSYRLGVRPSNLHELFPPYITEALQQSIIMIDREMPGFVSSKALLHGVETRTSSPLQISRHGETYESTSLRGLYPIGEGAGYAGGILSAAVDGMYCGFALARQLSLFHGDIESFLGKAQKQTGFVKY

SEQ ID NO: 184453 - protein, 80 aa, Triticum aestivum
  Clone ID: PAT_TA_78871.pep
PLCPLVLCRSLAPHIILSVLQGASRSLESCGCWWWSGPRSRPRRRPCSGSQAVAHEPRHKMQVPEICKNFRLLLLANLEV

SEQ ID NO: 184454 - protein, 185 aa, Triticum aestivum
  Clone ID: PAT_TA_78872.pep
ERGGLTEMVVRDKILVFRFTNVGKLPLPVLQFVEVTFGYTPDNLLYKKLDFGVDLDSRIALVGPNGAGKSTLLKLMTGELAPLDGMVRRHNHLRIAQFHQHLAEKLDLDISALQYMMKEYPGNEEERMRAAVGKFGLSGKAQVMPMRNLSDGQRSRVIFAWLAYRQPQLLLLDEPTNHLDIETID

SEQ ID NO: 184455 - protein, 90 aa, Triticum aestivum
  Clone ID: PAT_TA_78873.pep
FFFCFFFFFPLTCSKSVDAFYNQLVLYRYAKTSLATSMWFLQAGLSISLCDCSRTNHSKAYTQIHCGELASRMPCDISILKRQTTQPGRQ

SEQ ID NO: 184456 - protein, 52 aa, Triticum aestivum
  Clone ID: PAT_TA_78874.pep
RAMGSSGGHFFVDTCIIYSTPHHTTPHTHHDELSMKLSMQLIKYSMLVLPRC

SEQ ID NO: 184457 - protein, 37 aa, Triticum aestivum
  Clone ID: PAT_TA_78875.pep
LQFILVYRMSWYSLRHPVMYTYDGLYKVVDDWVQKGV

SEQ ID NO: 184458 - protein, 179 aa, Triticum aestivum
  Clone ID: PAT_TA_78876.pep
PRVRESARYADEVLSEDLPTIISGISFPKSMRWNSNIVFSRPVRWIMALHGDLVVPFSFAGISSGSQSCGLRNSSLANFKVETAESYLHTVEKAGIVIDVQERRAKILDDSSTLARGVDGDFIAPDSLLQEVVNLVEAPVPILGRYDDSFLELPKDVLTTVMQKHQRYFPVTSKSTGDL

SEQ ID NO: 184459 - protein, 79 aa, Triticum aestivum
  Clone ID: PAT_TA_78877.pep
MQLAPEATLGRNRGSPKDDRTPERARVELPNSGQVKQAGEGTIRMDMSLLSCRVCYHPVKPPVFQCNVGHLACGTCLAE

SEQ ID NO: 184460 - protein, 106 aa, Triticum aestivum
  Clone ID: PAT_TA_78878.pep
SSAPSKSSSLVLHGDFLDTLYLLVNIVRHNRMVNIFVYQSSCNSTSALLGFMSIGNRCRSLCVVPNKRSRSVLHRVFLKMLTLCSDTIYHNRMVNTIFFHCLCGRV

SEQ ID NO: 184461 - protein, 159 aa, Triticum aestivum
  Clone ID: PAT_TA_78879.pep
KPEDKLELPGKQKPAVAAERQMIKDFDDKKRSLDSFEDLDAKSPTGGSFKIGECIRRAASQLTGPSPIAKSQNENTAEAENAEFDVSSDDAANELTVEKCAKRRRLHSHHLADPKELFSQLCSVAIEPTDGYNFSALTISYFSDFRNYVVSVATEASII

SEQ ID NO: 184462 - protein, 143 aa, Triticum aestivum
  unsure (1)..(143): unsure at all Xaa locations
  Clone ID: PAT_TA_78880.pep
MVLLIPNSRFDGATDAVGIQFFLENVHPRMXAAASALFGLPDSLYARPNTFGELMRAIISPSSKVQEAVDWALKGANPDIVLHTRMMANRPVRARKAAVLCIKRALQIRNTKGAPLVALVSDTPAFVKEIKSDISEFAEVLYF

SEQ ID NO: 184463 - protein, 37 aa, Triticum aestivum
  Clone ID: PAT_TA_78881.pep
AVIILCHQIDGSYLKSVSMYAKIYARLCFLKKKKKKK

SEQ ID NO: 184464 - protein, 37 aa, Triticum aestivum
  Clone ID: PAT_TA_78882.pep
QIALQLFAEKKYPVIILPHVVAQSLDFPCWEVSSYCR

SEQ ID NO: 184465 - protein, 159 aa, Triticum aestivum
  Clone ID: PAT_TA_78883.pep
PRVRIQIRETANGSITLAGVTEAEVKSKEEMALHLARGSLSRATGSTNMNSQSSRSHAIFTISIEQKRTSSSASEKSTSNEYDILSSKFHLVDLAGSERAKRTGADGLRLKEGIHINRGLLALGNVISALGDEKKRKEGAFVPYRDSKLTRLLQDSLGG

SEQ ID NO: 184466 - protein, 65 aa, Triticum aestivum
  Clone ID: PAT_TA_78884.pep
QIHTCILLISLIVLCALSVDICCLHNKLISAYSILIELWSSVLHRVCCSFDCSSLRVMVECYIAW

SEQ ID NO: 184467 - protein, 104 aa, Triticum aestivum
  Clone ID: PAT_TA_78885.pep
TWSPEALGLLNDASNASRLLRGGAGREILMPPVVRPTGRGRLRLCPIGPARPPRSPLAQPSPASNARLGGVPPGSWSLHELPEKRPTGHGSRLPRRSWGLADAW

SEQ ID NO: 184468 - protein, 110 aa, Triticum aestivum
  Clone ID: PAT_TA_78886.pep
PRVRRQIEDPMFVDITNLEQIRALVASLEAGLRFTTCITSLMPILIQLLASSSATDVENTILLLMRCRQFQVEGSEAALRKMLPLVFSQDKSIYEAVESAFIAIYTKRIP

SEQ ID NO: 184469 - protein, 97 aa, Triticum aestivum
  Clone ID: PAT_TA_78887.pep
HASENFSKISNFLQHKTTADCVEFYYKHHKSDSFREVKKLLDLRQQQPTGNYLGTKSGKKWNPENAASLDMLGNAASVVAAHGLDYANRVQKDTAKI

SEQ ID NO: 184470 - protein, 56 aa, Triticum aestivum
  Clone ID: PAT_TA_78888.pep
ISRAIRPEAPDQNTTHARTRKAAESTWGSSRPNDLASPVRPAARRVGARGGEERGN

SEQ ID NO: 184471 - protein, 118 aa, Triticum aestivum
  Clone ID: PAT_TA_78889.pep
TGPEFPSRPTRPQYAGPGLFEQMTHAQVLGMFSGVNGRANGFRHGHQLTEESVKIVQNGVIGKAATTTSPLQEADHDPKGSYPQDDNRSASPSFNAAGSPPRGKAAANPKQPDLVLQL

SEQ ID NO: 184472 - protein, 59 aa, Triticum aestivum
  Clone ID: PAT_TA_78890.pep
RSGFPGRPTRPREEQSIFLGRKPSWRDAVQARTNTPASPTTFSIEPAGPVKPYTRNPPP

SEQ ID NO: 184473 - protein, 52 aa, Triticum aestivum
  Clone ID: PAT_TA_78891.pep
GSTHASDAACNAKELLERQLYSANAEVQKLHGIIKSLENQVEEEKALHDELM

SEQ ID NO: 184474 - protein, 95 aa, Triticum aestivum
  Clone ID: PAT_TA_78892.pep
RSGIPGRPTRPPKARTLTGSSDPCYIEAYHLADPTDGRITLHLKILNLTELELNRVDIRVGLSGALYYMDGFSRTVRHLRNLVSQDPVQSSVTVG

SEQ ID NO: 184475 - protein, 65 aa, Triticum aestivum
  Clone ID: PAT_TA_78893.pep
LHDHTLCVEAGQLEFRTHLGIVVKTAAKSSGCEPDLETALPEEGSTTAIAQTSLPCRALSNCGRV

SEQ ID NO: 184476 - protein, 60 aa, Triticum aestivum
  Clone ID: PAT_TA_78894.pep
DSLYTGLKALEYHSKGKKGRTKIAELDELPAPMVNVDMDIFVLAGDVITLLERAALEPLP

SEQ ID NO: 184477 - protein, 97 aa, Triticum aestivum
  unsure (1)..(97): unsure at all Xaa locations
  Clone ID: PAT_TA_78895.pep
TRPDVWMGPSQAETXVTKAALTFGCSAWVRAGSGGHGRHHVNVCLGVYDQWVNGGQIEAAGDQWYEIKGAFKLEKKPSKVIAYVQGPPPGVDIRVMG

SEQ ID NO: 184478 - protein, 164 aa, Triticum aestivum
  Clone ID: PAT_TA_78896.pep
HASAAGVWKRLQKRLKQQNISFTDLIFPNIKVICKELLSKDGLFSSNKQEQRAALCSLATLMSISPNDTFVEFEKHFIELPDRTLHDGFSENDIKIFFTSEGQLSTEQGVYVAEAVASKNTKLAKGRFRAYDGQDAEPAKSDKRESSSIGKRETGKFTKKTAPV

SEQ ID NO: 184479 - protein, 94 aa, Triticum aestivum
  Clone ID: PAT_TA_78897.pep
GRPTRPAAATAASPLHDSRTFALQQGELDGRFADAGEKPAAPSEEPAEAEAEEDDDDDEDDDEEYWSYHDVGEALDWLDAAEGPDGSTRLSSTF

SEQ ID NO: 184480 - protein, 47 aa, Triticum aestivum
  Clone ID: PAT_TA_78898.pep
MMGGRAVLLLVISALFAQIGASDPLFHEFFNESFDGSWIVSGKEEYK

SEQ ID NO: 184481 - protein, 170 aa, Triticum aestivum
  Clone ID: PAT_TA_78899.pep
RNSRVDPRVREGKLAVPFSASIFLGFDADPSLNVAARIRGPNDQYINHIMNETGVTVVLRGKDSGNLGNCHAEASQQPLHMHLSGVHLKSLEAAKVLAENLLDTIAAELGASRISSSKVYGAVPPPQQLLTGVHTSGTSDICVSTGASHSFAPTGVTSPIAAPSVTLQSG

SEQ ID NO: 184482 - protein, 68 aa, Triticum aestivum
  Clone ID: PAT_TA_78900.pep
NYTKLHILLNLPVLLALYTGLLLLLSPASYPSLASHHIVTGAPRSWPLLHPATCASSGAPASLLRTRG

SEQ ID NO: 184483 - protein, 66 aa, Triticum aestivum
  Clone ID: PAT_TA_78901.pep
PRVRVNLRCPMTGSRIKVAGRFKPCVHMGCFDLEAFVELNQRSRKWQCPICLKNYSLENLIIDPYF

SEQ ID NO: 184484 - protein, 84 aa, Triticum aestivum
  Clone ID: PAT_TA_78902.pep
VDPRVRRGEPEQPASCLINLLSSHRVLTYKPCPRAAAAAAPYPSVTADASNPHARLSRAWPPSPFPSFLLGTSRSCCLHPARSL

SEQ ID NO: 184485 - protein, 115 aa, Triticum aestivum
  Clone ID: PAT_TA_78903.pep
MAPIKIGINGFGRIGRLVARVALQSPDVELVAVNDPFITTDYMTYMFKYDTVHGQWKHHEVKVKDSKTLLFCQKEVAVFGCRNPEEIPWAAAGAEYVVESTGVFTDKDKAAAHIK

SEQ ID NO: 184486 - protein, 105 aa, Triticum aestivum
  Clone ID: PAT_TA_78904.pep
VILHTTLSPLESRNVKQRRGGSTPGLAIATHGCHASSRSGSPARCSPRSAGFRRGARYSPWSPAKVARLPLYRRVDDQLAPIFHSTNGQIAADRDAIPCQQQGTA

SEQ ID NO: 184487 - protein, 69 aa, Triticum aestivum
  Clone ID: PAT_TA_78905.pep
MVPLNNDQGPQPPSVSWPDAQSGMVDPLQGSPAREEGEVPESELDPDTRRRLLILQHGQDTRDPTPPFA

SEQ ID NO: 184488 - protein, 43 aa, Triticum aestivum
  Clone ID: PAT_TA_78906.pep
MALTSQSLFFTPSPAGPSRRGRGRPVTMSAAASHNSQPRNNPF

SEQ ID NO: 184489 - protein, 120 aa, Triticum aestivum
  Clone ID: PAT_TA_78907.pep
VRNPGSTHASVIVITKLIDSVLEDCGISSGMTQDQESVYPIEGPQPMDMDVKGVSAVKQNEQREQLRRRNTVMALEVLHIMAADTKIQAFLRLICLNMPDKFSVLSHRLTLIEAHKMALE

SEQ ID NO: 184490 - protein, 102 aa, Triticum aestivum
  Clone ID: PAT_TA_78908.pep
NLLRRFCGKYGQNQQKIISRLKEDCRDDRITVEINFQNNEVVLFATEQNMEKVFCTVNSALECECKILRNECLERNLFPGRPGSSPIALFGSGAEIKHLELG

SEQ ID NO: 184491 - protein, 32 aa, Triticum aestivum
  Clone ID: PAT_TA_78909.pep
PANVEHVAINYLVTFLVISPFQVSQSLHNLNA

SEQ ID NO: 184492 - protein, 89 aa, Triticum aestivum
  Clone ID: PAT_TA_78910.pep
DPRVRSTDYLSPLQTPPPLPSPPLGSSARLGLHGRPTGAREDGFVQVRVSAPAGPADRRRLPPGGLLAAPTPAQRRGPRRPGREPHGRL

SEQ ID NO: 184493 - protein, 99 aa, Triticum aestivum
  Clone ID: PAT_TA_78911.pep
PARWGRRRWRRRAARRPWPPFRPDPALLVFRVVPLPQLLRRELEFQLESLKPTNKTNQSISQSVSIRSEFDQAAAAAALFLPHSTRKLHLKRTNSRGRV

SEQ ID NO: 184494 - protein, 82 aa, Triticum aestivum
  Clone ID: PAT_TA_78912.pep
ARGPPRRRPPRTAVPPSPPPPPRPSAAPAPATARGPPPPAAPRRSPASCPWPVAGTLSRLPETTSAFARQSLRPVCSLCRTR

SEQ ID NO: 184495 - protein, 87 aa, Triticum aestivum
  Clone ID: PAT_TA_78913.pep
YKMPMSGNQTQSSDFELVASQPDAQCLVCTRPFTLDTEVTNSFEALAICRECKATVLNDSQRDVTTSTSQQRRQRRRRSSTASLESN

SEQ ID NO: 184496 - protein, 56 aa, Triticum aestivum
  Clone ID: PAT_TA_78914.pep
KGVESSGEDFASLSITNKDIALPPGCPTSKQSCQHMNHIVFGKTMVSRLAFSRTRG

SEQ ID NO: 184497 - protein, 143 aa, Triticum aestivum
  Clone ID: PAT_TA_78915.pep
VRNPGSTHASAFGVIVRVESEAFQVLKGVPDKPEVVLVKLREIKYKIDRRTSAKDSKNNTVSTKDIVMVIEGPCKGKQGPVEHIHKGICFIHDRHHLEHSGFICAKAQSCVLVGGSAVNSSRMGVDTADPRLGAFRSPARILQ

SEQ ID NO: 184498 - protein, 95 aa, Triticum aestivum
  Clone ID: PAT_TA_78916.pep
PTRPRARVWLLYEAYNELQRLAAELGGAAVPAPAVVVVGHQTDGKSALVEALMGFQFNHVGGGTKTRRPIALHLRFNPRCHSSNCRLLSGSGEGD

SEQ ID NO: 184499 - protein, 70 aa, Triticum aestivum
  Clone ID: PAT_TA_78917.pep
IVHLIGTSIQGKSKDSKQYAARVLPQLRILLVSPIENSRVQHTTSKTSFQAFMGSVYLLSSPQNDEETSN

SEQ ID NO: 184500 - protein, 121 aa, Triticum aestivum
  Clone ID: PAT_TA_78918.pep
PRVRDGSRWSKLPAAAADVTDLPLLPDDVEECAGAAERALRSAGATLPQPQAGSNNGTTCDVPFCYCGIRLRRPVCALPAGRAARRLERDCARPGLAGCSRCLRALNLLNAIGEKNATSGK

SEQ ID NO: 184501 - protein, 52 aa, Triticum aestivum
  Clone ID: PAT_TA_78919.pep
TYYKEFTESGSWSSFRTVNAPSSFRCGHYYKKNIVMLSSLVESRTLQQHKAT

SEQ ID NO: 184502 - protein, 149 aa, Triticum aestivum
  Clone ID: PAT_TA_78920.pep
HASGLKKVLEHVSTVQDLCSVLKMEHFSIITEVHDSLDDSVGKDHKSISNDTLSKLDRTIATLNEDKMLRLKKLQELATQLNDLWDLMDTPMEERSLFDHVTCNRTASVEEVTAPGALALDIINQAEIEVQRLDELQYSKMKEIAYKKQ

SEQ ID NO: 184503 - protein, 129 aa, Triticum aestivum
  Clone ID: PAT_TA_78921.pep
HARTQDTRQSAPMGAAAPLTLRDFLEMACESSCSDGFRSYPRRVLPCPSSSDDGALATQAKLKEETAPVRLLIEADLRRSPSRTLSSILFPRSPRSLAAISRLSRTLSRRLVFWRRHPGEDDGSERDSL

SEQ ID NO: 184504 - protein, 120 aa, Triticum aestivum
  Clone ID: PAT_TA_78922.pep
MGVLRSTQSMQAEVEEMRAALFHGGGWRPSAGDSDVKRAAGGDEGAAGPRTVCVTGGISFVGFAIVDRLLRHGYTVRLALETQEDLDKLREMEMFGEDGRDGVWTVMANVMEPDSLHRAF

SEQ ID NO: 184505 - protein, 88 aa, Triticum aestivum
  Clone ID: PAT_TA_78923.pep
GGGARDGVGEGAAGGGGGMVVVVRRGRGCRRAGRAGAEVAPRVVVWDLGSGSGSGDGRREGRGIRKLLYSFLRCSSACASRMISSDAW

SEQ ID NO: 184506 - protein, 131 aa, Triticum aestivum
  Clone ID: PAT_TA_78924.pep
THASGQSVNWMAQSARAKGAKTRTAWFRWPTLKLCSTELRKEIVGKKKARRRDAAVGLFVFPAQSRVTGAKYSYQWMALAQQNGWHVMLDAGALGPKDMDSLGLSLFRPDFIITSFYRVFGSDPTGFGCLL

SEQ ID NO: 184507 - protein, 144 aa, Triticum aestivum
  Clone ID: PAT_TA_78925.pep
MTPSPPKHVTNLFRTSVPPVVSFNLGSLGFLTSHIFEGFRQDMRAVIHGNNTLGVYITLRMRLRCVIFRNGKAMPGKVFDVLNEVVVDRGSNPYLSKIECYEHNHLITKVQGDGVIVATPTGSTAYSTAAGGSMVHPNVPCMLF

SEQ ID NO: 184508 - protein, 189 aa, Triticum aestivum
  Clone ID: PAT_TA_78926.pep
TRPAAKTLRAVLSWRETIGADHIIADEFSGELSEGMAYVAGHDDDNRPVLMFKIKQDDYPKYQPQKSFVRFLVFTLEVAVASMNRFVDQFVLLFDASFFRSASAFLNLLMGTLKIVADYYPGRLHRAFVTDPPSLFSVMWKGVRPFVDLAPATAVVSSLDFEDSLEDASFTAYPRTASLRFEPSVAAVL

SEQ ID NO: 184509 - protein, 64 aa, Triticum aestivum
  Clone ID: PAT_TA_78927.pep
GTGGGHTKNPPSNGTYTIYFFWGTYTIYQKTGGRLPRATINSRFPLKTKEKKNETSKEPKNPLL

SEQ ID NO: 184510 - protein, 74 aa, Triticum aestivum
  Clone ID: PAT_TA_78928.pep
VRLVKLETEIYMQSQLTEKSVNRLFGSVFGLNRIWALRLRSSLRAAMDALSSSGPLLCERRWSDDAWTDECVLL

SEQ ID NO: 184511 - protein, 96 aa, Triticum aestivum
  Clone ID: PAT_TA_78929.pep
MPPGTPLPSTGAWTWENAVAGATAGFATVATFHPLDVVRTRFQVSGGRGLSDLPPYRNTGHAVYTIARSEGLRGLYAGFYPAVLGSTVSWGLHFFF

SEQ ID NO: 184512 - protein, 37 aa, Triticum aestivum
  Clone ID: PAT_TA_78930.pep
EGSQTCTPNYKLTIPNLRWVYMYREPSTFTPNYKRTR

SEQ ID NO: 184513 - protein, 77 aa, Triticum aestivum
  Clone ID: PAT_TA_78931.pep
DNFKLLPDLLSSYSMYVQCHLCMKCCTAVLPLFIHQRIAPCVRIITIHGQATFAQDSSHYHILTPNKIYNYLQKINK

SEQ ID NO: 184514 - protein, 176 aa, Triticum aestivum
  Clone ID: PAT_TA_78932.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGTA

SEQ ID NO: 184515 - protein, 136 aa, Triticum aestivum
  Clone ID: PAT_TA_78933.pep
PRVRSAPKPKSSSKPSQPKPGQASRMASSAFKSTTRRNLHGSADRPVQPPPHCPRRSRSVTPAPRRERLLGDYAGTTRTNPLFDRGGRAFSPPPPPEDSGDRGRKESRGRGSRKARSVSVAPPQRRRAATSAPSSA

SEQ ID NO: 184516 - protein, 136 aa, Triticum aestivum
  Clone ID: PAT_TA_78934.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYT

SEQ ID NO: 184517 - protein, 87 aa, Triticum aestivum
  Clone ID: PAT_TA_78935.pep
TQAPPRYSPCPRSQAPSRGEEPPQATAPPLPSCPYPSSSRSRSTPPPQVAAPATRPRRSSDLAGAPTSSEMSSRHPVSSPPPSDCLP

SEQ ID NO: 184518 - protein, 133 aa, Triticum aestivum
  Clone ID: PAT_TA_78936.pep
PRVRAFSTRSTIEFDVYSYGVVLLELITRKMALDPSFPHDVDLVSWVSSTLNEGNVIESVCDPALMREVCGTAELEEVCSVLSIALRCTTEDARQRPSMMDVVKELTRARRDAVSLPKQAISGSSSSCLNLAT

SEQ ID NO: 184519 - protein, 90 aa, Triticum aestivum
  Clone ID: PAT_TA_78937.pep
PARRRHGRRRGAGGGGGGGGQLGIGAGPPVLPVAQPRRRPPGTRRGFRWGRPGPGPRSARAWSGSGWVGICVACGQVQVGRVRVIGRVGR

SEQ ID NO: 184520 - protein, 93 aa, Triticum aestivum
  Clone ID: PAT_TA_78938.pep
PRVRDWCESFNTYPRTYDVLHMSDLLGSLTKRCDILEVAAEVDRILRPGRWLVLKDTMDMMKKMRPILRSLHYETVIVKRQFLVATKSFWRPR

SEQ ID NO: 184521 - protein, 190 aa, Triticum aestivum
  Clone ID: PAT_TA_78939.pep
MQDAAHDPSAATFYSAAAGLYASTHPPVPLPADPGLSFVPHIFSRLPLGSAPPHSPPCLLDAATAASLSRADLRRLVSSLARGLRRAHNVRAGSVVLLVLPNSVAFPVAFLAVLAAGGVATTMNPSSSRAEIAERLRDTAPSLVLASPENAAKLPPSAAPVVLVPETFNPTPSAGHEFAPFRALLDSDAD

SEQ ID NO: 184522 - protein, 96 aa, Triticum aestivum
  Clone ID: PAT_TA_78940.pep
PHPSHHHQPPPPPPKIARENISLAPALLLQIAPASAPKTIPFPPSPKPPTIPRGRSESLAARLSPRLPRPRPRPLLPRPAPATCSTEGPAGRRDVT

SEQ ID NO: 184523 - protein, 81 aa, Triticum aestivum
  Clone ID: PAT_TA_78941.pep
MPRKERDAEGSRSSSRRRRSPSDSDSDSDSGGSPRRGRSRHRRRSRRKAAPPSSSSSSGASDSQASGSGSHSGDRRRRRSG

SEQ ID NO: 184524 - protein, 189 aa, Triticum aestivum
  unsure (1)..(189): unsure at all Xaa locations
  Clone ID: PAT_TA_78942.pep
HASAFTPLTNEKKGVLLNGSSEIPSRGETGRLGSAAPVARSQSHKFLTLDLQLASRQNVKINSNSPVKKEKLDQGFSIFPSARPPKDVQTTSGMESSSXSSLGKLSNLDLNVSLDPVDQLEGLPTMQAGFNIPHHTTIQHQKAQVPPVAPFSSVSSRLSLNIDNTLKPSSAYQLPNKSVAADVTLDLQL

SEQ ID NO: 184525 - protein, 34 aa, Triticum aestivum
  Clone ID: PAT_TA_78943.pep
LIDMKIRVGQFNVVPSAKLCTITNLDTFLVKDEY

SEQ ID NO: 184526 - protein, 80 aa, Triticum aestivum
  Clone ID: PAT_TA_78944.pep
EVKEGPRPLPEASVAALRQLRDALAGARELLRLGSNGSKIFLALEREKIMQTFQDITSRLEQALAGISFDELGISDEVRE

SEQ ID NO: 184527 - protein, 92 aa, Triticum aestivum
  Clone ID: PAT_TA_78945.pep
DSLLVQFSCGVATSVLPDLIDERSGDIEGDLPFPKRLKRVPSDVLQDVTSVEDITISLDNHVALAASSSTWKFNLGISGLPSGCDEKFYPLS

SEQ ID NO: 184528 - protein, 137 aa, Triticum aestivum
  Clone ID: PAT_TA_78946.pep
TRPIPSGEALGQESFAPPYLAPNSSAEVINSGANYASGSSGIFDETGSFYIGRVPLGQQISYFEKTRAQVLETMGENATADFLGNALFTVAAGSNDILEYLSPAVPFLGRQKPDPAVFQDALVAKLAFHLKVPLDHL

SEQ ID NO: 184529 - protein, 110 aa, Triticum aestivum
  unsure (1)..(110): unsure at all Xaa locations
  Clone ID: PAT_TA_78947.pep
TRPVKTYLHRVGRTARAGREGYAVTFVTDDDRSLLKAIAKKAGSQLKSRIVAEKPVSDCAKLIEQLEHQISNIILQKRDEMALRKAEMXLQRHKILIAHRDEIYSRPQEN

SEQ ID NO: 184530 - protein, 218 aa, Triticum aestivum
  Clone ID: PAT_TA_78948.pep
HASGEGVCSEYCECHGDCKNIWKHEEEVTEEFAEYTKRKADEAAAQAAAAQAAAAQPAADQAAAAQAAAAQAAAAQPAADQAAAAQAAAAQAAAAQAAAQPQPKPLPAQEPESKGEARNNSPSAVKMNWCSCRTSGCRIHRCPCFMHNAWCSSKCNCAATVCVNRSGAKGALAEKLQHRGIKREVLASGSVTSTATAGAVLANEGGKGCTCLLSKCTN

SEQ ID NO: 184531 - protein, 196 aa, Triticum aestivum
  unsure (1)..(196): unsure at all Xaa locations
  Clone ID: PAT_TA_78949.pep
PRVRALQNAAVDLDDVTLSLSKDGYRDILKMADNFSSFNQRLRYAHYRPSLPVKSDPKSWWKYAYKVVTHEMKKASGSLSWEQLLRNARLRKTYVSLYASLLKSDMSRPVVEDNEEINSLDRELDMEVILQWRMLAHKFVEQSAERQHAQQNKQSWWSFGWTGSSXDDGDSKSFSDEDWERLNRIIGYKENTEYIP

SEQ ID NO: 184532 - protein, 78 aa, Triticum aestivum
  Clone ID: PAT_TA_78950.pep
PRSSSCPRSLRRMLRSGAPRALPAAPLGAPRKPSRAPDSTGPIGESRRAARGAFAFAGDDGWAGWPRVIAGHDQRTRG

SEQ ID NO: 184533 - protein, 72 aa, Triticum aestivum
  Clone ID: PAT_TA_78951.pep
AVVCREVSAESELGGVERRTTKEDQGSPTWRSEARAGDGWRGPPRPGQASDIPAEGKMKSSFRWHCRSRTRG

SEQ ID NO: 184534 - protein, 135 aa, Triticum aestivum
  unsure (1)..(135): unsure at all Xaa locations
  Clone ID: PAT_TA_78952.pep
MMPKIADFGLSRXXGEQQSRFFTNNKEGTLGYMAPEYRVRGVVSYKADIFSFGVIVIEIITGGRDYPWDYSYFQQHSPNHTDPSFQQFTEKVLESWKNKFVTTPNYKPVEKYTKQVRQCVTIALICVDPGMEKRP

SEQ ID NO: 184535 - protein, 217 aa, Triticum aestivum
  Clone ID: PAT_TA_78953.pep
EQLHDYKMVDNRFVLDQAHEIQCIAKELELLKCELSDNFVAGCIIAKLPAGWRNFATSLKHLRREFSIEDVISHLSVERNSRANDSHVKGAEGSSSANVVQKNFHKFKGKNSFQQNTTFKKKGKKKDKKRDGCFTCGSEEHWANKCPNKYKKSGQDAKSVNVTLSNNDAATRYGNLFTVLSVCQSTDWWVNTGANIHVYADVSLFSSGRVGRPGIPD

SEQ ID NO: 184536 - protein, 168 aa, Triticum aestivum
  Clone ID: PAT_TA_78954.pep
PRVRGLISTYALETLVLYIFHVFNNCFTGPLEVLYRFLEFFSNFDWEKFCLSLWGPVPISSLPDMTAEPPRMDTGELLLTKAFLDRCNHLYGVMPRTQENQGQPFVSKHFNVIDPLRANNNLGRSVSKGNYFRIRSAFSFGAKRLAKLLECPNEDLIAEVNQFFTNTL

SEQ ID NO: 184537 - protein, 66 aa, Triticum aestivum
  unsure (1)..(66): unsure at all Xaa locations
  Clone ID: PAT_TA_78955.pep
FFFFFFFFFXQPNLVITEKEIVDQDSLQPLNPMPHNLLHAHNTLPGEEILSVAGLANGDTNRADAW

SEQ ID NO: 184538 - protein, 65 aa, Triticum aestivum
  Clone ID: PAT_TA_78956.pep
PPPPLSNIVFTVLFGFTDVDIFLYELDQALRSLTSEKIYTRYFWNGEYLVDEFTAHFKQIIIHKD

SEQ ID NO: 184539 - protein, 105 aa, Triticum aestivum
  Clone ID: PAT_TA_78957.pep
MDQQGAAPSSSTSTSTNSSRSTSDHPHHASAAAHHHPFYYAAAAATGATPPPPFMGSLAMVPAATPAGAQTANHSQSITVAEPPSEKKVAKRPTKDRHTKVDGRG

SEQ ID NO: 184540 - protein, 181 aa, Triticum aestivum
  Clone ID: PAT_TA_78958.pep
HASGAANAPSCPVCMEPWTSEGEHRISCIPCGHVYGRSCLERWLTQRGNASATCPQCGRRFKHKDIINIYAPEVAVPNNDLEKQLRFCRQKLESLEEVVLKQGKLLDEIISEKNHRSADVGVSKRQKIAEHSDGRTYLEPSASASAASASGNSCRFVLLKELSFDGARVMGIDASNQIILA

SEQ ID NO: 184541 - protein, 62 aa, Triticum aestivum
  Clone ID: PAT_TA_78959.pep
HASARTSLYLFILGLKIIDTKTSAIKRRFSFTITFVFKLNGNSTHIHASSMHFFTQQARGIK

SEQ ID NO: 184542 - protein, 151 aa, Triticum aestivum
  Clone ID: PAT_TA_78960.pep
MAAPAALDVSLERVATAPAVPPPGIGVDSATAEAEFLWELRKYVLLLATLAASVTYSAGLSPPGGFWPDNDADRGARLAGDPVLLVTYPRRYKAFFYCNATAFVASLVIVNLLLVRSLGHRRRWLRALQAAMLLDQFGLMGAYAAGSCRDA

SEQ ID NO: 184543 - protein, 139 aa, Triticum aestivum
  Clone ID: PAT_TA_78961.pep
DGAHRTQPSMQLQLIIYSWRNTGSASSVTKETTTLTNETGRKVRQRWSSDDCDRSQCTDGSSDNSQPHWRLARSGRKRKAEVANWRLHACICILQITDSEVPSEAVRARAELAVEQHLELSGRLCPTAVVGAAVHPDAW

SEQ ID NO: 184544 - protein, 59 aa, Triticum aestivum
  Clone ID: PAT_TA_78962.pep
MCAFLTCRYLIVVDDLWDTSAWDVINQLFPKCSQGSRIITTTQIEDVALACGWDHPGRV

SEQ ID NO: 184545 - protein, 67 aa, Triticum aestivum
  Clone ID: PAT_TA_78963.pep
MANPDDGGGRKFWRSASWSASRAAEAAGPEAAPLPPRMGPPPLTPRSKGRACLPPLQPLAITRRSLD

SEQ ID NO: 184546 - protein, 90 aa, Triticum aestivum
  Clone ID: PAT_TA_78964.pep
RVDPASDMTSYKKVVYLDADTVVVRSIEDVFKCGKFCGNLKHSERMNSGVMVVEPSETVFKDMISQVDRLPSYTGGDQGFLNSYYADFAN

SEQ ID NO: 184547 - protein, 93 aa, Triticum aestivum
  Clone ID: PAT_TA_78965.pep
GRGARRVKRSTKTKNSRRQQRPCALMRGAYLHSSRRQLNQWAHEINTVELTMEVQKPLKGSNMPTLFNAEGHPCRTWSGVCYCWFHQQFATSK

SEQ ID NO: 184548 - protein, 182 aa, Triticum aestivum
  Clone ID: PAT_TA_78966.pep
PRVRAEPVSKCDATTAVQFIKKVIFRFGFPHNIITDNGTNLSKGAMKEFCQREHIWFAVSSVAHPQSNGQAERANQEILRGIKPQLMVPLQRTPGCLVEELPSVLWSINTTPNRSTGYTPFFMVYGAEAVLPSDIRHDSPRVAAYVEADNEKARQDALDLLDEERDLAVARSAIYQQDLHRY

SEQ ID NO: 184549 - protein, 191 aa, Triticum aestivum
  Clone ID: PAT_TA_78967.pep
PRVRLKNSKHSQGRWDHIVVLTLLRPDIGMVSAQSDQHLSPAVLGEALFFALRVLLSRSLSRSSTVLRNSDSVYVLLVDSQFGGVVNVQGDLNKLNFDLNNVYECAAEWIKKDAKITVSSVDRVWNKLGNANWGDIGTLQVLLAVYHSMVQFCGAPKYSLDELATEHSSRLQSRRSERHLVDRHSNGNGLF

SEQ ID NO: 184550 - protein, 74 aa, Triticum aestivum
  Clone ID: PAT_TA_78968.pep
TTPSPKLPGWVHKLSGLRCVSYHAIHTKSYQMYVYTSFFWVKKATTIFVHKLPGLRCVSYHANVTKAIEGIGRV

SEQ ID NO: 184551 - protein, 238 aa, Triticum aestivum
  Clone ID: PAT_TA_78969.pep
MDQFLVAAPPSADEGPEAPRPPPRRWHRWSRIAVELDGHIDARFRHRESRRLLDSLAEIRTFEHKYYTHGEERCTTYVNRMINASTFAGCYHSAREGVSAMEFDKKGIYLASVTNSGCLTVHDFETLYCSLYGPLCRIPDDSSNYVLHISNSMPLCAVRWNPGNQDEIVCSSSQTDKVLLFDIGYVSSAPTEVLQKGMTKFHGFCSESRKGLTDLAFTPDDKSRLFASGLDGAVYMWD

SEQ ID NO: 184552 - protein, 236 aa, Triticum aestivum
  Clone ID: PAT_TA_78970.pep
MVPKMLGTAALSEREFDLNKATQMAEQEDKLAYSENPYVLATLTPRLWPFMRHSITSVRRSAIRTLERLLEVCNTRSSAGDALSNFWPTSILGDSLQVAFQNILLESNDEILQSSERAWKLLLQCPEKDLECAAISYFGNWVQLATTPYGSTLDSTKMFMPVALPRGSRSRAAKIRPAKLEHESSRMVSFGSTGENTSHEKQFDLSSNVPKIIVGADSDKSVTHTRVLTAMALGLF

SEQ ID NO: 184553 - protein, 243 aa, Triticum aestivum
  Clone ID: PAT_TA_78971.pep
TRPGFELSQLGELTELGGSLGIYNLEKVQKKDEANELKLIDKNHLHKLILEWCIDRPNRNAEQEEHVIESLVPHSNLQDLCIRGHGGANCPSWLGRYLSVENLESLSLCDVSWSNLPPLGKLGFVAGEGWQSHVSSQSFHILKRLEIVNIPKLQKWAGNEPCHLFSVLEVVIFIDCPELVELPFSHPTSHRAKHDENMSWFPKLRELKIICCPKLASLPPIPWTQALCSAEIRQAGSVFEQLV

SEQ ID NO: 184554 - protein, 158 aa, Triticum aestivum
  Clone ID: PAT_TA_78972.pep
PRVRLVENDTSKTNVHDGTVHPLTIRVINHVKFLFDYQLTLKLLLQEFETGSDTESQLTVVLTKIMQALQNNLDGKSNQYKDPALMSIFLANNIHYMVSSVRRSEAKHILGDDWIQRHRRIVQQHAKQYKMVAWGKVSASDLETVSIHQPSSAPLPVA

SEQ ID NO: 184555 - protein, 96 aa, Triticum aestivum
  Clone ID: PAT_TA_78973.pep
SSPLLASDGVVEVGGGKGAFSGRREGGQGGVGSKAAESLSLPTSRGLEAPTDRQATPRRRIGEEIACRASELPGGIPDLSEKAGADAWVDPGFRTG

SEQ ID NO: 184556 - protein, 244 aa, Triticum aestivum
  Clone ID: PAT_TA_78974.pep
NSNPKIIQALHSSALGGHSGRKASYERIKKIFYWPGLKSDVEKWVTECHVCQKNKGETCHYPGLLNPLHIPDMAWTHLSMDFIEGLPKSQGKEVIFVVVDRLTKFAHFLTLSHPFTVKTVAQVFIDNIIKLHGPPIAIVSDRDKNFTSQLWKDIFAALKVDLRYSSAYHPQSDGQTERVNQCIENYLRCLTSAHPTKWVQHLPMAEYWYNSSFHSSLKKTPFEALYGYPPPQLSEYVIHNNRTR

SEQ ID NO: 184557 - protein, 100 aa, Triticum aestivum
  Clone ID: PAT_TA_78975.pep
LLGVGEEAVERLRRVPRVQRRVDPPLRVEPLRPELRRVHHHHFLRAAARSAAPREGLPLCPSSSSAAASARRRVGRGAWCLGVWRLLLLLASASPHRTRG

SEQ ID NO: 184558 - protein, 259 aa, Triticum aestivum
  Clone ID: PAT_TA_78976.pep
PVRIPGSTHASAQIGNAGAPQGHGSTVIDQQRLRDQPSSSRARAPGCTCCGGAPTTRVVLNLPVCEACYRRFFHAGAPQQHAQIGYAGAPRGAVRNPVAVPTREQQFLANMDAPPRPFSMFPFRWGPANPALERQSSSPARNGPPQQAQIRPPPLHTLAPPPERQSSSRAREQQLQAQADAMRLQVANILNNPFSLVRSGPANPAPQRQSSSPGCYSNIFTGNGPLFSSAGARAPQAQGHGTAIDQQRQLDLLRGQPSS

SEQ ID NO: 184559 - protein, 249 aa, Triticum aestivum
  unsure (1)..(249): unsure at all Xaa locations
  Clone ID: PAT_TA_78977.pep
TRPGGDTAATSPSASSDSKSTAPAGKHSDVSQDEGWITIPNKELPGDWSEVSDMLQLRPLDRPFXFPGEQVHILACLSASKQDMTCISPFRIAAVMSKSGNSPRHPTNKSSSVSENGDANGTAGENSPHGVEDNMESVELNDKVSSPSKQDILETESLLRMEDHKEQIETVLQKFKRSNFFVRIAESDEPLWSKKRVAATKTADEQLYSDSQGNNTVSRSXLTIPXSDKGVFDGSTSGGVARDTVRCYA

SEQ ID NO: 184560 - protein, 115 aa, Triticum aestivum
  Clone ID: PAT_TA_78978.pep
MATETETFAFQAEINQLLSLIINTFYSNKEIFLRELISNSSDALDKIRFESLTDKSKLDAQPELFIHIIPDKATSTLTIVDSGIGMTKSDLVNNLGTIARSGTKEFMEALAAGAD

SEQ ID NO: 184561 - protein, 91 aa, Triticum aestivum
  Clone ID: PAT_TA_78979.pep
HASGAAGGDDYMYSEEEFQMQLAMALSASNSDCAGDRDRDQIRDAKLMSLGGGDRFAAGRDDGHTADSLSRRYWVRLHSAPANSIRAELEC

SEQ ID NO: 184562 - protein, 62 aa, Triticum aestivum
  Clone ID: PAT_TA_78980.pep
LLAFMACHEECIGLSAGRWTAAVRWWTSMQTVIDRQRYGPWLGGGDSDLDGRMGVATDNAAA

SEQ ID NO: 184563 - protein, 86 aa, Triticum aestivum
  Clone ID: PAT_TA_78981.pep
MATARKGTATPLASAFSPEETRRAVSRVAQAIADRRADLARVQGFFADNAALVNLVQRLPDELSREKGGAPKGDHADAWVDPGIRT

SEQ ID NO: 184564 - protein, 104 aa, Triticum aestivum
  Clone ID: PAT_TA_78982.pep
MDQPESSLPHAAVQKGQTPRREELVRLIAQSLYSLGYRKAAATLEAESGVPLYPPEHDRLLLDVMSGRWDACAATIDSLTGITERNRAVAEFLVWRGHFLELLG

SEQ ID NO: 184565 - protein, 246 aa, Triticum aestivum
  Clone ID: PAT_TA_78983.pep
TRPKASKKDKWNQVKDSIGRALRNSSVEAMVNIIALSYLDLPRHLRTCLLYLSIFPEDRIIEKENLIKRWIGEGFICKESSHTMYELGEIYFNDLINRSLIQPTGIGGKCSEVKSCRVHDTVHDFIVSKAVDENFVTVIGVPAGVNHDPQMKVRRLSLQNNGEIPACLIVSNARSLHVFGRNAKIPSVSQFGLLRVMDFEHCWQLKDYDLAGIGNLLHLKYLRLKHTGALKALPEEVARLQELQID

SEQ ID NO: 184566 - protein, 88 aa, Triticum aestivum
  Clone ID: PAT_TA_78984.pep
RSKYCVGEGQVCYVYPAILLQSIPAARAASQARPRHRRLAALASQAAGRRCCSVWAGNRRAAGLLLLSSLVRVRFSSGLQVADGGSLP

SEQ ID NO: 184567 - protein, 77 aa, Triticum aestivum
  Clone ID: PAT_TA_78985.pep
EIRSSSPIIIPRTVHCPEYRRFIHALQIKDDSSLKLDKAKPCQSSYQHNHNVQRRKPIAFAGMDLVRILRINTSCQF

SEQ ID NO: 184568 - protein, 115 aa, Triticum aestivum
  Clone ID: PAT_TA_78986.pep
MPSSPSPPIVLLSDSDDEEATASAALLGLAAERITSSLVTQADVDAVCRKQGVPREFVARPAGDLRACSAPPPGAVCVYAHALEAGVRFPLHAFFRDALNHFGLAPGQLAPNGWR

SEQ ID NO: 184569 - protein, 95 aa, Triticum aestivum
  Clone ID: PAT_TA_78987.pep
MGVEEEEGAINGGEEGPGLAAAPHDRWVLLRPAQGSARPSARYKHAAEVVQDKLYVVGGSRNGRSLSDVQVFDFRTSKWSALLLSPSRDSNQLNL

SEQ ID NO: 184570 - protein, 90 aa, Triticum aestivum
  Clone ID: PAT_TA_78988.pep
GCSYLREQDLNNANIEGWTRRERNRQGAASKKPSSDRCNQMEIALGNAGKIGQEVVFQPFKGMQFDSREGCIRIFQCIFLGNWFWYQAWQ

SEQ ID NO: 184571 - protein, 80 aa, Triticum aestivum
  Clone ID: PAT_TA_78989.pep
NPGSSSSNRSTVSTRTQEHKKMQEKTQDMFHARNARTQELASAIKSHARARHPSGPRGRRRPARRNRRPSSSHSRGGCRP

SEQ ID NO: 184572 - protein, 216 aa, Triticum aestivum
  unsure (1)..(216): unsure at all Xaa locations
  Clone ID: PAT_TA_78990.pep
MADLQTPLVRPKRKKALIYFNIYLGDMWSAMKSEKKRQKEHEDNVQKVVKRLKQRNPKKDGLVCTARKPWIAVGMRNVDYKRVRHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDXLFYGXPWSQGTLGFLVSAEIKLIPIKEYMR

SEQ ID NO: 184573 - protein, 233 aa, Triticum aestivum
  Clone ID: PAT_TA_78991.pep
TRPKIGNEMDPGSYIKVKCVASGTRWQSEVIKGLVFKKNTAHKHMPTNCHNPRLLLLKGVLGHSDVGLSSFNSMDQEKGQLERTISKVMEICSPNVIMVEKTVSRDIQELLLKEGCTLILDMKLSRLQRIARCTGSPIISFPEVLDQPKLKQCDYFHTEKFIEEHNIASEGGKRLSKTLMFLEGFPRPLGCTILLRGANTEELKKVKQVMHYTVFAAYHLILETSFFEDQRVF

SEQ ID NO: 184574 - protein, 30 aa, Triticum aestivum
  Clone ID: PAT_TA_78992.pep
LLRMTYGVCCFFNKSELEQAIYIESSRTRG

SEQ ID NO: 184575 - protein, 199 aa, Triticum aestivum
  Clone ID: PAT_TA_78993.pep
MAISPLVLSGAAVATLAVLGLAVYACRRWRRGAPPAALPPSASSQGEDINRPLISDKLDDYSGPSNNLGSNNAGESTMWTNRSTTSPRTHTHPTESHPIEGEVHVIDVTNGTPEELHLGSTLKRTAEASVRASEAKHTRRASGENNNGGIPVKDITVGSHLALEVIAGPSHGINRYLQSGNTSMLPMTLGRIPQSDLVL

SEQ ID NO: 184576 - protein, 99 aa, Triticum aestivum
  unsure (1)..(99): unsure at all Xaa locations
  Clone ID: PAT_TA_78994.pep
AEQAAVMRQQIHLFWGXNMLFERSQVEFKLVVGDWKKNLDASVERFKLAGASESDISMVLKNHFSNAAVSECEEKKDMPSATGSSQTSDGIDDESVVES

SEQ ID NO: 184577 - protein, 201 aa, Triticum aestivum
  Clone ID: PAT_TA_78995.pep
MAAHDSDLGGAVHVLLLPYPSQGHINPILQFGKRLASHAGVRCTLAVTRYLLGQGRDPCPGAVHLAEISDGFDRGGFAEADGDVAAYLARLESVGSRTVDELLRSEAEKGRPVRAVVYDAFLQPWAPRVARQHGAACASLFTQAPAVNVAYAHAGAGRWTVPVLAGTVPPELPGLPAGLGPDDVPSFLAKLDECPAYLDLL

SEQ ID NO: 184578 - protein, 70 aa, Triticum aestivum
  unsure (1)..(70): unsure at all Xaa locations
  Clone ID: PAT_TA_78996.pep
LLTFQGESCYNPYNPRVPGLLXSKGLVXESEVARAIFIEGHQIPLIGVKRDGGFNYASRDLAALWLVTES

SEQ ID NO: 184579 - protein, 103 aa, Triticum aestivum
  Clone ID: PAT_TA_78997.pep
MPEEKEYVAVPMGQAPEPADPEDPDKSPPRPTSPATSTRQACFADLQSWVSRKFMTGCVVIFPMAVTFFITWWFIRFFDGFFRPLYAKLGVDVFGTCSTNTYV

SEQ ID NO: 184580 - protein, 92 aa, Triticum aestivum
  Clone ID: PAT_TA_78998.pep
ANQEPFIPTALHRAAPTSSALHRRRPMDQFPDRHHVRLRSRALGGYLHAADDGESVVLRRSRASLNAAWEVHLRPNGGRGVHLLLHSAAYGR

SEQ ID NO: 184581 - protein, 131 aa, Triticum aestivum
  Clone ID: PAT_TA_78999.pep
MDPSRPLLGRGAFLSSSAHAAAAIILIAFLLLTLLRLPLSPSISIYTPPPIASTPHHHLQHQDHEDQEQEDASSCDLSSPLDCADPRLFHLMMRSAVDAFPAVHFARFGRPVPGDPPSASCDMAWRARTNS

SEQ ID NO: 184582 - protein, 110 aa, Triticum aestivum
  Clone ID: PAT_TA_79000.pep
LPLSTPAMLLLYCRPFSSPCPPLRRLLRCRCTCSSASSPIVPYHQSFARRMALAGIHPHHRIAVGVSGGPDSMALCVLTAAWKKAAKGGSGGFVEGLLGVVVDHGLRLKS

SEQ ID NO: 184583 - protein, 120 aa, Triticum aestivum
  Clone ID: PAT_TA_79001.pep
NQEPALFATSIRENILYGKSDAAADEIDHAAKLSEAITFINNLLERYETQVGERGIQLSGGQKQRIAISRAILKNPSILLLDEATSALDAESEKSVQEALDRVMVGRTTGVIAHRLATIR

SEQ ID NO: 184584 - protein, 154 aa, Triticum aestivum
  Clone ID: PAT_TA_79002.pep
GARIRRNGPYYAYDTRDTHHSVCIPCYNKSRGHTIEVEGQMFPKARFQKKRNDEETEECWVNCERCNCWQHQICALFNDINYDVKQAYTCLYCYIEEVKRGLHVPSPQSAVLGASDLPRTALSDHIEERLFKRLKLERQARAVQSGRSFDEVAG

SEQ ID NO: 184585 - protein, 133 aa, Triticum aestivum
  Clone ID: PAT_TA_79003.pep
MQGAAAAAEGRSRASPDKADEESAKKPRLDLPDAHSVKQELVSPDAAEGGDPGGIVAAAAPYSPREELAVRIDERLLHCPLCALPFKPPVFQCKAGHLACGGCVAQLPCGQSKACEDGAGFFDPCPALDAVVT

SEQ ID NO: 184586 - protein, 97 aa, Triticum aestivum
  Clone ID: PAT_TA_79004.pep
FFFFFFFCSFFFLTLAVGLPNSLIKRSVTRTLREGKHSKRLVQKERKKKVGTTTNPSSTNKPCTPSGTIAGPPRGCLQGGSDIEDNTVTKSGRTRGS

SEQ ID NO: 184587 - protein, 136 aa, Triticum aestivum
  Clone ID: PAT_TA_79005.pep
GRPTRPAAAAAAATPICPPPSTSSTNLCNPIGVHARRLIVAFLRHRHRAGQLHRCGEAEVNVVSLSRTRSRGENRAFPMILWARRRQARDESVFLAPLPSQGHRATTTLARSTSPWPSKPMSTGELPTTAPSTASA

SEQ ID NO: 184588 - protein, 204 aa, Triticum aestivum
  Clone ID: PAT_TA_79006.pep
VDPRVRASPLGGTSQAPVRGASPQVNLGTVGIPTQSSTPAAQTPAITTSVKPNPTDLNILSSQPAVNDSKALVPLGNGSPSNSSFGVDPFSATPQPTQNSSSPHVSNGLHGSTALGPAAGPHHPPKPMPPGPVQGISSLLSHTGQVPPNQPAPKQNQFNSIPSTPGPLNANIPGGQIPTNQKQFQAPWPKITQADVRKYMIVFI

SEQ ID NO: 184589 - protein, 170 aa, Triticum aestivum
  Clone ID: PAT_TA_79007.pep
LVTAPDGSNSVLAEVPGLSEPSNNYVPSGLSHAGSGRQPEVSSCGTALSMAETVMQAPLKVSTTPQLSVDAQKIEERTMRLRPLTPSSNKTSISSLSDKLKIRGARAGDSNGPVKTAPQLSTQPSNSSVRTPVKSEPVKPSQSGSFQVLTREQNGAANTAKDCSSNPVSP

SEQ ID NO: 184590 - protein, 210 aa, Triticum aestivum
  Clone ID: PAT_TA_79008.pep
STHASGENNLLGHCGPFLSKLCGNLTLLQKFPELHASAMLALCRLMIIDAEFCEANLQILFTVVENASSEIVRSNCTIALGDLAVRFPNLLEPWTEHIYARLSDSSASVRKNAALDISHLILNDMMKVKGYINEMAVRVEYEYERISSLAKLFFRELSKKGSNPIYNLLPDILSRLCNQHLKEETFRNIMQFLIGSIKKDKQMEALVDKL

SEQ ID NO: 184591 - protein, 170 aa, Triticum aestivum
  Clone ID: PAT_TA_79009.pep
MEDVLPPPSATGTPPAATSTLASPWGSGFTFGDQTAPPGDTPPDQMLPPPPPADDDDDDSADLPDLPLPPPPPPSDPSTDWPDLQLPPPPADMHPIPETPNQPLYSSPPPADTHPIPETPDQPLYSSPPPGVMHPIPESPDQPLHSPPPPAPPTPFAPPQTPLPPVDTPP

SEQ ID NO: 184592 - protein, 142 aa, Triticum aestivum
  Clone ID: PAT_TA_79010.pep
RGKEAAAWWYSGELGAWGSEVRKLHGVHGGEAKRRRRRRCTAHRQAAGSPGGARDHNEAARGRDGARQWLDDRVSLLSLLLWVTGQRRETRERRWWLGRSGDAWREQLQQSAIPAGSREEWLAAASGRRRGDWYGGADAWVD

SEQ ID NO: 184593 - protein, 86 aa, Triticum aestivum
  Clone ID: PAT_TA_79011.pep
KRCAVIDFAYVFQPTDAAGSAYSGADDGFIAQQQGDAWACASKICDSLSLSHQVDDRCLAPYMTFCISRGTMQGGRINFLSLSMNE

SEQ ID NO: 184594 - protein, 110 aa, Triticum aestivum
  Clone ID: PAT_TA_79012.pep
SPLATIDTTCEGLRKLADIYSCIEEMMCAPSNQVSLCRTLQRVAVEAELGRSLVVLDLCNAMQETLMELKMTVQELLLVLKRGEDTTCQVKAYIRHFTSRIHILHLVEAN

SEQ ID NO: 184595 - protein, 142 aa, Triticum aestivum
  Clone ID: PAT_TA_79013.pep
QLSTRGLTAPRRRYLHRYCLDQYLQPFHNPLLLSDCACGQIAYLYQPDDCHGRAHAHRCLLTKHSPLAQGALKRRGESSDACTMLTRTATHAFYLPASGPIKRFTGFRPHRLNTDSAHVGIKRKMCCQPVFQLTNVHFFWFR

SEQ ID NO: 184596 - protein, 194 aa, Triticum aestivum
  Clone ID: PAT_TA_79014.pep
RPTRPESSPSDIEFHGTSEFGLMILVCRKLSKYVMYLFIHHPSMLPLSISPAPTLAQAHEVYDDFTKDSVELEVSKETVEEVARMWTRLLVYAAGKSKAALHVALLSRGGELITFAWLIMAHCGFGDTRVRRLQLTNIDAHIVRELDFTPRHLFNLPMEDQISDSANRSKLDDENANGMTTKSDRFVVGSRSFP

SEQ ID NO: 184597 - protein, 255 aa, Triticum aestivum
  Clone ID: PAT_TA_79015.pep
RPTRPANVCSGKESLSKGAITCSAYSRNANNQPTRKVDCSSAGSGDTTPSSSSEKNGASRNGVLNAYSVASHVEETGIINSTGPNKDSHSLRAICSSTTEHGEDSCSHEATGSSMNPIAVIRLSSSCISSQVCTLNDLNCQSKSDSSACLAIDLKNSLAGEKMVAVSLSEDNSCTPGPDFLREFDSRNQQNTECSTLRKSVESTTSADQVPQFGNPLDTEPASSDSTTDLHGSLCNEAELNSAEEQILMVERSLT

SEQ ID NO: 184598 - protein, 104 aa, Triticum aestivum
  Clone ID: PAT_TA_79016.pep
ISTSSGLSRPPPPPPPCTHGRRGRSVMACPGRAGEARQRWHGRRLGRGARGRPQPRPRRRHPPAPLPPARPPPRPLRSPGARAQGAQRGPARLPAPPPRACQRR

SEQ ID NO: 184599 - protein, 178 aa, Triticum aestivum
  Clone ID: PAT_TA_79017.pep
PTRPWCDNPLGIPYHCSGFGESQRFQKVLQGQEVFRPYRGSLVDARMRNGGFQQQDGPYASALLDKWRAQQQHAFGFGPPAPVLPSQPSLSPPSVLMFQQADPKVSRFEFGHGHLDKNVDDPYARFVSAEGIGRGEQMLSLRPHLGSEVIDSGVAVENKGVAPTNSCKIFGISLAEKV

SEQ ID NO: 184600 - protein, 213 aa, Triticum aestivum
  Clone ID: PAT_TA_79018.pep
STHASDSEDLKSTFHKKPSVDNAPEQKVLLLCGPAGLGKTTLAHVAAKHCGYHVVEINASDDRSASSIEPKILDVVQMNSIMSDSKPKCLVIDEIDGALGDGKGAVEVILKMINADKNNDSDRSNGAEETQVQKASSRKSHRTAKLLRPVICICNDLYAPALRKLRQVAKVHIFVQPTISRVVNRLKYICKKEGFKTSSIALSALADYTECDI

SEQ ID NO: 184601 - protein, 98 aa, Triticum aestivum
  Clone ID: PAT_TA_79019.pep
KWQDKCTIIHRLNTNSEDMYLYNCKPLLQRAKCLKNFKQLAYQIWIGTDKNIENSYNDLRSEFLSEKKICTIQGHTLHHLTAMLSSLLEHTYAFVSDK

SEQ ID NO: 184602 - protein, 93 aa, Triticum aestivum
  unsure (1)..(93): unsure at all Xaa locations
  Clone ID: PAT_TA_79020.pep
LPMTYLGSPITLSRIRMVHLQFFIDCIKSGLTGWKGRLLSLGGHRVFIWSVLSAMPTFALPILIVVDRVRHHFLXAQDKELARGSCNVNWRKD

SEQ ID NO: 184603 - protein, 247 aa, Triticum aestivum
  Clone ID: PAT_TA_79021.pep
RPRVRDVIVVSGETGCGKTTQVPQFILDDMIESELGGNCNIVCTQPRRIAAISVAERVSDERCESSPGSKDSLVGYQVRLDSARNERTKLLFCTTGILLRKLSGNKDLSDVTHVVVDEVHERTILSDFLLIVLKSLVEKRSNQPGRKLKVILMSATVDSSLFARYFGDCPVISVEGRTHPVSTHFLEDVYEKMEYCLALDSPASGAYFAQHGEKWKHASSSVNNRRGMKNLVMSSWGDEFMLSEIML

SEQ ID NO: 184604 - protein, 217 aa, Triticum aestivum
  Clone ID: PAT_TA_79022.pep
PTRPQPLHKLLEAAADSSTPLAAARLHAHLLRSGHLHSSHHLTSHVLASYPPALARHLFDEIPVPTPRLANALLRARVRAGQWRDVLLLLPRLRVRPDAFTLSLLLKSCAMLPSLAHGRAVHALAVRSCAAYTDAFVAAALVQMYAKCGDMVGSINAFNAFEEPDIVLRTSVVTGYEQNGMAQEALEFFARSVIGQGFMPSPVTLVSVISAAAQLKN

SEQ ID NO: 184605 - protein, 167 aa, Triticum aestivum
  Clone ID: PAT_TA_79023.pep
RIAVLYLVLSSMVCPVCRCPGAACLPFVPTDEVLEVFYVVLDEYCFRRTYIPCNVRGFLADYIAEHRHIATTYKHKRTEPAILIYESRSYASEFKHRGNYSKFCGSAWFEFSNDYALRAEDRLVFTLDNSCFDLKVETFRDGERILPLPSVAFENLSNARYELVCSA

SEQ ID NO: 184606 - protein, 57 aa, Triticum aestivum
  Clone ID: PAT_TA_79024.pep
STHASALIRSPLIKEADLKSYESVKADLQQAHAEAQNLAAARQHLLADAQKLNKVPH

SEQ ID NO: 184607 - protein, 53 aa, Triticum aestivum
  Clone ID: PAT_TA_79025.pep
SGEIYVVSGGKVQHELLLQVHHIFSNFRSYSLACILLVLLVLPLLSIKICLMG

SEQ ID NO: 184608 - protein, 207 aa, Triticum aestivum
  Clone ID: PAT_TA_79026.pep
VDPRVRPRVRRASTPHPSDLLRFTKLKTDTETNPFSIRFGNAASGDVPEFLDILHADEEFYNESIEENELKEMYFSVVRPALIPRCLIFPYEIGNKHAPGLHEAYKTITKREEPLYISSRDLMITLSSMANQHWVHLLNFISDQRDLVIEDWCNSYGTLFGAGRYDHGFNCAPTGEMCFKGECDASLRGGMARICCIIWRGNQIVAC

SEQ ID NO: 184609 - protein, 233 aa, Triticum aestivum
  Clone ID: PAT_TA_79027.pep
TGPEFPVDPRVRVSGRRVFYSTKKRNAVSWTALMSGYASNGRPDQALRCIVWMQQEGIRPDLVAVGTVLPVCTKLRALSEGKEIHAYALRRWFLPNVSLCTSLITLYGACCHLEYSRRVFHAMDKKTVRAWTALVDAYLKNRDSSTAIEVFRSMLLSNRRPDAVAITRILSACSDIGALQLGKEVHGQVLKLRMEPLPLVAAELVNMYGRCGDLKAAQRVFNRTESKGSLTCT

SEQ ID NO: 184610 - protein, 60 aa, Triticum aestivum
  unsure (1)..(60): unsure at all Xaa locations
  Clone ID: PAT_TA_79028.pep
FFFFFLRVKVSLGEIRVLHVPTSSXQYADIFTKGLPTTLFDESRSSLNVRQAHVDSAGGC

SEQ ID NO: 184611 - protein, 106 aa, Triticum aestivum
  Clone ID: PAT_TA_79029.pep
GSGMARIPTLVAFAVRRAATATTAAGKAIWDAKGVLIVGGAAVAAWVYRADLGRLADHLFSQGRTHTPEDRDQRVRAKRAANKGARKVVRDAHGLYSKNHGRAGGH

SEQ ID NO: 184612 - protein, 70 aa, Triticum aestivum
  Clone ID: PAT_TA_79030.pep
GSGLKSSQSRMTGEQLQRPHSNQTLQGGPEPNRSARFGDWLAILCAIIMLHVSMIFIPFLPSLRTYPVQK

SEQ ID NO: 184613 - protein, 69 aa, Triticum aestivum
  Clone ID: PAT_TA_79031.pep
PQLIIVSGTTEKDQGIGVRPCAYIWNCSAASRSRGQFVLVCAAFFPSIRAHRSLQTPFCTSPQGTPCWF

SEQ ID NO: 184614 - protein, 197 aa, Triticum aestivum
  Clone ID: PAT_TA_79032.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIF

SEQ ID NO: 184615 - protein, 178 aa, Triticum aestivum
  Clone ID: PAT_TA_79033.pep
VDPRVRARSIHELAVTCHQKKSQRQLVNSVFPKLAVYNSEDPSVAPSLLMLHQQCEDRNVLRYVYYYLARILSDNGSQGLSAAGGIPTPNWDALADIDVAGGVTRADVVPRIVDQLSAESTSDDVEFHARRLAALKALTSSSTSSSEMLEKLSEIVFGILEKVADTKQKRKKGIFTKQ

SEQ ID NO: 184616 - protein, 179 aa, Triticum aestivum
  Clone ID: PAT_TA_79034.pep
PRVRGHPRASRPLQSPNSIPTTRFLSDLGFPYRERNAGRLIGGERWVSSPSTGRMPTQPRSLVAPSSSFSPSLARRAASATPARELRGRPSLERWQRRRLPNLLLPAVWPATAASAALVCSSGRGRRIKSSSFSSCVQKSTPFCIHFGRRSAPSLSRSTPSRIKGIAFQFRVCSPISDS

SEQ ID NO: 184617 - protein, 174 aa, Triticum aestivum
  Clone ID: PAT_TA_79035.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLG

SEQ ID NO: 184618 - protein, 51 aa, Triticum aestivum
  Clone ID: PAT_TA_79036.pep
FFFFFFFFFFFFFFFFFFFFFFLTMKNKHQMAQILEQIATFSFQLLMTARW

SEQ ID NO: 184619 - protein, 206 aa, Triticum aestivum
  Clone ID: PAT_TA_79037.pep
VDPRVRPPGRVPGGVTVHVSDEDGDVDIETPTSLQWWLDIYPHLAEHEKPLECTQLPGETIFVPSGWWHCVLNLETTVAVTQNFVNQSNFEHVCLDMAPGHCHKGVCRAGLLAVPGKSIRDIENHPPGTMSAWNHNDMTRAEKRLKGSGSGRASNSANQCASFEFSDVHESLENQVFSYDIGFLSQFLEKEKDHYTSVWSPTNPIG

SEQ ID NO: 184620 - protein, 211 aa, Triticum aestivum
  Clone ID: PAT_TA_79038.pep
RSGFLGRPTRPNRRHPEIQAPLPRLPPSANPIQIPDRHVVVVSDFQSSYYDGDDVKPAVTTHWRRDYGYGYGGGAAAEDVKPRPGPPGAGAGAGRGVHGQDDRAAFSWPAAEEFKSTLRTQESLAGLRTRYGIPEGFGLYLAGPAQAACAPPPPAARGARGGAAAVPICVHTQAFVAGMRLPLHPFFSDALAHFGIAPSQLAPNGWRVLAG

SEQ ID NO: 184621 - protein, 135 aa, Triticum aestivum
  Clone ID: PAT_TA_79039.pep
HVQHRMRISFLQRDFLAHGTNSSTSYRWQVDWSTSDGILGHPAPKLHRLYLPPPSSHLQGLPSPAPRRADLPVLLPDRGGGRRRGWFSRSGMGEARRWRSGLVGLVGSGAIGGDIRDLGEVGVNGSGQRREVRRR

SEQ ID NO: 184622 - protein, 231 aa, Triticum aestivum
  Clone ID: PAT_TA_79040.pep
YRSGILGRPTRPVAELQELTSLCGGLPKVIVEIAGSFAKNTDRWKHTLCTKNKFMLELENNGEFDSLKGLFGWMNSYFRKCPDSLKPCILYLPIFPRNHHIRRRRLVRRWIAEGYSRDSHEESAEMTGEKQFCDLINLSIIQQASALGLGGTRMVFCQVNGFFREYIVSRQMEENLVFELRGSCALTTQRTGRHLVILESWVRDRIVFESIDFSRLRSLTVFGNWKSFFVS

SEQ ID NO: 184623 - protein, 66 aa, Triticum aestivum
  Clone ID: PAT_TA_79041.pep
NSNLALFFRRWFFLANPCINKRSSKSKYGMLICLIGRENHFIISSRHYSKHVVHNRNQHMYLSKKG

SEQ ID NO: 184624 - protein, 204 aa, Triticum aestivum
  Clone ID: PAT_TA_79042.pep
KLFHSGTISTPHYYDLGLGGLLGGLGGLLGRLGGGLLGLLSGLLGEQHRVDVGRYRPSVLGEFICNKTVADELHRMVTERQCNHFIFEGAQAVGKRSMVLALLRDAFGPDDLKIEEITKRIELKGEIAKHIDVKVKISDHHVEVNLADLHGYEKYVITTLLNESIPPPDLICDHANCKALYWLVFGKVCRLQQSYFQLLQFFKP

SEQ ID NO: 184625 - protein, 209 aa, Triticum aestivum
  unsure (1)..(209): unsure at all Xaa locations
  Clone ID: PAT_TA_79043.pep
RPTRPRSDPLPPPTPRENPPXAKPSGAEIPRPAPWIRSPSTRRTSSPSRPPPSPPLPAASSASRNPSRPPLPPXSPHKSPPPQPPAEEETLAPHLGSPPPPPNHSPPPSEEEAVAPRLGSPPPPTTNPSPPPPPPAPDAEAVAPAPSSPPVPVSSPLPPADTAEDDDEEGDDGLDPLFSESAGGGGWDPLGLPTGEDDDEEEEMLAGGG

SEQ ID NO: 184626 - protein, 130 aa, Triticum aestivum
  unsure (1)..(130): unsure at all Xaa locations
  Clone ID: PAT_TA_79044.pep
STPRPRISFPLDPHSSSLPPRARGGAPAPVSPAPPXRPSLPRRAPSPPPPEPGAATILPELLPPLARARTKEPLRRPLFSPRPAPRPMPCRHALLAPARHCLPSALCASSSSPCRAPLERPEFAFLPDGT

SEQ ID NO: 184627 - protein, 183 aa, Triticum aestivum
  Clone ID: PAT_TA_79045.pep
MGVDAALHGAAAEAALHGALSLQPHVAGAFFALAACTVALAALLAVARTRPPWWCDCAVCEAYLTASWAGEFDNLCDWYAHLLRRSPSQTVHVHVLRNVLTANPVTVDHMLRARFDNYPKGKPFSAILADLLGRGIFNVDGDAWLFQRKLAAAELASPALRAFASGVVASELRGRLVPLLDSA

SEQ ID NO: 184628 - protein, 200 aa, Triticum aestivum
  Clone ID: PAT_TA_79046.pep
GRPTRPSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 184629 - protein, 82 aa, Triticum aestivum
  Clone ID: PAT_TA_79047.pep
MKRRHVFRRLGVRARVLDTARFSGFCQDSRDARQVATVHANCCRTMRAKIADFWAILRAARRLNGTTQLRWPPHSQCAKSWI

SEQ ID NO: 184630 - protein, 206 aa, Triticum aestivum
  Clone ID: PAT_TA_79048.pep
DPRVRLKKATDAESKINGLTNTMLSFQEKLTNMEAENQLLRQQALLHSRLKTISENTPPKSNSTNGSPHYEEQMTPHGTPRAPKDYGNFAHPRASFSERQHDTVDALINCVTENIGFSEGKPVAAITIYKCLVHWKIFETEKTSVFDRLIQIFGSAMQNHDSNEDLAYWLSNSSTLLIILQKSLKAVGSTGTTPHKRPQNQSSFLG

SEQ ID NO: 184631 - protein, 92 aa, Triticum aestivum
  Clone ID: PAT_TA_79049.pep
SSVSRLQSPMSAHFIRAPPTPQCNCSTAHPSPSPHQVIARAHMMRLGGRSELWSVTRKHNHGVPPHLDAPRNPRCGTRIMVNNGDIARVVCI

SEQ ID NO: 184632 - protein, 156 aa, Triticum aestivum
  unsure (1)..(156): unsure at all Xaa locations
  Clone ID: PAT_TA_79050.pep
RPTRPTASPTNSSSNSRHPQRPLPWPRPPPPPPPPPPCPPPLPPPRGPPPTRPXPVLGSLPPRPPRGGRAAPPRPLRRSKDRRRGGKTPSYTFDRDTVGMSLGSLYGRADDTAAETTAAMAEADAAAGTTSATPPTSVVPATTTMAGTISARPPTC

SEQ ID NO: 184633 - protein, 93 aa, Triticum aestivum
  Clone ID: PAT_TA_79051.pep
NHTPAPPVASLSPLVTPPPPPPPRRQITLGPSPAAGIPTPAPWSTPGAAPRGSAGPRRRRPRPRRPRPRRPRTRATRRGHQRQRPVRRPPPHR

SEQ ID NO: 184634 - protein, 204 aa, Triticum aestivum
  Clone ID: PAT_TA_79052.pep
RPTRPILREGDPVDEMQFILHGSLESMTTDGGRSGFFNKVQLKEGSFCGDELLTWALDPKSGANFPVSSRTVKALSEVEAFSLRADELKFVASQFRRLHSRQVQHTFRFYSQQWRTWGACFIQAAWRRYYKRKMAEQRRREEEAANRQSSSSGPSLGATIYASRFAANALRGVHRLRSKAAALPIVRVPKPSEPDFGVDVDDAD

SEQ ID NO: 184635 - protein, 200 aa, Triticum aestivum
  Clone ID: PAT_TA_79053.pep
DPRVRGILLAPPQLLLSPPRVPHRANHLRPLFSDPLHPPPPPTRFGPPDRGSDGPGGSPNAPALVPASRLRLPRPRSIWPLRSRAPRPQAPPPAGGLDGTAAAAARPDSLLALPPYFSSFPVSSVALCCTACSNRRPWSRRLQAIDWPKLPTPVKTFSSPRTARGFRIACTCRPSPSNASAAVLLSSASASPAPSRADLL

SEQ ID NO: 184636 - protein, 97 aa, Triticum aestivum
  Clone ID: PAT_TA_79054.pep
KRYSSATESAAGRERTPTRSCTSVPHLSSLPLQFRRSSLSSWLSIWDHPLLQSVSGGRESIWDHSLLQSVSGGRGRRAIGLQWTVDYISYSTGTVST

SEQ ID NO: 184637 - protein, 213 aa, Triticum aestivum
  unsure (1)..(213): unsure at all Xaa locations
  Clone ID: PAT_TA_79055.pep
RPTRPVLKLTSPYDWNWETSLLLGGLLSATDPVAVVAVLKELGTSKKLSTIIEGESLMNDGVSVVVYQLFLQMVLGRSFNTGSILMFLSEVSLGAYVXMIFQSMPNMPTMLLILTXQDALKYSGILTVTALGMFYAAFAKTTFKGDNRRSLHDFWEIVAYIANTLIFILSGVIIADGVLRHNVHFERHGNIFTYLCLLFVFMQNCKTSMSTSF

SEQ ID NO: 184638 - protein, 63 aa, Triticum aestivum
  Clone ID: PAT_TA_79056.pep
DPRVRSTVACGSSSYNYLGALLGLMIPCKAAVAPFSPAPPTDDCCWAVRELGQPCLCLLLAGP

SEQ ID NO: 184639 - protein, 54 aa, Triticum aestivum
  Clone ID: PAT_TA_79057.pep
KIYNLQNIYDLQTLKKILHRQQKPIVVWTSKVLRTDKFPSECCVPYGIEVLIVP

SEQ ID NO: 184640 - protein, 245 aa, Triticum aestivum
  Clone ID: PAT_TA_79058.pep
RSGILGSTHASAHASEQGESGSTDIKVSGREKLLRDQPELLQQFGMDILPTMTQVYGSSVNGPIRHKCLSVIAKLMYYSSAEMIEILHGTTNISSFLAGILAWKDPHVLVPALQIAEILMEKLPGTFSKMFVREGVVHAVESLICQEISSPMLFQVPQQDKDIDSGTCTSSRSRRSRRRSSAGNTDNNSLDEPKGSHTTIANSPPSTLEGPNTRIRASVSDRAKSFKDKYFPSEPGSSDIAVTDD

SEQ ID NO: 184641 - protein, 41 aa, Triticum aestivum
  Clone ID: PAT_TA_79059.pep
MASSTAANLWVLLGLGIAGVLLAAKRLKRPARPEHGAFVSL

SEQ ID NO: 184642 - protein, 153 aa, Triticum aestivum
  unsure (1)..(153): unsure at all Xaa locations
  Clone ID: PAT_TA_79060.pep
MSLDSSGDDEELGKALYNFYVKNVKHLKRKLSSVSRRNVRQKRSSDYPVCSTFTRYSGKFFSGVVDGMCSRXRIQKYGMGCLLNFVRAEVPLRLVKWLASRFDVPASEFQLKRKFIPLTKYDIHDILDLPVDGEPLVSDPEAGRDFILSHFNL

SEQ ID NO: 184643 - protein, 245 aa, Triticum aestivum
  Clone ID: PAT_TA_79061.pep
RPRVRMDKENVSSPENDNCKEDTDSDDQDPLKDQKVSSSATRVATGAASGDMSPLPRSPDTEVDRSPWFSALRYEQPKRPRADFRSNPVRENHVRTGLAAQSSPSTIVQSSLMNFLSLNKRKHEDSCNLITEAPVLRRGTCSGQVRRTSLEANAPGISDANSLQQISLWDHSPQPFVPKRTEVSLQHSEPPNVGSPSTEAPVLRRGTCSGQVRRTSLEANAPGISDANSLQQISLWDHSPQPSVP

SEQ ID NO: 184644 - protein, 67 aa, Triticum aestivum
  unsure (1)..(67): unsure at all Xaa locations
  Clone ID: PAT_TA_79062.pep
KINKYCKHKKLRSISTHLCWSLVDCGLRMTVLVHLTGQYILTTIKSTKKHQLVIPPXKKKKKKKKKK

SEQ ID NO: 184645 - protein, 80 aa, Triticum aestivum
  Clone ID: PAT_TA_79063.pep
CGFDTVYIVGRISILGKVWWLRHNWFHGSFWANTTLHEKSHILVSHWSLANKRGIQQNRLIQTQNQHIYIVVILSFQVTK

SEQ ID NO: 184646 - protein, 51 aa, Triticum aestivum
  Clone ID: PAT_TA_79064.pep
FTIFRFYCCLYSQERFTIAYCIYVKVSSSTVVSQHYDRRKQPFLLSMQTLV

SEQ ID NO: 184647 - protein, 235 aa, Triticum aestivum
  Clone ID: PAT_TA_79065.pep
RVRESAPGESCAVKQDPASCSRESLFGIDYIKSAYRDKKEAHKSTRKKKRPTRLKQHGQLHQVSQETCANGLASDLTGDYSPMDCSPYQAAVEQAPRKASVSCDQSTDICDSSVPNQNTTCAEDDLVSATEHLVIDADLQTCQDEGRDPIADASESNFGSNFSSFDGEINFCDAPQPIFTNMNVDANGEPKMYTTEAWVDGSGCNVSGPTCEENNSRTPHESGEPVNYKSSSANL

SEQ ID NO: 184648 - protein, 236 aa, Triticum aestivum
  Clone ID: PAT_TA_79066.pep
QQNAHKLHSCTDTPVHTTRTIHRGPDAPSALGGRPYTRPKRQARRHGCCRPMPPCAFSTSRRRCRATRPPRRPLSCTAADAATAALRPVECHSLLLPKPAALCAVVPCLRAVAPSCRGLCATTQVLRDLLASATAAARRAHGIAPHHRGLVARRNRHTLSTRCSLHVRCALRGRCRAPWPPLELGSEYQLLLPLGPGYLSSHSKPEEEEDGHERFSGWRTNTQIFLIFTLADAWVD

SEQ ID NO: 184649 - protein, 143 aa, Triticum aestivum
  Clone ID: PAT_TA_79067.pep
RPTRPPPPEAEAAAPPARRTRPPRACSRPLAPPAPYPTPPPRRPGPGRPRKIVEEEPEEAEPDAPQCRVVTPLVAEPADPGELPRWRLRGMWELACVLNFLQVFRPLLNIAVEFTAEELEDALIVPNGTLEGLHVPLLRSIPP

SEQ ID NO: 184650 - protein, 252 aa, Triticum aestivum
  Clone ID: PAT_TA_79068.pep
PVRNPGSTTRPAKCVAQLLFPENEAKATEYTTRIINGAKFACPVHKCDVCKYGENKEVKELQFAVCRRCPKSYHRRCLPRKIVFDDVIENGVCLFQRAWDGLLPKNRILIYCLKHNIDPNLRTPLRDHIKFPDDPITKKSSNVNGLRRVKIRRLDDCLPVPSSSSKRPLGTSTCSSSINSIAKRKKEHLPGGTKHPSMQKSVMSVIPISTFPEVDINTATRIYDFAQKASSNITIEDVQKQLVVSSTYTSFM

SEQ ID NO: 184651 - protein, 57 aa, Triticum aestivum
  Clone ID: PAT_TA_79069.pep
DPRVRQGRRAGRRDSACLLSLHAPICAPTSSYGCLFFSFLSNLIIPSLILRRWRTTT

SEQ ID NO: 184652 - protein, 99 aa, Triticum aestivum
  Clone ID: PAT_TA_79070.pep
PRVRRERKEEALERRRGRGDFSLVHGGGEIPLSSSLRVLPDSLGCPVDDEEFDKALYNFYVNNKVKYLKRKLSSAGRRNVVSLSSSSVNHWVICMVATL

SEQ ID NO: 184653 - protein, 169 aa, Triticum aestivum
  Clone ID: PAT_TA_79071.pep
TGPEFWVDPRVRRAGLVPHIKREITILRRVRHPNIVRLFEVMATKSKIYFVMEFVRGGELFARVAKGRLKEDTARRYFQQLISAVGFCHARGVFHRDLKPENLLVDERGDLKVSDFGLSAVADQFHPDGLLHTFCGTPSYVAPEMLARRGYDGAKADIWSCGVILFVLM

SEQ ID NO: 184654 - protein, 187 aa, Triticum aestivum
  Clone ID: PAT_TA_79072.pep
QDSAGPVKAIVLDTPVAACIAPMKVSSNSGKHRRTTNSTQAKSSLAILSTEERRHTAAIAGPATDQRLSPEDHNPIKKGRCRHTTATPPKRKTTPTSTVAASSDRRRAGFSSEPSRTSTLCQQIRPNCWVTPPLPQHLAIVIKPPRNTDPSHGREHAYHQPAPTRSKEHFSSFRPSDAWVDPGIRTG

SEQ ID NO: 184655 - protein, 87 aa, Triticum aestivum
  Clone ID: PAT_TA_79073.pep
FFFFYQSQNKSTSSSLSYAYFNTRIATKRMQEPTHTHIHITSPFTYYSNTSFNKSPSLCNNHTYIPYVIYTPNMFSKPPPPLSPRTR

SEQ ID NO: 184656 - protein, 173 aa, Triticum aestivum
  Clone ID: PAT_TA_79074.pep
PASEVGMGAGEGGGRRRRNLDGDDSDEEYVLEEEEDEEEVHELEYGHGGRDAASSSAGEEGGGSDAEYEVDDEDEEEETPRPKRPVKRKANPAPARSRRRRYEDDDDYSEELEEDEEIGEDLDQEEEPRRPNCETKCGGRSQKAKMPPVAQRSNRPRHGEEEDMDFDPDLDEG

SEQ ID NO: 184657 - protein, 177 aa, Triticum aestivum
  Clone ID: PAT_TA_79075.pep
MDSGEAPDERIREEGGFRRSDRSASDTLTRRHADGAGSDANGHDRGLTKRAKDEVPDSPEPPPAVGPRRVQSREEQFVWPWMGVLANVPTERRGGRQIGESGNRLKEQLAAFCPHKVVPLWSHRGHTGNAIVEFGKDYASLGNGLKFESHFEAQGRGKLSWEASRCRGAPEMMFGWV

SEQ ID NO: 184658 - protein, 56 aa, Triticum aestivum
  Clone ID: PAT_TA_79076.pep
PPPTPTPKTLACHHPVPYPYPLPLPSVAPRPPLQAESRDGFRLAVVGHPGQRAAGV

SEQ ID NO: 184659 - protein, 40 aa, Triticum aestivum
  Clone ID: PAT_TA_79077.pep
SGRTMYSGRACLKCEEIYKLSPRFKFLLHHSNISRLGIGR

SEQ ID NO: 184660 - protein, 92 aa, Triticum aestivum
  Clone ID: PAT_TA_79078.pep
FFFFFFIFFLFFCTRRNELDYQYIWISYEQVKHACSVQGIRSSFWTVYTFCTENALRLLYTKENKYNQTSWRISTITAARGRGVVGHPDAWV

SEQ ID NO: 184661 - protein, 108 aa, Triticum aestivum
  Clone ID: PAT_TA_79079.pep
MDVKDVSLYGPLDSVECLGTHLKEMVILNYEGCEQDVGFAKFFVLNAVVLKKIKFGVPKNNNGDWVAIQLDLLQVENRASQDAQFDFKCGLDDVINYPCIQEMSLIGR

SEQ ID NO: 184662 - protein, 156 aa, Triticum aestivum
  Clone ID: PAT_TA_79080.pep
ASGISSTGSADDKKLSKKNELIVWLRLTACQRQLYEAFLNSDLVHSSMQGSPLAAITVLKKICDHPLILTKRAAEGILEGMEGMLDNKDMGMVEKMAMNLADMAHDDQALQVGEEVSCKLIFIMSLLRKLLEEGHHVLIFSQTRKMLNLIQEAILL

SEQ ID NO: 184663 - protein, 74 aa, Triticum aestivum
  Clone ID: PAT_TA_79081.pep
MMTQLQATPLRTLALSRRRGAGAAARPMAGSVRCSAAARSYSITLLPGDGIGPEVVAVAKDVLSVAGSKEGVEL

SEQ ID NO: 184664 - protein, 51 aa, Triticum aestivum
  Clone ID: PAT_TA_79082.pep
WQYDSVFFHALWWDYCTICLLLYHCTYRLLVLLILTMSLNGLVVEEHQFNL

SEQ ID NO: 184665 - protein, 104 aa, Triticum aestivum
  Clone ID: PAT_TA_79083.pep
PFKSRWGRPRQPTTPAAIGQPCTPTHTTPPLPTLVELHRTVTEPASTSSHLGKTVSRSHTRATTPMGAHLGNTTPSSTTIRGHIRGQQSTSTIAPGSCRHWTPT

SEQ ID NO: 184666 - protein, 80 aa, Triticum aestivum
  Clone ID: PAT_TA_79084.pep
EQEIRERDSSHSEIKDIREKINWIVLYKIKVQKCAEIFSGGRWEDHNYFCIHYLIACALQREYTYSSCSYIFQLFNTNLG

SEQ ID NO: 184667 - protein, 122 aa, Triticum aestivum
  Clone ID: PAT_TA_79085.pep
KEPPPRPPRADPGRAAPDPRPAELSRKMHRGPPPWPPHQIGHTRVAARWGSPATAVQATGFARPCPSTVARGEGREEGRPAGFGASARVAPGGATRPPITFVLTRLYLEHKFMINFTGRVGR

SEQ ID NO: 184668 - protein, 112 aa, Triticum aestivum
  Clone ID: PAT_TA_79086.pep
MFLQNDSGSRANIGRSSALQNSENNLKASTGRLSVSQNSDSAPKEIKPTAPSGLVPSTPQRVGTGSSTRTAGNSTYASGGTTLKRSSLKSNSTSNLHNFSKTDVVPAAVIIP

SEQ ID NO: 184669 - protein, 63 aa, Triticum aestivum
  Clone ID: PAT_TA_79087.pep
THASAPFYPNDLADLPDHIGGLLDTNARALPSGLRVHLVQALILLVNRKIVDLEDTMELFMEL

SEQ ID NO: 184670 - protein, 115 aa, Triticum aestivum
  Clone ID: PAT_TA_79088.pep
RPTRPPQVSSPRPPRVSGIATRLLPPRPRWSHPHPVHNHRSRRRTASKNRPPTPPPMGMAPRPLLRRHLPPRRPSTSTRPEAAPTGRPPPRWWTPGRARRRCCPGTFLLLRTPRT

SEQ ID NO: 184671 - protein, 89 aa, Triticum aestivum
  Clone ID: PAT_TA_79089.pep
ENTALKKRRLVEAVFEASVVKKHDRCRPLAQVVQSSVKFPRSFQCNDDSGTVVVEGGKDPLPAICQAKRSGATYLSADSGDAHSRDFIP

SEQ ID NO: 184672 - protein, 113 aa, Triticum aestivum
  Clone ID: PAT_TA_79090.pep
RGRARRDFRIVGATLPLDWSTNNTSVADFCRRTVATLWHYHGGCVVGRVVDKDFRVMGTQSLRVVDGSTFSVTPGTNPQATVMMMGRYMGLKMIAERHSRRQVNTSSYNELEE

SEQ ID NO: 184673 - protein, 49 aa, Triticum aestivum
  Clone ID: PAT_TA_79091.pep
MDLLGNPFKGVVADAPGRASWYKDDWVAGLRTGFRILAPTMYIFFASAL

SEQ ID NO: 184674 - protein, 110 aa, Triticum aestivum
  Clone ID: PAT_TA_79092.pep
STHASGYRITTNHRLQRQIKMQLSLLPDLAVEPNPLGHRSTMAPSLPPSLCREPSSSPQRRRGSRPASSTALEHTAPAFFHRAGGSSAFHQLASTPPVHHDHPFHRHPPP

SEQ ID NO: 184675 - protein, 69 aa, Triticum aestivum
  Clone ID: PAT_TA_79093.pep
GSELKAGTGLGEWAGLGCIHHQWASGRLQPRPRFGPARLSPVQLQSTRRESKTYLPLPSTPPPLTPLAG

SEQ ID NO: 184676 - protein, 66 aa, Triticum aestivum
  Clone ID: PAT_TA_79094.pep
IQSTPVTSWCISESETIGITSWILTKKQDLMTWPLRLSTCHQSFLTMEILNPHGAMGTTESVLAFC

SEQ ID NO: 184677 - protein, 154 aa, Triticum aestivum
  Clone ID: PAT_TA_79095.pep
RPRVRRPCTSHDKLKIQYDDLENADNCGKLEERVRASILALPDKLGLRCPGRLRIRPRPQQKTLVDDTALLPGTAVDVWQFNGWWEGVLVSTDAGSSDGLQIYFPGENFFCVCQLNDIRISRDWIQSRWVHIERKPDVLSRIPSAGVQTRQLDN

SEQ ID NO: 184678 - protein, 83 aa, Triticum aestivum
  Clone ID: PAT_TA_79096.pep
PTRPGRHILKYSSEAAVDTYEEIAIIIPRGRRTVELHLSFLRLHGQADDIKIQYGSIVRLFVLPKPNSPHTFVVITLDPPIRK

SEQ ID NO: 184679 - protein, 138 aa, Triticum aestivum
  Clone ID: PAT_TA_79097.pep
MLPMPPMYDVEMDFQSSQESPEVYDMSPSIHPHKLTSATSELAFHNREIMEVALVSVATGVLKPVLEKLAALLGDEYKHFKGIRKEINFLTNELAVMEAFLLKMLEEEDPDVQEKIWMNEVRELSYDMEDAIDDFMQS

SEQ ID NO: 184680 - protein, 119 aa, Triticum aestivum
  Clone ID: PAT_TA_79098.pep
RPTRPIFFWERGSAGNWRCSEIAAAPLRVWATYAARRREPSPGVRPELLRRKSAPRLPRRSSRPRKTLVGLRSQTLGAANTKAAASHPRVGVSGRHPKVEPSPTVSLIGIKAWIGNGRS

SEQ ID NO: 184681 - protein, 105 aa, Triticum aestivum
  Clone ID: PAT_TA_79099.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVGESTGVFT

SEQ ID NO: 184682 - protein, 42 aa, Triticum aestivum
  Clone ID: PAT_TA_79100.pep
SQSSHLPTWNSFQSTSATVKTEKSSMSASVKIENLFNFTLPA

SEQ ID NO: 184683 - protein, 79 aa, Triticum aestivum
  Clone ID: PAT_TA_79101.pep
GGDPERGDAVRRRVDAGTHRAGRRRQMEMRWCVPVGRRRGESRLTGKQNRLMLRCGGVGSVGKIATFIQEIERGKDGAD

SEQ ID NO: 184684 - protein, 75 aa, Triticum aestivum
  Clone ID: PAT_TA_79102.pep
TQQLSHSTFHGFYATSSLFPSLDVKLMCHFVYRLCFFFVMQRLFRCNNIENKFSGRFMSTEPANIFLFRREENLK

SEQ ID NO: 184685 - protein, 81 aa, Triticum aestivum
  Clone ID: PAT_TA_79103.pep
LTDSALVTETQVYRAHCFQTSYKIALDCLQRHCPFPAVLSRGLLLICWSMLIQVQPSPVLQSPGQGSCFLHAPRDPVDGIV

SEQ ID NO: 184686 - protein, 205 aa, Triticum aestivum
  unsure (1)..(205): unsure at all Xaa locations
  Clone ID: PAT_TA_79104.pep
STHASGSRYCKYDVRIVMSVPKITAHGKSRKLRAYKIEPPRDAPVTWDRTTALEKLRKYGAIYLTPFSHRLAEEIDDPELQRLRCRVNYHALQFKPNIMKTSSDIVNKLRSEGHFMSIHLRFELDMLAYAGCIDIFTPKEQEILLKYREENFANKTLVYKKRRLIGKCPLTPEEVGLIIRAMGFNNTTRXYLASGKLFGGERFMK

SEQ ID NO: 184687 - protein, 107 aa, Triticum aestivum
  Clone ID: PAT_TA_79105.pep
RDACSCISLTDIFSFVPAARESAHNDVCLNALGCGGSELVTSSTPTCDVYPTHSQTTCAVVNDQVSYSITDDKREQRNARRRATYRKKKDDQVKLQNEKQNVSPDAW

SEQ ID NO: 184688 - protein, 103 aa, Triticum aestivum
  Clone ID: PAT_TA_79106.pep
MTPHLPVSSHPAHHLLDALPPSPHHRRLRRRRRFCPPRPRASSSSSLRCRAAAAAAPQPAAAAADEARTRVFVVSDLHTDYPENMEWVRRLAVRAGPPGAGEG

SEQ ID NO: 184689 - protein, 92 aa, Triticum aestivum
  Clone ID: PAT_TA_79107.pep
THGHKGTILLLRQGSPSRLEIISLQQKKISIPEIQFQMVDFVKFQLNRVSLNCGTWSHKTIQSFMVSAKMRVRFAIKFRMKIPPQRRLGHNI

SEQ ID NO: 184690 - protein, 171 aa, Triticum aestivum
  Clone ID: PAT_TA_79108.pep
DPASGAHSTPPMFPRPRGMTMAGMQRMVPGLMPLQRPFMAPSPGPSPTQQNQRTEEEDLKDLEVLLSKKTYKEKQNTKTGEELLDLIHRPTAKETAVAAKFKTKGGSQLKEYCTNLTKEDCRRQSGSFVSCAKVHFRRIIAPHTDTNLGDCSFLDTCRHTKTCKYVHYELD

SEQ ID NO: 184691 - protein, 95 aa, Triticum aestivum
  Clone ID: PAT_TA_79109.pep
GSRAVRRGWRAAIPVHTEVVVLVAYEEQRSVAVALLLVAIHAVAGLSLPSATTDSIRLIPAKPYKIRGVCGVGFELDVRQREGERETNTGGTGEM

SEQ ID NO: 184692 - protein, 204 aa, Triticum aestivum
  Clone ID: PAT_TA_79110.pep
MVQYEKLLITRSAKDKLEHLQNQFVDLTSENSGLNSEIGELKSRITDLQKTQEAVMVQHVEECQVAEDKIRRLESEAEISASNVKCLEKLSSELQGRVQKLLEDSSLAEDQKEELLQKTLKLESDNQELLGRVQSVLDEKSNDTESLHSEIAKRDQQVDTQEKQISELRSVLDEKEQLYISSVEREKSLEEQKLQIQASLAATE

SEQ ID NO: 184693 - protein, 176 aa, Triticum aestivum
  Clone ID: PAT_TA_79111.pep
PRVRPDIAAKAIAGCKALVRLDLYMNTLVGPLPDALADLPELVYLSLEANNFSGPIPESFGTFKKLQSLSLVNNLLGGKVPVFLGRVATLRELNMSYNTFAPGPVPAELGDLTALRVLWLAGCNLVGSIPASLGRLANLTDLDLSLNALTGPIPPELAGLTSAVQIELYNNSLSGP

SEQ ID NO: 184694 - protein, 69 aa, Triticum aestivum
  Clone ID: PAT_TA_79112.pep
MAFPSADGGSDAGSGEGVAGADSGARGHARGHHPGEGADSGGRGHARGHHPGEGARGADSGGRAHARGY

SEQ ID NO: 184695 - protein, 53 aa, Triticum aestivum
  Clone ID: PAT_TA_79113.pep
THASGMSLAMMVTRIPPLGSPSKPPPPRPPIPCELHTASHRISHSSSPRRRSS

SEQ ID NO: 184696 - protein, 100 aa, Triticum aestivum
  Clone ID: PAT_TA_79114.pep
LVARSSGPGNAGHNESLTEKYLGLPSDVGRAKEGSFKYLKDRIWKRVQGWMEKCLSAGGKEVLIKSVAQAIPTYSMACFKLPRGLCEHINGQIRKFWWGS

SEQ ID NO: 184697 - protein, 64 aa, Triticum aestivum
  Clone ID: PAT_TA_79115.pep
SYRTHPSRLPSCLHETVRPRHLHPPRSHTSSALSSSFCSARPPPPPPAASDRAPRPALFCSTNR

SEQ ID NO: 184698 - protein, 89 aa, Triticum aestivum
  Clone ID: PAT_TA_79116.pep
MAPAQQVQVSPPPILSVLETTLVTPSPSAGAAPPECSLPLTFFDVLWLTSPPVERVFFYRLAADADVPAILSNLKTSLAKALSAYYPLA

SEQ ID NO: 184699 - protein, 138 aa, Triticum aestivum
  Clone ID: PAT_TA_79117.pep
RPRVRSEVSRESGLVIIDNSVALVETLMDERRWSDMFSCMIAKATILEEVSNGIGGSRNGALLLMKAELQVLSPLVPIREVIFLRFCKQLAEGAWAVVDVSIDGLLSNQNSATTSAGANLKCRRLPSGCVMQDTPNGY

SEQ ID NO: 184700 - protein, 144 aa, Triticum aestivum
  Clone ID: PAT_TA_79118.pep
MPRKLDGAAGYASSAELYRDLLLLCANAAVYLPRHAPDHAAAALNALRLVSAQVSASLRESPTKREPPSGANPPPAPAVGLDPRRAEADIVGPLIQKAAKPLIFCRKRSSIAKAAAAAAVARKEEAAEKRDVEEEAESDGEKKA

SEQ ID NO: 184701 - protein, 101 aa, Triticum aestivum
  unsure (1)..(101): unsure at all Xaa locations
  Clone ID: PAT_TA_79119.pep
LSAHPSLSPAAAPAPPPPLKSPATAEAPXPSSSPSPGRRYEALSHPSPPPLPPPPPIPTTLSYPHNQEQPPFPCLPSPPXDDASPPAAAPSAPPPPPPGAA

SEQ ID NO: 184702 - protein, 101 aa, Triticum aestivum
  Clone ID: PAT_TA_79120.pep
WLPGRRKGLATKHVMWCERRGSQPHGEQGQRAHCAHAFAKKKGERTNLTPGGRDGCSSLYSPGNRARASSQSCRDNHPPDAALPDSVATCLSKTSLGRVGR

SEQ ID NO: 184703 - protein, 108 aa, Triticum aestivum
  Clone ID: PAT_TA_79121.pep
EPRCCLLPSSTGPLLLLHPDFLLLVVYPAVGGDWFQIWRKLGEPCGGVKGQGRRATRTSNCRPVVGEATGKREEAGDRVKEHAGPRGGGVAGQGPFAIAGLTRPVYSL

SEQ ID NO: 184704 - protein, 143 aa, Triticum aestivum
  Clone ID: PAT_TA_79122.pep
RVRKKIPNTALMVLEIVASGHSFGASSFHVLSTCRMLLLKLLDVPGHLVAQTGCPSDCVCDQPPNWKTEELTLYCLREVEIQNLRGTEHETALMKRLFRWATVLEKMTVTFHFSVADSKAKEFCQMLRSFCRPEISIKGQRFA

SEQ ID NO: 184705 - protein, 84 aa, Triticum aestivum
  Clone ID: PAT_TA_79123.pep
TRPTKISTLLYTEQPGAAWHVQFRPSFPPPGSTRRRPRHRCPGAAYSATPHADPATRGEQDEAGAFRVCALERQTIPLIASGRR

SEQ ID NO: 184706 - protein, 214 aa, Triticum aestivum
  Clone ID: PAT_TA_79124.pep
TGPEFSGRPTRPEICTKFTMNDSNKEIVKDIGLIGSNGVPSFVPSPASYLEPPVILNKNKKDDIPNDWVSSLEECQAMSAQKLGQEGSNSGQNCSGSTGDENVSKSKKPASDSTSCEEASSATDKPTRLLAVNGGLVPESSLRPVIGRNSHILKQQKINLLDIDAALPEEALRASKSQQIRRRSWRAFVKHAESISEMVLATSVLESMIKSEFL

SEQ ID NO: 184707 - protein, 61 aa, Triticum aestivum
  Clone ID: PAT_TA_79125.pep
MAAAAASAEAAAITRRLASCNAGARERAVRHLLADFLPASAPHLSATDLLKLWKGLFFCFW

SEQ ID NO: 184708 - protein, 154 aa, Triticum aestivum
  unsure (1)..(154): unsure at all Xaa locations
  Clone ID: PAT_TA_79126.pep
QEYHADEQAICAVGLARAKPGIFVEAIQYILXLATPVEVMLVGVCCSASADGTDPYAELSLQPLPEYMISTDGVTMTCITCTDKGQIFLSGRDGHIYELQYTTGSGWRKRCRKVCLATGLGSLLSRWVLPSAFNFSAVDPIVDMVIDEERNTIY

SEQ ID NO: 184709 - protein, 80 aa, Triticum aestivum
  Clone ID: PAT_TA_79127.pep
RPTRPQGAHSEARYRGVIDCVRKVYHAEGVAGFYRGCATNLLRTTPAAVITFTSFEMIHRFLLNLGSPEPEQHHPHPLKH

SEQ ID NO: 184710 - protein, 95 aa, Triticum aestivum
  Clone ID: PAT_TA_79128.pep
PPLVPGSRRIQTPCDGIATEREHETDQERSEREHGEAPPPPIPRPPGAAKPSVNPSAPSPQPAHLPPHPWTSTPTTTRTPISTRASRRTSTWAAA

SEQ ID NO: 184711 - protein, 73 aa, Triticum aestivum
  Clone ID: PAT_TA_79129.pep
SNQVHSKKLTSSSPPRILTLLPAQPKLSHTADQNPQKPMAKIADGDESQHGRNEVDRDRRWRRHAERIGGEGG

SEQ ID NO: 184712 - protein, 200 aa, Triticum aestivum
  Clone ID: PAT_TA_79130.pep
STHASELIQNELTVKVYETHARLALQAGDLAEFNQCQSQLKRLYREGNNGCYFEFSAYNLLCVMLHSNNKRDLLSSMASLSKEAKQDGAVKHALAVHAAVSSGNYVIFFKLYKQGPNLNSCLMDLYVERMRFEAIKCMSRSYRPTVPVGYVAQVLGFLPNGDDRSEECEIWLKAHGAVLSVDNGGELQIDTKVMISLWTM

SEQ ID NO: 184713 - protein, 67 aa, Triticum aestivum
  Clone ID: PAT_TA_79131.pep
VYFHQEGEVVVAANGGQNEELNGDTHSANDSANRLSVLLPPAKRKEMGYPPPTMEKARYEGLTPRFV

SEQ ID NO: 184714 - protein, 153 aa, Triticum aestivum
  Clone ID: PAT_TA_79132.pep
MFHVYGLSLFAAGLLSLGSTALPMFHVYGLSLFAAGLLSLGSTVVVMRRFDVGEAVRAVHRYKVTHLPLVPPIMAALLRAKATGASSLDSLVQVSSGAAPLSGKLVQDFIKAFPHVDFIQGYGMTESTAVGTRGFNTSKHKKYASVGLLAPNM

SEQ ID NO: 184715 - protein, 116 aa, Triticum aestivum
  Clone ID: PAT_TA_79133.pep
MVSFDINDRTKIGLGLTGFGVLFSFLGILMLFDKGFLAMGNILFVSGVSLTIGLKSTVQFFTKPKNHKGSIAFGIGLFLVLIGWPVFGMMAESYGFAVLFSGFWPTAAVYLQKNPT

SEQ ID NO: 184716 - protein, 112 aa, Triticum aestivum
  Clone ID: PAT_TA_79134.pep
MAESPRSAPRRTPAAKSGAGLLSPRFRSAAELAGWDEESILLAALVVEDTPVRESRRKRRPSGSSTAGGSAGSNTRKRRSRRQSADETPIPPVALVLDDDEKPNDHEGGKKE

SEQ ID NO: 184717 - protein, 166 aa, Triticum aestivum
  unsure (1)..(166): unsure at all Xaa locations
  Clone ID: PAT_TA_79135.pep
ASALSPAVAGLRALTGLYLHYNALRGGVPRELARLTWLTDVYLNVNNFSGPIPAEIGAMASLQVLQLCYNQLTGSIPTQLGLLNRLTVLALQSNHLNGAIPASLGNLPELRRLDLSFNHLFGSIPVRLARLPQITALDVRNNSLTGSVPXSELAKLEGGFQYGNNT

SEQ ID NO: 184718 - protein, 94 aa, Triticum aestivum
  Clone ID: PAT_TA_79136.pep
RPTRPSVALVFDPNLFPQPPFQAPHPLHYLDNGGGGPLCWRRRRGEMVARRRPSPHASHPPSSSRIPPDPRRAGAAAICKGRATVESIQWILDP

SEQ ID NO: 184719 - protein, 225 aa, Triticum aestivum
  unsure (1)..(225): unsure at all Xaa locations
  Clone ID: PAT_TA_79137.pep
TRPQEEKLDWEARLQIALGTAQGLAYLHHDCSPRIIHRDVKSKNILLDKDYVAHLADFGIAKSVCISKTHTSTYVMGTIGYIDPEYARTSRLNEKSDVYXLRHRLARVADWEEASXNECNLHHLILSKATDNTVMEMVDPDITATCKDLGEVKRMFQLALLCSKRQPSDRPTMHDVVHVLSCLVCPEAPPKPAQPPASPQSSTAPSYVNEYVSLRSGSALSCANS

SEQ ID NO: 184720 - protein, 210 aa, Triticum aestivum
  Clone ID: PAT_TA_79138.pep
STTRPLRGSNISPVQAMLKRPEGKTWVVELEKVDRCVFLTTGWPKFVVDNSLREYEFLLFRHDKKMDFMVSIFGRNACEKAVRSSGSATESLERILPTCKRGHSGDELTKTTNNLRQSHSLVMVPDQSDTKIFPFQGSTQGNGHISPQSFADIHLHEVDGLKDELKIYLLLKVPMDDDKAKVIAEVMSRLHVDRATVDLFCATLCLYKWD

SEQ ID NO: 184721 - protein, 64 aa, Triticum aestivum
  Clone ID: PAT_TA_79139.pep
IEASDKSSRFSILDRDSRLNLNSLPVEKVAGCHLKSLQINKPTHTIVHPIAVVEKSLELLQFEF

SEQ ID NO: 184722 - protein, 149 aa, Triticum aestivum
  Clone ID: PAT_TA_79140.pep
DPASAPLQQVHTQVASPPGPSPQEQVVQLCSELRRALSPLLAQPTSRDLPKQQRRPRQKRPLVSSPRRSVRLAKGGRGSKASKQQTVLIRKLCLANEGNQIDDDALQAYVKLSDKPLLDCHVRAILALFGWDASVLPLQSEEEGRVEGQ

SEQ ID NO: 184723 - protein, 214 aa, Triticum aestivum
  Clone ID: PAT_TA_79141.pep
HASVERVALTHSVSSYPPPPRLRRAQAFPTEFAASASMSSRPARRRSSASATAETAGARAAKAASLENKRAALGNLTNVAGGRTGGADAKSSSSNSVAYVKKGSSAGLPNVNRKVASATKPTLDRFERAISHHGNALQKENVCCPSVPTLAPHGSWPGLSHDSVSMEDDMLTCNSVESPGPLFLDNAASSVATSLRRCANDKLPVSDNRDTTVS

SEQ ID NO: 184724 - protein, 122 aa, Triticum aestivum
  Clone ID: PAT_TA_79142.pep
LTRAELTPHIHTSIECKSCFYHANNNPRVFFLTILCYSDSSSPSPYHPHSYRYSYLPTPRRRWRCSRQLCGCRCGCCCRSTRPCTSPRRRRRRTRGTPAPPSSSRWPAPAARRARPRPDAWV

SEQ ID NO: 184725 - protein, 97 aa, Triticum aestivum
  Clone ID: PAT_TA_79143.pep
CKTTLRVVKQTNRDPAIFTRPPWKRSSHFTVNALLPLHNRSNLTRQFSTVYSDTLSPPNTHTHTQASPEEGDSPFSPTRCVFYWTHRRACYLLGAPG

SEQ ID NO: 184726 - protein, 205 aa, Triticum aestivum
  Clone ID: PAT_TA_79144.pep
RPTRPVQSSPNGFPSSDAALPTKQGRFDLELRADHYFEDDHASDSKPIDFLGVSSDTKRPNDAGAALARAEGLGRFGHNSATSFPPSTGNLVGHNHNVADLNKPILGPYMARTNGAVSGGPSYTLENSWQQSPWRSSTTNSSFNKEYSKDKRINEATSSNFFDASSRIKQEEKPLIDKGKRASSTGFLAPRCNGMDPQKMFSAAD

SEQ ID NO: 184727 - protein, 126 aa, Triticum aestivum
  Clone ID: PAT_TA_79145.pep
RPALYAHLHRRAVLHRVSFKAAPSAVRFSPDGELIAVAVGKLVQIWRSPSFRKEFFPFHLLRTFPGFAAGVTSFDWSPDSASLLVACKDLTARLLPVKRGTGNKPFLFLGHRAAVVGAFFATDKKT

SEQ ID NO: 184728 - protein, 125 aa, Triticum aestivum
  Clone ID: PAT_TA_79146.pep
STPRPIKSDARNFQSKPQPQLRRRKCGAGAGAAAAGGTRRRPSPRRRSTAPRCRTPSASRGTSTTPSPAATPTPSACAAAAPPPSARGRPPTPAAPSPASPTAPRRPPPSAPSTPTSPPPPSTSA

SEQ ID NO: 184729 - protein, 76 aa, Triticum aestivum
  Clone ID: PAT_TA_79147.pep
FSSKKRRDSLRETLVPSGEKLRRLEKEKGIVVRFVIGRSGAAEGGGGAADRALDAEEAEHKDFLRLDHVEGYHQLS

SEQ ID NO: 184730 - protein, 63 aa, Triticum aestivum
  Clone ID: PAT_TA_79148.pep
ALVWFRGSRLPLPLPLAPQGPRRPLQQEEPRYQVSSTLKWVLGRTGKREMTIQLMWKWNDMLN

SEQ ID NO: 184731 - protein, 89 aa, Triticum aestivum
  Clone ID: PAT_TA_79149.pep
STHASEAEMSAARRERAGLVDASRTAGAETPHPRREEEEEEQMMVAQPSSSSPHMWQPVRAQAAGQDAPPRHADGLTREAVRPGGARAS

SEQ ID NO: 184732 - protein, 165 aa, Triticum aestivum
  unsure (1)..(165): unsure at all Xaa locations
  Clone ID: PAT_TA_79150.pep
RPTRPLFDIDVLTMSFAPKDEHEAQVQFALERGIPAISAVMGTKRLPFPGGVFDAVHCARCRVPWHIEGGKLLLELNRLLRPGGYFVWSATPVYQKLPEDVEIWEAMSALTRSMCWNVVNKVKDRINRVGVAIFQKPMDNRCYDGRSAANPPLCGEFEXPDAAWN

SEQ ID NO: 184733 - protein, 105 aa, Triticum aestivum
  Clone ID: PAT_TA_79151.pep
SNSEVMGGYTDCLVIYLDTDFDRRAHACIISKHHLNQTDQPINIHHRFTIPPQHVNAKAALLSTKFLFISILDSYRDKIQASPRSPQNLTRFLLFDDPRHLSGLG

SEQ ID NO: 184734 - protein, 129 aa, Triticum aestivum
  Clone ID: PAT_TA_79152.pep
DPRVRWRTWHIGMGNGLHRLQVEIAMRGIGLLKVGGRMVYSTCSMNPVENEAVVGEILRRCGDSVELLDVSNELPELIRRPGLRTWKVRDRASWLGSHNDVLHYRKNAILPSMFPSGKGTTDSCTAGGS

SEQ ID NO: 184735 - protein, 85 aa, Triticum aestivum
  Clone ID: PAT_TA_79153.pep
ECASGEAATRAANALHPPLAIAAVMFGGAGGPTGALAAAAAALPPAAETARGRKTARTAAARWRRRIMASVGVGARQWSDRVADA

SEQ ID NO: 184736 - protein, 59 aa, Triticum aestivum
  Clone ID: PAT_TA_79154.pep
FHHCLCICLFSVMLIRPFYLNCVHLFVADIRKGVKVFLLFSTKKKKKKKKKIKKKNEEK

SEQ ID NO: 184737 - protein, 78 aa, Triticum aestivum
  Clone ID: PAT_TA_79155.pep
DPRVRQLPLPHSVQPWPPPPPPASSSSTPARPPPSRAQTLAPAPPIRPAPPTRASRSPTAWRRPRRRSPGPPATPSAT

SEQ ID NO: 184738 - protein, 62 aa, Triticum aestivum
  unsure (1)..(62): unsure at all Xaa locations
  Clone ID: PAT_TA_79156.pep
MKYVVVTGGVVSGLGKGVTASSIGAVLKACGLRVTTIKIDPYLNTDAGTMSPFEXHGEVYVL

SEQ ID NO: 184739 - protein, 64 aa, Triticum aestivum
  Clone ID: PAT_TA_79157.pep
STTRPAVVLVHLVSSSALFGKALLIEVSSSSAFQKKRYCLFFLFFIATYFCCICICFIYSTFII

SEQ ID NO: 184740 - protein, 125 aa, Triticum aestivum
  Clone ID: PAT_TA_79158.pep
STHASGEAYPGRLHGVQEVLLLLAPPTRRQTLMPPSFQEIVDVGTTDSCNCALAVQGYRGRGGLDDGEGSCLQPDASHLEGSNPADKEMPSSYIRLGRAIFASLSLNLVWLDQLGRPSGGRGRPH

SEQ ID NO: 184741 - protein, 202 aa, Triticum aestivum
  Clone ID: PAT_TA_79159.pep
THASGMVSLQGRLFHNIIKHINRPPALAQATLLSRPYRTVPWHGEVLASTHRRLFSRILPHNSRLPALARGALLPRCFYTTTRQFKDMESIRRLLFRGITPGIFLPRWYFSAPLQQQQILGPIRGLFFGHIRQVVCRPWQYCVAPSRSAIHFARSYFGCLWKVTVAAAFINIMWSFVYHTYLVRVPYTSQTRFLRFETVPYT

SEQ ID NO: 184742 - protein, 44 aa, Triticum aestivum
  Clone ID: PAT_TA_79160.pep
PTRPSPSFSPVRNPTPAPTEALTLLNGKWILAYTSFSQLFPLLG

SEQ ID NO: 184743 - protein, 183 aa, Triticum aestivum
  Clone ID: PAT_TA_79161.pep
HASDDDYGDYEGADSDWSASWLQLLAAKAVQELVLVNRRRPLDVVLPATFLRTATLTRLHLCFWKFPSTAGLPPGVSFPNLRELGLYSVVVEGRDLDFMLDRSPVLETLCLEGNLFTLRLRLVSQSLRCVQIIGSFLEEIFVVNAPLLERLINLEGWTHEAGCTKVKIGHAPKLQLLAYLQLD

SEQ ID NO: 184744 - protein, 201 aa, Triticum aestivum
  Clone ID: PAT_TA_79162.pep
VDPASELVLFYAKHGDVAAARRVFDGMPHRSVVSWTAMVSGYSRNGRPQEALELFALMRTSGDARPNQFTYGSVASACASAGCVRSGEQVHACAAKGRFVGDMFVQSALMDMYLRCGSVADARRMFVEMERKDVVSWNALLRGFVERGHCSDALGLLSSMLREEMLPDHFTFGSALKACGAVSVLTNTELIHTCIIKLGYW

SEQ ID NO: 184745 - protein, 91 aa, Triticum aestivum
  Clone ID: PAT_TA_79163.pep
PRKAPPAISVSAMEMEHAVIQQQVVEYPEEHEVEVDVDNIMKTEVAYGSGVHSTAFRYKHKKRSKVWEEYKPIFLNGKVQFAECLYCHNRL

SEQ ID NO: 184746 - protein, 164 aa, Triticum aestivum
  Clone ID: PAT_TA_79164.pep
CLLLLELCTSGELSSSLQDKNSAILVCLIDVEGDSLLQRVPAIYGDQPAYGTKTSQFLPFQSGSVDIITFKGPKLQTIKEIWIGLESGSWRLDGLNMKVIHGARNTPEDLEGTLELKFSGLQYTFDKLGAVLGEDGASVVEARPIAVTDLSGINISDLQEGQLS

SEQ ID NO: 184747 - protein, 90 aa, Triticum aestivum
  Clone ID: PAT_TA_79165.pep
CLSAVDLQSNGSWSGVPLRTQVPHPQPTDLRMNGSRGCNASEFTKHCTLLNMSLSYFSLAEPLFNVSLACGEGILDVSGLCPLSRSAGEP

SEQ ID NO: 184748 - protein, 73 aa, Triticum aestivum
  Clone ID: PAT_TA_79166.pep
SLAAWRCRWRRRGRRRHSARTALPPRMTKMLSVAVNLPPIQILFSEENLTKQNLKSFIESQPDALLQNSTIFY

SEQ ID NO: 184749 - protein, 117 aa, Triticum aestivum
  Clone ID: PAT_TA_79167.pep
MPPPTPRTKRPEAARLLLLTTFLLLLLTFLFAQSAFAADDHHDGGHHARMLLDANAEDSISGVQTVLSAAMTNQYTCLEGFAGPSASEDGRVRPFIQGRIYHVAHHVSNSLAMVRRL

SEQ ID NO: 184750 - protein, 78 aa, Triticum aestivum
  Clone ID: PAT_TA_79168.pep
LEEVLVSLLIHYHSSHFSSAHVVGHTLLLKCLKQQESDLLWSLIPVFSPPFKHFFRWCMQILQLSSIDILIRLKNSRL

SEQ ID NO: 184751 - protein, 69 aa, Triticum aestivum
  Clone ID: PAT_TA_79169.pep
RAPGQRGRRRSAPGRCCCCSGRCCPSRTWPAVRRRPARPRPRRDQITRAVGAIRTAGQETGGISADAWV

SEQ ID NO: 184752 - protein, 147 aa, Triticum aestivum
  Clone ID: PAT_TA_79170.pep
PTRPLPPSPPVTQTHSPPGSSPAAPWPCLPRSTPSPPAPATTHRHPPPPQLPRAIGPRHHPPRPAPDHHPPRPAPGRHPPRPTPGHHLRRLPWLPPTVACPTPPRPDPLMGRASSIVVPTLDLQNQSAVPSPDLQRRSPAPTSILTS

SEQ ID NO: 184753 - protein, 48 aa, Triticum aestivum
  Clone ID: PAT_TA_79171.pep
KQITVILILFWKGQMKSEISVCSILNSSRWGELFWVKVGRFNFRTRGS

SEQ ID NO: 184754 - protein, 67 aa, Triticum aestivum
  Clone ID: PAT_TA_79172.pep
RETTLASLGAAHKDLPRRGMHTYATSLHVTRRIGELHTFCMDVYSCTILVCMSAAVACQLVLGEDAF

SEQ ID NO: 184755 - protein, 77 aa, Triticum aestivum
  Clone ID: PAT_TA_79173.pep
MIPCLGWSTLLLPMFKGVTVLRNFALNVMFKLVAKYYTNRLAHLAHHIVKSCQSASIKSRHILELVLSLYEIVCDVS

SEQ ID NO: 184756 - protein, 62 aa, Triticum aestivum
  Clone ID: PAT_TA_79174.pep
VDPRVREEQALRGGQLGHHARLRQGQYKDRLNWQWAAGWLCFLLSKAKGTRCWPSILLRITI

SEQ ID NO: 184757 - protein, 54 aa, Triticum aestivum
  Clone ID: PAT_TA_79175.pep
HVHQHCITFSKHANKTDFIGNPTHSRRTHLAKQHVRTDHNVPAQAICLIVSGRG

SEQ ID NO: 184758 - protein, 234 aa, Triticum aestivum
  Clone ID: PAT_TA_79176.pep
GPEFSGRPTRPAPDSSKGQLAQLISSILDIISNMRHLCAFYQMEKLTLELHTLFMSSSDNSKAVLSQCKPSLASFMAILGHLNSSEDDSNSLCSAMPDLYHLLVRERHWALVHLAMGSFGYFAARTSFTQLWRFVPGDAALSYNTNTGVDIDENGFMLELRAFLQKEVALRADKWSEEQVCFLVSEGRVLKKLVEKTSEIPQAPEREEKAAISMDVNTKKRKMPDGIGKGMALL

SEQ ID NO: 184759 - protein, 206 aa, Triticum aestivum
  Clone ID: PAT_TA_79177.pep
RPTRPGQTCPGKGQTDGNMTGDGDDSVLDLAWKMLNTARVIVAKSPEKTMEKVNILNALAEISMTREDRDKSIGYYFEALAILEHLVGPDHFRIVDLNLRIGLASKVGDAIRYSTKAISLCMSHIHNLEIAKEALLADIHNLKIAKEALLADIHNLKIAKEALLADKDLASAAKGHSKSTLEDDISYLARMSSRVQKKLEELKQAM

SEQ ID NO: 184760 - protein, 146 aa, Triticum aestivum
  Clone ID: PAT_TA_79178.pep
EALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAEL

SEQ ID NO: 184761 - protein, 141 aa, Triticum aestivum
  Clone ID: PAT_TA_79179.pep
PPARNGVPAAGSPTLFASPKGRISPPSRTRRLFAPPRSQLSQRSSPTRSSSRREPAHTGVRRRGMPPLLRPANHSGVAPLTSGGALLSHWPTSTSTPTAALRLQVTLASILRRQILTTPSSTDIIVNLQSDKSAFMCIALY

SEQ ID NO: 184762 - protein, 85 aa, Triticum aestivum
  Clone ID: PAT_TA_79180.pep
MRHHHLPLFVLLAALAVREAAGGDADALLDAKAGLDDPTGSLASWSNASTGPCAWSGVFCDARSGAVVGVDLSGRNLSGAVPRAL

SEQ ID NO: 184763 - protein, 112 aa, Triticum aestivum
  Clone ID: PAT_TA_79181.pep
STHASGNGPLFFLPFENQQRGALRDVWKVCDKAGLQPWLAILCLSEINFRPAQPFPSVNLKSTHERESWQGPKYTSVLLVSSFALPSPSPLLLAADLWIPRRRSAEPSAPCP

SEQ ID NO: 184764 - protein, 183 aa, Triticum aestivum
  unsure (1)..(183): unsure at all Xaa locations
  Clone ID: PAT_TA_79182.pep
APCTLHTTRPDRSHPIIXTRGITLQIFSFKIAKISLDLEWPLLQWPLKVYGVIAARDSVDRKRNVLFHRLRDNFQEITEKDSFLCLTGPSRAISAESPLEFEVELKLKGGEAKSEDSVLINRKGHYNGYDTHNGFYTVTFDNCLCTTELSLQKLYSGAVQATFLRVGIVKGSQSPFSYGGRVA

SEQ ID NO: 184765 - protein, 106 aa, Triticum aestivum
  Clone ID: PAT_TA_79183.pep
SCEAISSIDVESPDAAAFRSRRSICGSLCPPYDELAADVLSAIDILILTDLKGKALEYSTGEREMLLFNSLQWDIYTYSGQTSNQPVDEKQPINLFIFVDHKCAHM

SEQ ID NO: 184766 - protein, 131 aa, Triticum aestivum
  Clone ID: PAT_TA_79184.pep
GSEDSLSDAPSVLAAPATSVDPVGPSLPADLPPDGLVARALAHRQLLEEVQGDWPSGGRHHLRDLLLLYSPTRHGSQPWHNNYHLWPGNGGNSAASIIAAGVSSFFNHGPPTYDLPPLPAALPPLPLSLGS

SEQ ID NO: 184767 - protein, 115 aa, Triticum aestivum
  Clone ID: PAT_TA_79185.pep
RAPPPLRRRRSRLHNLLPLPKTLISAAAAAAAWPSTDHTTTATAATGQGSGAQMNASRLGQWHGNPSGAGPDRCVAIWEPRRRTLGLVSVREKTGQGAEDVAAQGERERERERGL

SEQ ID NO: 184768 - protein, 130 aa, Triticum aestivum
  unsure (1)..(130): unsure at all Xaa locations
  Clone ID: PAT_TA_79186.pep
VDPRVRWASTHNGTLAGKMSAVVDALHACQQAPANGGTGYLSAFPAEFFDRFEAIQPVWAPYYTIHKIMQGLLDQYMVAGNGKALAMVVAMAGYFGERVRSVIQRHSIERHWTSLNXETGGMNDVLHQLY

SEQ ID NO: 184769 - protein, 73 aa, Triticum aestivum
  Clone ID: PAT_TA_79187.pep
DPRVRRAELFLKTAQPPGRGRWGKGRFVVWWRRRSRTYCFLRRRMHCSIPCGGSIVGLSSSCAGAVCRQNIFS

SEQ ID NO: 184770 - protein, 54 aa, Triticum aestivum
  Clone ID: PAT_TA_79188.pep
KLHGNSIEAPSTPVDPLHPSDASLQPRRSSDVPDGTPLQPRRSSIATAAKLQRP

SEQ ID NO: 184771 - protein, 80 aa, Triticum aestivum
  Clone ID: PAT_TA_79189.pep
MPPATGSAAGLAAAVLAASAPRAAAEAVSSVADFLRRHHSGADQPRAFFADALPALLFRLFVSSSPASPCFLDFAAGDPA

SEQ ID NO: 184772 - protein, 57 aa, Triticum aestivum
  Clone ID: PAT_TA_79190.pep
PKEEVIKQNTSNSHKSECNKNDPYIGDISMAAQKEPLMDELVAGDAVQKENIIQEDM

SEQ ID NO: 184773 - protein, 191 aa, Triticum aestivum
  Clone ID: PAT_TA_79191.pep
PVRNSSVDPRVRKAIRIEGQWKEVEERKVCVMKEYADIREGIEVPPETLDKGMDLEGTGIDFAGNYSLDFGSCSRKECKEELKTTERNGNIMKEYADIREQGIEVPAETLNEGMDLEGTGVDFTGNYSLDFRSCSGKECKEELKTTEGNGSVMMEYADIIEEGIEVPAETLNEGMDLEGTGVDFTGNYSLD

SEQ ID NO: 184774 - protein, 77 aa, Triticum aestivum
  Clone ID: PAT_TA_79192.pep
DILVKFNVRIVCIEELRIISTTYQITTIHWLIMKSKKLLGISYPILTYTNYSATNGSVYVQSINRICNTIKANMSKR

SEQ ID NO: 184775 - protein, 45 aa, Triticum aestivum
  Clone ID: PAT_TA_79193.pep
FFFFFFFFFFFFFFFLHLVMPPMGVLKDTFIYFPVASTGTCASWL

SEQ ID NO: 184776 - protein, 104 aa, Triticum aestivum
  Clone ID: PAT_TA_79194.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKA

SEQ ID NO: 184777 - protein, 83 aa, Triticum aestivum
  Clone ID: PAT_TA_79195.pep
IDCHFGNYVIQKMFEHGDSEQRRDLAKKLAGHVLTLSLQIYGCRVFQKALEAIELDQKIELVRELDGHVLECVRDQNGNHVIQ

SEQ ID NO: 184778 - protein, 98 aa, Triticum aestivum
  Clone ID: PAT_TA_79196.pep
RQTDLIQISTTVPEGIQISTTVPEGMTVDVPRHLARDPGHVDLRPAPDLMMKMCKHLEHLSKYTTKKFRFFLSIFKKIPNPSSNELKLKRVLSEIVHT

SEQ ID NO: 184779 - protein, 155 aa, Triticum aestivum
  Clone ID: PAT_TA_79197.pep
APVTTGLNIWHCPAEFANQENSVLTVGREGWGSMSRHRGIVWMRCMHVGSCHQPLCPGNQYRPSSGQQPSTRYTRAHHVVQNHSRLPRMHTLSSLSAVKEQQARVLVLSTVARSTCTLVTMHLPLHMQQLWRSTDRACTFVRLRVRPCMLRCSYV

SEQ ID NO: 184780 - protein, 78 aa, Triticum aestivum
  Clone ID: PAT_TA_79198.pep
KTYSLYPAYDAGKPPDHEHGEGSPSPVFLRCSTPVQSSHPPLAGPPAGRGPAPDPAPPPPWAASAGRLGCHQSPLDEA

SEQ ID NO: 184781 - protein, 61 aa, Triticum aestivum
  Clone ID: PAT_TA_79199.pep
FSISCMRSRWILTIEDGGPWSSSDAPGGDLHLELQRFDDLQLHVLLPFISMCFYLLRAPIV

SEQ ID NO: 184782 - protein, 150 aa, Triticum aestivum
  Clone ID: PAT_TA_79200.pep
STHASAHGAPVSASYGLLGNGGAAVPVAPVFRPPASRARAEPPRARRGAGPADSAPRDEASRPATRARQEPPSPVQVRRSSEFAHSGPQNEGYSDSDDDSRRSVSRESAPSYQGQSDGGRHAMAAPEGRRSHVVTFGLADDIKYDQSSEL

SEQ ID NO: 184783 - protein, 77 aa, Triticum aestivum
  Clone ID: PAT_TA_79201.pep
ISQKHGAGRKTRAGCGRGSRSGSQASLIEPRRRDLPPPCAAGSGLGAAGAPGIGCGGGVEIEFVCQPPLVTHWRTRG

SEQ ID NO: 184784 - protein, 169 aa, Triticum aestivum
  Clone ID: PAT_TA_79202.pep
VRTTLTQHIYRNQQVQNHFPVRIWMCVSFNFNLDKVLEQIEVGTRPVESEKEGSTTEKLIEERLKSKRFLLVLDDIWQISDVGDWEKLLSILNQSQEKGSMVLVTTRFRAIAQVVKTTGHSIELDGLNSGEFRKLFLTFVFGDEQCPRDKHFLLETGDKIMEKLKGSPL

SEQ ID NO: 184785 - protein, 225 aa, Triticum aestivum
  Clone ID: PAT_TA_79203.pep
VDPASEAGALEVVRLLLPLYDLEAAKLRSRLDLDAFHVAAKQGHTEVVKEFLGRWPELCSVCDSSNTCPLYSAAVKDHLDVVNAILDTDDSCIKIVRKNGKTSLHNAARIGYHGIVKALIERDPGIVAVKDRKGQTALHMAVKGKNIDVVEELLMADVSILNVRDKKANTALHIATRKWRPQMVQLLLAYDSLEVNAINSQNETAMDLAEKVPYAESKMEIIEWL

SEQ ID NO: 184786 - protein, 155 aa, Triticum aestivum
  Clone ID: PAT_TA_79204.pep
MAMEAAIIGALLKTALPKAVSVLGGSRDVESIQLELSYIEATIRDHRKKTGGKDTSHLREAWIHDLTRFAFDIEDCVDRFLQQVSEDGEAGFLRRSVRSAKNTVYTRTVFSPKIRKLKTRSEEIHRRLKRYIEEETTGVTVTPDGAASIPTAGAH

SEQ ID NO: 184787 - protein, 171 aa, Triticum aestivum
  Clone ID: PAT_TA_79205.pep
REMGRSTTDRFAMAQYLLVALIVVVVASNSKHEAVAANTLFVVQLQGHGPAGHKISVPLRKHDFFLTGCTDGSGHCQAFPGHEHLFPASTTLPFARSYRQHIDGLLNLPCVRLSRDAMVHATPVLPAYAELAAMKAMLCEAQLLQSIRETVTGGWMNGIIVAPQHLHALHR

SEQ ID NO: 184788 - protein, 158 aa, Triticum aestivum
  Clone ID: PAT_TA_79206.pep
DPASAQLNKKKGPSPPLPRIVSYPGDCSQPRSLAATTYGARFRLIPATPGGAQQTHDLPLLRCLLPSVQLRGARSVALARDPKPCFGRGVAFVAGEAPADSGGSSPYPPSPPRASPLPGTRSCARWPWGAGAHRAGPPLLPIWGSSRESPWTRRTTGT

SEQ ID NO: 184789 - protein, 137 aa, Triticum aestivum
  Clone ID: PAT_TA_79207.pep
MLHRRHPLPALLRLFSTTCRRRSRLPSQPHPPNTDTLPPRPVAKKVPFTVSAHGRSWSDPYHWMRDTSDPDFAALLAAENAYADAFVGAAGGGGLRARLAAEMRARLAPSAVSPPQPWGPWSYYQYVPNGMEYPVLS

SEQ ID NO: 184790 - protein, 116 aa, Triticum aestivum
  unsure (1)..(116): unsure at all Xaa locations
  Clone ID: PAT_TA_79208.pep
MEAAKNEDAGSAGEEVIPAYKRRGRPQKLFKHDVDEEEDVPKGEDDGDXQNKRLRHAGSRRAQLXNGGKKRRRQSKRGSASATEEKGGAPARAPTGFRHNGSRRNNTPQRAAEAGV

SEQ ID NO: 184791 - protein, 97 aa, Triticum aestivum
  Clone ID: PAT_TA_79209.pep
STHASEGLIPEVVSGVAKRFSDRRFSGTARLFLEHTKRVTAMITAVILSTRFFVAVTRQCDCRATLQLQSEQSLWHQGHGQVTALACLIKADFVSCS

SEQ ID NO: 184792 - protein, 147 aa, Triticum aestivum
  Clone ID: PAT_TA_79210.pep
VDPRVRTPVSSVDAFDNFSTNMHWVVEPIPVRAAMPLLRPPTRVRLPFTRRVITVLPMPSRVIVYVRAGADGSRIARGAFVFEGNSVFDLRETLIRRLEATMGVSDVAMCVEAGAFGRPTPLVVDLPRSRQNLHILVFAGGTPAHAG

SEQ ID NO: 184793 - protein, 133 aa, Triticum aestivum
  Clone ID: PAT_TA_79211.pep
STHASARLYQVGEQDLALGFKFNAKGTIDCYEGEMELLPESRARRREIDFNMVDGDFKVFQGKWSVQEVDDATEGGEISSGQEFQTTLSYVVELEPKLWVPVRLLEGRICKEIKTNLICIREEAEKVQRLLDE

SEQ ID NO: 184794 - protein, 185 aa, Triticum aestivum
  Clone ID: PAT_TA_79212.pep
RPTRPEQFSQRAVAAQLEKDQLMLKLDSARNGKSWDDIENAGSEQDVDLMKTYISKIQQLEAEVTRQKFSTACRNGLHDRLALDKGMLLDDLGSGCEVGTLEVSSEVDEEEKEREHSSIQEKLDMELQDLDKRLQQKEAEMKQFAKSDTSVLKQHYETKLHEMEQEKKAFQKEIEDLRHALAKIS

SEQ ID NO: 184795 - protein, 117 aa, Triticum aestivum
  unsure (1)..(117): unsure at all Xaa locations
  Clone ID: PAT_TA_79213.pep
ANGDAAPAAVLAPVAPLVGPLASPSTALPSPPPAPAASAALPPSSPAPAPVLRVRWADLXTRSRSPLLPSLPAAPPSPAGPVAQPPTSGVLPPARSRCGRRRCLRARLGPPARKAGA

SEQ ID NO: 184796 - protein, 103 aa, Triticum aestivum
  Clone ID: PAT_TA_79214.pep
CESKQITKLQFGIPIRCEMHQWILGWNQGFQFQCQPKPLNFQKSDSLIPATIHGIGRQTRCSFAALNDSPCDRFSRCSFFSFFSSVKAIFWLHCYARSSLASK

SEQ ID NO: 184797 - protein, 99 aa, Triticum aestivum
  Clone ID: PAT_TA_79215.pep
VVGRSFSSCSRLPYPAFPFSPPTARSRVAPLKPRQKPRCEICASRHTTTTTGMAAPRVLLLLAAAALLTVSYGGDASGEGPRGRKLLVLVDDLDDRSSH

SEQ ID NO: 184798 - protein, 123 aa, Triticum aestivum
  Clone ID: PAT_TA_79216.pep
DNQTGSALLSWSCGEEARPQGGQQRGGAVLPVALPWPGPEMLPCRRLIVVAERRQLHHLVVVAAAPEEEELQPLLRALRLLRRPGHQLGALPVHLWVVDDWPKFCASICLSVTRLVHGVRMIR

SEQ ID NO: 184799 - protein, 81 aa, Triticum aestivum
  Clone ID: PAT_TA_79217.pep
MVRSRSPKGGDDGRRRSTPRRSSDEQGGRKEKGPISLLVRNIPHNCRYEDLRVPFAKFGPVRDIYMPKDYYSGEPKGFAFI

SEQ ID NO: 184800 - protein, 109 aa, Triticum aestivum
  Clone ID: PAT_TA_79218.pep
HSSIWTHAGGQLALKVPCPAAHPARACCCRSSDERMGRVPAARRGEPQPAPAEPSRAPWRQAAQEPSLAEVVDGGGGDVGDGGGRRRLGLGRAGWCSLDLSDAWADAWV

SEQ ID NO: 184801 - protein, 239 aa, Triticum aestivum
  Clone ID: PAT_TA_79219.pep
MNDILRAEYTEEEVKRALDNIGDLKAPGPDGMPAIFFKRFWQIVGNQVTKEVLQILRGGEMPEGWNDTLIVLIPKNANPASIKDLRPISLCNVVYKLVSKVITNRLKVIIPDIISPNQSAFVPGRLISDNILLAYELTHFLQRRRSGLMGYAAVKLDMSKAYDRVEWTFLKDMMQRLGFKRCWIELIMRCVSTVKYQIKVNHDTTEIITPQRGLRQGDPLSPYLFLICAEGLSAMLHEA

SEQ ID NO: 184802 - protein, 158 aa, Triticum aestivum
  Clone ID: PAT_TA_79220.pep
RANPSFFDGGREGDEKTSKDAAASLGAARAGAPGLPRADPAVPLLCRNRNANTCSVGRRRAASGHQWGSPPAAGAGPSVGGDLGTTAQHQRWPAGEWRGVPGGASQPHGGGRASNAVLDLAAAARPRQSLCSFSAFALVSHSGLVWESLTSLGGRVGR

SEQ ID NO: 184803 - protein, 150 aa, Triticum aestivum
  Clone ID: PAT_TA_79221.pep
FFFFTGMAENFPMPINSLQQIADSRFSQQKKEKKRLGKLSFGIVSSRRASQGRQITQEDGWMDTISQWRRQHLIQQTDCWYALHQASQGRQITQEDGWMDSSCATRRKYTMGEVSTARERKQNESRMAVQHKMRVAIVHPTDSTRATHDS

SEQ ID NO: 184804 - protein, 176 aa, Triticum aestivum
  Clone ID: PAT_TA_79222.pep
MASHGSHPTLLEHMGRTGAPADLAVLVAHIQAACKRIAALVASPGNADLSRAKPAAAGAASAAGRDAPKPLDELSNEIILSSLQSSGKVAVVASEENDLPVWLCDDGPYVVVTDPLDGSRNIEVSIPTGTIFGIYDRLVELDQLPVEEKAQLNSLQSGSRLVAAGYVLYSSATIFC

SEQ ID NO: 184805 - protein, 204 aa, Triticum aestivum
  Clone ID: PAT_TA_79223.pep
HASELKQLTVLNLSHNHLAGMIPPELGEIHRMNSLDLSENELSGEVPVQLQNLVLSAFNLSYNKLSGPLPLFFSATATYQQSFLGNPGLCHGICAGNDDPGAIPAARVHLIVSLLAASAIVLLMGLAWFTYKYRSYKKRAAEISAEKSSWDLTSFHKVEFSEMDIVNSLDENNVIGKGAAGRVYKVVVGPSSEAIAVKKLWASD

SEQ ID NO: 184806 - protein, 159 aa, Triticum aestivum
  Clone ID: PAT_TA_79224.pep
HASALTATHNGGGVTNLPRRVLPVRILFSLPVVRILLLSPAEAAVFTPPPHLWMPSRGTPRPRAASTATRSLPLRSSSSRARDARRLRAARARQAPAPAARGRTCRLGRRRPVVVLAPRGGAPWRRRAGVVLQFPDRARFPEFSHKGLIPAVVGGSSAW

SEQ ID NO: 184807 - protein, 100 aa, Triticum aestivum
  Clone ID: PAT_TA_79225.pep
CLQRRSKPWWESYRQGSVPNVGCRVQTRTTRVSQSDRETAESTIASWYVPADQLVWRGVAGPAGFLHSWGGGGGYPGGAQACWGGCGLMPRVRMYSRNCP

SEQ ID NO: 184808 - protein, 81 aa, Triticum aestivum
  Clone ID: PAT_TA_79226.pep
YSVSSIDEISGESRKTVKGVLKLNNEKLSIILIKEKRALSPNFFYPNKLIFARMLLKIYVLLLSSYGFLKISNFERKFISI

SEQ ID NO: 184809 - protein, 50 aa, Triticum aestivum
  Clone ID: PAT_TA_79227.pep
HMKINGGRSDFQNLFSTSAYVDVASEFLCLLDCLSEASYRGVPVIFLLPS

SEQ ID NO: 184810 - protein, 83 aa, Triticum aestivum
  Clone ID: PAT_TA_79228.pep
FFFFSVQHLDQLYLFMFVSDYQLVVVSPAAIHSLRSSWFLQSMNKSFTVKWCMCHDHQVCAPPVLPRHSFPGRVGRPKNSGPV

SEQ ID NO: 184811 - protein, 133 aa, Triticum aestivum
  Clone ID: PAT_TA_79229.pep
DPRVRFDDRSAGYKRRLDRFFNLFYLAVTVGAIAAFTLVVYIQMHRGWAAAFGALALAMGASNALFFAGTPLYRHKAPGGSPLTRVAQVLVAAFRKRGADFGDGGYVGLYEVAGAKSAIRGSGKIEHTDDFRW

SEQ ID NO: 184812 - protein, 70 aa, Triticum aestivum
  Clone ID: PAT_TA_79230.pep
RPRVRMLTFISSEDLSFLKNQIIFLEELEMGMSNKHEEDKLTASTNYNGPPSMALPLLPLPYSYRARCFQ

SEQ ID NO: 184813 - protein, 141 aa, Triticum aestivum
  Clone ID: PAT_TA_79231.pep
MGDRRCRSAVSSRGGPTAGRREEEEEWRRYLAPERLEVLAQLEPWAEANMLPLLKPVDEAWQPADMLPDAAALGADGFQAACIELRARAEGVPDPHLVCLVGNMVTEEALPTYQSMSNRFEGTRDATGADGTAWARWIRGW

SEQ ID NO: 184814 - protein, 133 aa, Triticum aestivum
  Clone ID: PAT_TA_79232.pep
RPRVREAAPTVVGGYELRERLGGRPPATSVWRAVRLSTGAPAAVKQVRLAGLPARLRDSLDCELRFLAAVSHPNIIRLLDVVRTPGCIYLVMELCEGGDLATYVKRAGGRVEESVARNFMRQIGAGLQVLRRH

SEQ ID NO: 184815 - protein, 144 aa, Triticum aestivum
  Clone ID: PAT_TA_79233.pep
PASGSQPLTSLKRNKGSEFSRMIKEAKHLGLALGIPCLDGVEEAEAQCALLDLSSLCDGCFTSDSDAFLFGARTVYRDVFIGDGGYVICYEMEDIEKKLGFGRKSLISFALLLGCDYSNGVHGFGPVSTRWIVSIFGLLTLNTQ

SEQ ID NO: 184816 - protein, 162 aa, Triticum aestivum
  Clone ID: PAT_TA_79234.pep
THASASNTGACLKATIQGYVDILCPVFLKDIARAIVSAGKSFQLVQHAQSTHHTRTSVTNGALTNSTGQFGHDAREMGVLTLSEIFLICLSGLLENGDHVYEYLRKLRAGSAPDIQAFLECKSEEACAENSSEKTWLKLLRDAISGRKYDDMEKTLSKDAVT

SEQ ID NO: 184817 - protein, 105 aa, Triticum aestivum
  Clone ID: PAT_TA_79235.pep
MALALSTLPFAPSTPAPASFRPRGAHFAPSPAGRSVGVGLPLACAAPRKNRGRRRRGGGLVVFAAADYYATLGVQRSATIKDIKAAYRKLARQYHPDVNKEPGAT

SEQ ID NO: 184818 - protein, 145 aa, Triticum aestivum
  Clone ID: PAT_TA_79236.pep
QVAEPWQGPGLYAHSLTSRCSAETPSNSSVGDPKKMIHISTLTSSPSSVGFQFDADGVVGWEQREHELRLDLRGAGMDGSADHLVALGEEELDEPRGDEASCAGHAHALPSRRRLHALSYSPLPPPSPPARTSSATHLLQPPPCE

SEQ ID NO: 184819 - protein, 151 aa, Triticum aestivum
  Clone ID: PAT_TA_79237.pep
MVAADDSDPKIGTLVVRVWGADDDGVEKWMLEDTFSLSKFVDVTKSSTEYDTTVQIEAFVDGFLYLCIKYGEHTESLVSLCLETGKLNKIFDDTYTSPAHPYIMSWPPSLVCNKEDSQTKITGGSVEDAGSVGTKETPSVLVTAPQSHKID

SEQ ID NO: 184820 - protein, 75 aa, Triticum aestivum
  Clone ID: PAT_TA_79238.pep
STPRPEEPAASMAKEPPLAQGEAASDEKQDKGALFYEPPRFPSMDVPFVSCDLVTSGDLQEYSPLGIRQLMRSTM

SEQ ID NO: 184821 - protein, 149 aa, Triticum aestivum
  Clone ID: PAT_TA_79239.pep
MSDESPATAAEKTQQDEQDGGGWGGWGLSVFSEISRSAVEVAKSAIADIQQPPEQEAGPGEGEDKGSNEPEGEEEDERRKAALDKPATLPPSSTRTMPGSPPSSWRLCLRSAPASSSTGAMPLRRMAYFASLCSYRIEVWGSKSTPLPL

SEQ ID NO: 184822 - protein, 170 aa, Triticum aestivum
  unsure (1)..(170): unsure at all Xaa locations
  Clone ID: PAT_TA_79240.pep
RDQLIYPLTADQETEPLSYGGXDLEYLLERYPLDKEVNWGDELSLGEQQRLGMARLFYHKPKFAILDECTSAVTTDMEERFCNRVRAMGTSCITISHRPALVAFHDVVLSLDGEGGWKVQDNRNGSFLPTELEFDALKSSETDRKSDALAVQRAFSANTKENTLSGPKEH

SEQ ID NO: 184823 - protein, 171 aa, Triticum aestivum
  Clone ID: PAT_TA_79241.pep
MAPPPPPPAAALPDELVEEILLRLPPDDPACLLRSSLISKAWGGAVSGPGFRRRLHELHGAPPMLGLLHNQASEPTRFFAPTTASPFSLAAPDPSSWLAIGCRHGRALFLPRSQEARKLLVWDPITGAQHLVPVPAASECRYLTAAVLCAADGCDHRGCLGGPFHVLFVFP

SEQ ID NO: 184824 - protein, 119 aa, Triticum aestivum
  Clone ID: PAT_TA_79242.pep
RPTRPRLHRASSACAAIPTGADPPRHGDLLPATACQRGDPRWRGRGRRRGAAAGGDATPVARWDCRRHHQDKDWIRANAGRAQGAAGERRPLLRPISPRPRRSAAGGHLHGRSGGGRPG

SEQ ID NO: 184825 - protein, 202 aa, Triticum aestivum
  Clone ID: PAT_TA_79243.pep
STHASDLLCHAAGNTGPSPKSMSSYSPWIFTVGASAHDREYNNYVVLGNNLTISGVGLAPGTDGDSMYNLIAAPHALQNYTTTPIEMSLGECQDPSHLDKDLIRGKILVCSYSIRFVLGLSSVKQALDTAKNVSAAGIIFYLDPFVLGFQLNPTPMDIPGLIIPSSDDSKIFLSYYNDSLVRDGPSDRVVKFGAVAKILGGL

SEQ ID NO: 184826 - protein, 106 aa, Triticum aestivum
  Clone ID: PAT_TA_79244.pep
QDGGTRREQEDQPATSGQSSMCGRQGACPGLDLDGPSPFLLELLVVAVRVRRARTSSDEQMPSLADGAASTRASQLLHHAAGLLPLPIASPNPPSGSPNLRPISIR

SEQ ID NO: 184827 - protein, 110 aa, Triticum aestivum
  Clone ID: PAT_TA_79245.pep
AMYWCCVECRVARRDVVFSSHCVVGRRYEPSLGAKDEVVSVRTVVCVRSAVRELLWVGCGVLPRLAYVPSKIRPFVRLGVCTPKISVSLFFHLCPSECERERQQQIQDNL

SEQ ID NO: 184828 - protein, 109 aa, Triticum aestivum
  Clone ID: PAT_TA_79246.pep
AGPPPWAPTKSTVFRSYAAAVVGDRAEAPSARGNGVAARSSNLRAVRKRPIVARLTRDIVQTFEKCNPEFNYVDSLNPKHFLTTPAVPVHNDGLDNANSDLILYVNLEL

SEQ ID NO: 184829 - protein, 174 aa, Triticum aestivum
  Clone ID: PAT_TA_79247.pep
MQAVQTRNLRETQLGGVIFGCKHETIEECFNKQLFGLPALHYSYVRNVKAGLPLFLFNYTDRKLHGVFEAASPGQNSIDPYAWSNDGTLRTPFPAQVRICTRTRYQPLFEVQYKKVIQDNYYTHHYFYFELDHAQTRALIALFKSVGPLNFKQVPAVSSKRSLPVPLPSTNRMS

SEQ ID NO: 184830 - protein, 115 aa, Triticum aestivum
  Clone ID: PAT_TA_79248.pep
DPRVRAEGSSSSSWPALRHWRRTTDFCGGGGTVAPSASVVCYGDTVTQLHVEGAAQGAPPLPLNFSLGALVTTLSRLPDLRVLTLSGLGLWGPLPGKLERLAGLEIVNMNRNYLY

SEQ ID NO: 184831 - protein, 143 aa, Triticum aestivum
  Clone ID: PAT_TA_79249.pep
VLPRRGQLLHDPLNLERGVLPLLVELVGEVAQHGARDDGERVGGHRRRNRSGSRSPPLERLDRRRSPHRPAAPRSHTVPDDRGVTLTPVGGGRGDAETWSPKTQPELTSSRAAAETRAWEWIWGRRRWWCDLEGEGEGRTRGS

SEQ ID NO: 184832 - protein, 114 aa, Triticum aestivum
  unsure (1)..(114): unsure at all Xaa locations
  Clone ID: PAT_TA_79250.pep
SFRRPQAEETKPNPSPAPXATVAMDISKPPPAASGDESAKGARGGGEGLRQYYLQHIHDLQLQIRQKTHNLNRLEAQRNDLNSRVRMLREELQLLQEPGSYVGEVVKVMGKSKV

SEQ ID NO: 184833 - protein, 192 aa, Triticum aestivum
  Clone ID: PAT_TA_79251.pep
VRQDWYAEFVKHLLLRRDRKSLNTLRLHWNHDDANTWIVHALRHNATAIQLSAKHHRPILKLECTVFLSGNLNILQLANVSLDSRSLSGLCSRCTSLEELELRKALIYATEIRSTSLKRLTMVNCKIFNDLTVDASNLAALRCIRPCSFVPQIKNSGSLVAATIMLDDACLQHARPWSVQDDEDDGDTYTDA

SEQ ID NO: 184834 - protein, 96 aa, Triticum aestivum
  Clone ID: PAT_TA_79252.pep
LAYTPIKGSRQSGGERSGALPATTRESRRTGIFTPPYFVTPSCFICVSRSHQIQTYVLARNDILSSSLLCFIPSNLANYCRRMASSELNQGKILGL

SEQ ID NO: 184835 - protein, 106 aa, Triticum aestivum
  Clone ID: PAT_TA_79253.pep
SSQEQDKIYLGRGANSQETGMGSSGSTIFAPQEYLLFIIIALLLYSVGLEILTILLLGAFEAPGLLLGVEFPACLPFFTGVEFPACPPFFTGILSEHASSPRTRGS

SEQ ID NO: 184836 - protein, 121 aa, Triticum aestivum
  Clone ID: PAT_TA_79254.pep
GSGDATAQGSRSQDPMTPPDLSPPPPFSGPTGRSKSPTVRSYVMETEDLFVPVWVKNYSEKRRKNWVPSSSDLKLLSLNRLKQQQACEDNRKVAVKDVSWRKKWVVAWMDVVSRKMCVSYT

SEQ ID NO: 184837 - protein, 206 aa, Triticum aestivum
  Clone ID: PAT_TA_79255.pep
DPRVRDPNLLRSYIANHEESSREGISLLGLLIEGIATDFGGEMLCQFLEILKVLLDGCTADTVTQCRDFIELFYEKCFDKLINIIESSRVEEYSAKLEILYNICELLCFCARHHPYKIKITFFGSNSMEKILTLTRRRERSLVVAAVRIMRTIIGACRNDELLISHVIEFNTLKPIIEVFVENGNRYNMLHSMVLELLDFIRKENL

SEQ ID NO: 184838 - protein, 185 aa, Triticum aestivum
  Clone ID: PAT_TA_79256.pep
MSAAGKAKASGGKRGGAKDPDEAPRSDKRRRDMDDSDPELELDSDFKQIVTMLRHIKDKAHKDGQKKTEQAISSVATEIQSMVQDTKTKFEKERQNVLKALTKASKECEGSLKTEYTKFQATHDKFSKDKAAHVQNFKDLFSKFEVEKEKLIVQYELQRKKEKTTLADLEKTVSEKITDAEESLK

SEQ ID NO: 184839 - protein, 192 aa, Triticum aestivum
  Clone ID: PAT_TA_79257.pep
PVRIPGSTHASGYLNGVDTHGILLFRTLVGKIFGSIGSVGGGLALGKEGPLVHTGACIASLLGQGGSAKYHLNSRWVQIFESDRDRRDLVTCGCAAGVAAAFRAPVGGVLFALEEVTSWWRSHLMWRVFFTSAVVAVVVRSAMNWCDSGKCGHFGAGGFIIWDISGGQEDYSYQELLPVAIIGVIGGLLGAL

SEQ ID NO: 184840 - protein, 114 aa, Triticum aestivum
  Clone ID: PAT_TA_79258.pep
MAAAVSRDDELVVKSPSDNRSYRLLRLANGLCALLIHDPEIYADGGPAPKPNEDVDMDDGDDEEDGDEDDDEDDEEYSDEEGEDDDDEEGEEDEDGSEPKRKKDKGSSEPGRVG

SEQ ID NO: 184841 - protein, 163 aa, Triticum aestivum
  Clone ID: PAT_TA_79259.pep
KPEKPQFHGDSPFTSALTDLTAQEESSVDKGNSKAAAAAVRKESKLEKPQVPDSPFDFSDLGDEEEASAKWNSKPTAVVKREVKVEKPDPDLSFASAFTDRRVLDDANDKGKKTGASAYGGAKSGKRAASKPSSFADFDEDDDGVSEEKENRAADDTEKDVGW

SEQ ID NO: 184842 - protein, 220 aa, Triticum aestivum
  Clone ID: PAT_TA_79260.pep
THASAGNATPHMRRGPDGPRTLCNACGIAYRKGKMRRMIEAEPPIDEASLAKLVPEVDMEFESEEKAYEFYNKYAGHVGFSVRKSTSHKSSENITKVRTFVCSREGYNRDKKSLEAKKPRLDTRIGCPARLIIKVTPECKYRVTDFKAEHNHQLAPPSTMHMLRSQRILTELQSGEAELSDDSVVTPTTKATGDLVVRQVGFLRSISLLPADYKNYLRSK

SEQ ID NO: 184843 - protein, 134 aa, Triticum aestivum
  Clone ID: PAT_TA_79261.pep
LSSSLAPVSGLRPCRTVAAYTASRRCRRLPLRLTPPSTCPRPSRGCRSSQTTGGSSPSTTCPPPPRPRPRTGAPGAPSPAPSPRPPPPPRQRRAPPWLPRHPPRGTTRGCAAPGRATTCSSPSPSASPPRPSSP

SEQ ID NO: 184844 - protein, 159 aa, Triticum aestivum
  Clone ID: PAT_TA_79262.pep
WISLLLSSASLLCVRQLLNMFGEASGLRINCTKSWAIVTRGDHRDHDEERIAPILQRSIGAFPCKYLGLQLSILSLTKAEWQPTLDSIRACAPAWQRGLINRAGRLVLVDSVPSARPAHHLLISEAPKWTILQLEKWLRAFFWAGTEIVQGDKCLVSFG

SEQ ID NO: 184845 - protein, 95 aa, Triticum aestivum
  Clone ID: PAT_TA_79263.pep
FDCHELYILGVSMNYSFLELPRKSSPLASHHLQKSAYTNNYTMLNVDIYKNLQTKKLWELVKKWQHLQRNRHDLLRRTSINCHEKKVLLKASGTW

SEQ ID NO: 184846 - protein, 175 aa, Triticum aestivum
  Clone ID: PAT_TA_79264.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKPGVTVYPSP

SEQ ID NO: 184847 - protein, 193 aa, Triticum aestivum
  Clone ID: PAT_TA_79265.pep
DPRVRTGPRLLIQRIQDAAEPPKCFNASLYSPPKQREVERHHEIMSYRNQFLWSCLFSVPVFLFAMVLPMLPPSGDWLFYKIYNNMTVGMLLRWLLCSPVQFIIGWRFYVGAYHALKRGYSNMDVLVALGTNAAYFYSVYIIVKALTSDTFEGQDLFETSSMLVSFILLGKYLEVVAKGKTSDALSKLTELAP

SEQ ID NO: 184848 - protein, 89 aa, Triticum aestivum
  unsure (1)..(89): unsure at all Xaa locations
  Clone ID: PAT_TA_79266.pep
LGSTVVVSSSDSSSAGANGRCVGASSSSSSXSPSSSSPYPSSSSSSSSSVVSPPSSWSSSGSGASSCPASTAPLAPSSSSEEPGDAGAW

SEQ ID NO: 184849 - protein, 109 aa, Triticum aestivum
  Clone ID: PAT_TA_79267.pep
RPTRPNAVRYAIMMNTVGEVCSDISHDSRFCQELMDAVNAVHSKYLLGKQQTAEGDKTYEQTVNEACVSEPLNDPAVINNKSVRKGNRLKSRSEREGWKKAADKRKKCI

SEQ ID NO: 184850 - protein, 170 aa, Triticum aestivum
  Clone ID: PAT_TA_79268.pep
RPRVRYHWDLPQALEDKYNGWLDRQIVDDFAEYAETCFAAFGDRVKHWITVNEPHTVAIQGYDAGLQAPGRCSVLLHLYCKSGNSGTEPYIVAHNFILAHAAVSQLYRTKYKAAQNGELGMAFDVMWYEPMSGAAIDVEATKRAQEFQLGWFADPFFFGDYPATMKKRVG

SEQ ID NO: 184851 - protein, 218 aa, Triticum aestivum
  Clone ID: PAT_TA_79269.pep
MGVPGSYGEMWSWSHVVPMVNSALSWLHLNDIPYLCSLINGQSENTTHTPEQSCLVLLISSVLGMLNSTLERISPEGTPDSRSYCLPWIPDFVPKIGLGIITNGFFSFSCTEVVGHEEQLPSRGVSLVQGLCHLRCWGDVDASLSSISCLQRLVQLSCSVDRVIQRATTNSSEHLKESKAGLAGKILQEGISSLWHNDLLNFLTSLLPLISSQWPVLK

SEQ ID NO: 184852 - protein, 164 aa, Triticum aestivum
  Clone ID: PAT_TA_79270.pep
TLEPGGGICTMPPAQACHSCGSRQRGPSPLSRSPAAESTNVIIPSSTHRTSRHSSANRIIPPELGSPPTFNPHHQKLFRRRQHHHQSRASSLRKALKAAQAQQQIPPKRARTDRGGRGRSGPSVCMRLCYGCLPPPSPPLPCLLSSLPQVQQGQQQGRFGRVGR

SEQ ID NO: 184853 - protein, 79 aa, Triticum aestivum
  Clone ID: PAT_TA_79271.pep
SMFLIQTIFSFLVETSNYHIHFLLKSSNHIIIHRRTCSCCYVYGLHVFIVLIAFIVYFILSLLGILHASDQRRHPGLAL

SEQ ID NO: 184854 - protein, 68 aa, Triticum aestivum
  Clone ID: PAT_TA_79272.pep
ANNTESGTNENFVLSYAVRNFQTGLGSCKSESSRHFIFAGCRIIFSKVWCSFLVRAYELLPQIPSRLS

SEQ ID NO: 184855 - protein, 226 aa, Triticum aestivum
  Clone ID: PAT_TA_79273.pep
MTTNTKRAYKLQEFVAHASNVNCLKIGRKTSRVLVTGGEDHKVNLWAIGKPNSISSLPGHTSAVESVAFDSTEVFVAAGAASGTVKLWDLEEAKIVRTLTGHRSNCMSVDFHPFGEFFASGSLDTNLKIWDIRRKGCIHTYKGHTRGVNAIRFTPDGRWVVSGGEDSAVKIWDLTAGKLLHEFKSHEGQIQCIDFHPHEFLLATGSADKTVKFWDLETFELIGSTG

SEQ ID NO: 184856 - protein, 159 aa, Triticum aestivum
  Clone ID: PAT_TA_79274.pep
SLPPGAPSCIRGSDGVDAEDSTPASDAARLASRAGRCAGDEASHHPPPIWRALVLPWLLRTPHGLLASVLAFLAKPGSQELKNPSCFRAREDGFSAVDGEGISAEASCLRAPMRVQRAKEVAGEAEPQASAAKQGSEWRGAGEGRREGRDLLFYSDAGS

SEQ ID NO: 184857 - protein, 109 aa, Triticum aestivum
  Clone ID: PAT_TA_79275.pep
DEDKVAGGKTAWRTCSAQWGQEPQLVGGGGGGGEQGGARRGRGVAGGVSEKQSVLPSSNCGMQSMSGRWRCQAAWWAGQQQSPICFSRWAYGPGSRAGLGRPADGTGPT

SEQ ID NO: 184858 - protein, 180 aa, Triticum aestivum
  Clone ID: PAT_TA_79276.pep
PRVRDDSLILTGPKRGFMVCDNIFFEIDLKVKDVHGRTVDDDRLSKGLIEVDAIRRLEYSPRYVVDTETLVSMHSILDLNYTFVRSSVEGTVEIKILEGPDEFHGKIVASTTSIPCDIMLHDSKVSGALTAGDNGVLQMARRVVGVSVDEMLVLTVAAAVGDDELSVRTIEFTPRRNGYD

SEQ ID NO: 184859 - protein, 201 aa, Triticum aestivum
  Clone ID: PAT_TA_79277.pep
TRPKEYLHSAELRDIMQFGSSNTAVFFKMRVAGVLHIFQFETKQGEEICVALQTHINDVMLRRYSKARSGSATSTVSQNDVSQADKLPNAEMHDKRVQELSKVVDESQKKADELRDELQRKTQQEREMQEELEGLRDTLQSERHIIKEVTSERDRLKSLCDEKESSLQVALVEKNRLETKLTNGQAQENNTKVNLSGSHCE

SEQ ID NO: 184860 - protein, 143 aa, Triticum aestivum
  Clone ID: PAT_TA_79278.pep
DPASGLFCCGGAAALLTNDPAYRSRAKMELRCLVRAHIGAHDDAHAAAVHCEDADGRLGVSLSKALPKAAVRAFSENLQRLAPRILPAAELARFTVRLLARKLMRRKLKFEGPKINFKTGVDHFCLHPGGTAVIEAVRKNLGL

SEQ ID NO: 184861 - protein, 129 aa, Triticum aestivum
  Clone ID: PAT_TA_79279.pep
DPRVREERREGKDEDEGGEQAGILSAMASKIGMAMSGNGTHGGSGEDVDHSNGEGEGKEKEMGGDEPSSNGGGLVKQIMSNLPTSGALPICHFQFRHILVLLPRLFQLTGFALSPSVLLPRCRHSGARC

SEQ ID NO: 184862 - protein, 91 aa, Triticum aestivum
  Clone ID: PAT_TA_79280.pep
MAYVDHAFSITDEDDLVGGAVGGPRGAPVKEIAFAAALLAFGALGVVAGLFMAANQVGGDTAHGEIESPFAPLRLHFLLSLYAYKKNWYCL

SEQ ID NO: 184863 - protein, 65 aa, Triticum aestivum
  Clone ID: PAT_TA_79281.pep
NSLLCGPPFILAVYSYTNSGSATVSNNIIISSSLTLFLHNRKCKYKVKEDDIIILLETVADPEFV

SEQ ID NO: 184864 - protein, 82 aa, Triticum aestivum
  Clone ID: PAT_TA_79282.pep
DPASDKLRGTLSSVDVATKDNLEKLVNVGEMLLKKPVSRANLETGQMVPACSDTEETNEEALKRFAKLLSDEKQIRQARSPK

SEQ ID NO: 184865 - protein, 115 aa, Triticum aestivum
  Clone ID: PAT_TA_79283.pep
PTRPVQCWLQSVAVLTPHPQLGYLHCPFSQRRPAAGGFTPNRTRPSSIPSTIVGDPSRRLDSVDRRRRLRHTFVSASPPTTAPPPPRAVGTKVHSSLLLTFHHPAALHLIILFSL

SEQ ID NO: 184866 - protein, 146 aa, Triticum aestivum
  Clone ID: PAT_TA_79284.pep
DPRVRSAQRWSELPYTRVASVAMRRYKFLFKKHDEERFGKYLEDVEAGKAKISAGALLPHEIAASAYRGQEDDVSELQWRRMVDDLRSKGSLRNCISVCDVSGSMHGTPMEVCIALGVLTSELSEEPWAGKVITFSERPLILFSGA

SEQ ID NO: 184867 - protein, 157 aa, Triticum aestivum
  Clone ID: PAT_TA_79285.pep
PRCDYHVTTTGQAATALRMLRENKDQFDLVISDVHMPDMDGFKLLELVGLEMDLPVIMLSANGETQTVMKGITHGACDYLLKPVRLEQLKTIWQHVIRRNTKNRGSDNDDAGQKGPNAEGENGGANRNKRQSRRDRDDNGDDGDDSDENSNDNGDSS

SEQ ID NO: 184868 - protein, 177 aa, Triticum aestivum
  Clone ID: PAT_TA_79286.pep
DPRVRGALSLGVYAHALLLRQLGGHGDVSRDVLINNSLVDLYGKCGAVELARQVFDRMPERDITSWNVAILTLANHGCVRESVELFDRMTRAENVVPNAITFVAVLSACNHGGMVEEGRRYFEMMVSEYRIRPRIEHYGCMVDILARAGFIEEALDVVSGMNCRPDAIIWRSLLDAC

SEQ ID NO: 184869 - protein, 145 aa, Triticum aestivum
  Clone ID: PAT_TA_79287.pep
STHASGPDWVPTAYWKGNPDVASPLRLALLACNDTNLWRAEIMRQNWEEEAKSGYQNSKLSSQCTHRYKIYAEGFAWSVSLKYILSCGSMALLIDPLYQDFFSRGLEPRVNHWPVSTVGMCESIRDAVEWGNAHPEDAERVGKRG

SEQ ID NO: 184870 - protein, 72 aa, Triticum aestivum
  Clone ID: PAT_TA_79288.pep
VITNSMCLTRENKITATSLHSSLVMSITNYSGKQIESHAIQILQQNNKKVLTYSIEEQTFLTIEILPRTRGS

SEQ ID NO: 184871 - protein, 186 aa, Triticum aestivum
  Clone ID: PAT_TA_79289.pep
THASGRGLPPGSGKKKQLDALGSAGTSFTPHIITVKPNEDVASKIMSFSQQGPRTTCIISANGALCTATLRQPATSGGIVTYEGHFDILSLSGSFLLAEDGDTRSRTGGLSVALAGSDGRIVGGCVAGMLMAATPVQVVVGSFIAEGNKKPKEEQPKREPTSVPMLTSAPMQTAAGFGAASAAATP

SEQ ID NO: 184872 - protein, 187 aa, Triticum aestivum
  Clone ID: PAT_TA_79290.pep
RPRVRSGNIPAEIGNLINLALLDMSQNMLSGQIPLAVWNLSNLIVLKLSMNRLSGKIPSTVGNLAQLSQLYLDENELSGNIPANIGQCKRLLVLNMSVNHLDGSIPGELFSISSLSLGLDLSNNNLTGPIPSEVSNLINLGLLNVSNNKLSGSLPSELGLCVQLLSLQIESNMLNGSIPESFSALKV

SEQ ID NO: 184873 - protein, 79 aa, Triticum aestivum
  Clone ID: PAT_TA_79291.pep
YVALTYIIFFLQAPYSFSCNIYLDLSVVKCHHVSKTPLYYRTEGVFILCTHNVTDLFSVAVCHLSEFWIACIVPNKFMS

SEQ ID NO: 184874 - protein, 120 aa, Triticum aestivum
  Clone ID: PAT_TA_79292.pep
RPTRPVPPHRPPAAPLLRYDLLGAPPSPATPRLLAVAVTSDAGHSSAASRCRPLLRKEHPTLPPRPCDADHSFVASRRPPLPPSFVQAQDFPSLTRSDGERAKPCHSDGHFGQIRLGEPP

SEQ ID NO: 184875 - protein, 75 aa, Triticum aestivum
  unsure (1)..(75): unsure at all Xaa locations
  Clone ID: PAT_TA_79293.pep
VDPASGKPFQLPKGSRGRAKNCISIASEHVEKALQYSYRDQRNKKXDRPYLWIDSIGYPLTSEISQGNEFLSFSC

SEQ ID NO: 184876 - protein, 88 aa, Triticum aestivum
  Clone ID: PAT_TA_79294.pep
STPRPHRSARLQQDYYAAICSSFEAAGSPIRSASKKTQFFFYYPSARSPLPRSLPRHTSRHAHPELPLNQPATHSCNSSLHFFREELS

SEQ ID NO: 184877 - protein, 62 aa, Triticum aestivum
  Clone ID: PAT_TA_79295.pep
RVKNMRTKKNYWINLQHPSFTSFMSLLFTPGSIFNLKISGELPFRVHLLALLIFLGYSILLC

SEQ ID NO: 184878 - protein, 115 aa, Triticum aestivum
  Clone ID: PAT_TA_79296.pep
LRWATKGLSRPEAIFSFLPFTTTTKSHLVRVGVSWNAAESRRISGLIAVAVAVGGDDSSDLAAAKDLDQKCPRRSGNLPGLGRSNPGAEANAAGRDLGQARTKFKNGTLGQIPPS

SEQ ID NO: 184879 - protein, 82 aa, Triticum aestivum
  Clone ID: PAT_TA_79297.pep
PRVREREVYKLSIGAACGLSWPSDRVIVQVLDDSTDPTIKDLVELECKICGLRARYGMVLMRKSGSGWKSASNTARKSHCWT

SEQ ID NO: 184880 - protein, 176 aa, Triticum aestivum
  Clone ID: PAT_TA_79298.pep
RNETNLFHHEIPFHFIWFLVQTHPWLSLSAPTHIYNLIRVAQRANSRVSHVRLATRQRVRFVENKQKITEKRIGQRPSVTIPRFLSLSLVYPPPPRRPRPPQPLTFPPPTFSLPHPSPLAPDRAAGSGTPMALFTVQDAMDKVLWPWCCIHGQGGHLSLSLCAESSCSCCNLNAPA

SEQ ID NO: 184881 - protein, 59 aa, Triticum aestivum
  Clone ID: PAT_TA_79299.pep
TGPEFSGRPTRPHPRLHHKVLNTPSRTHWICNVCVHARVRLVRSYESSVVSCSKKKKKK

SEQ ID NO: 184882 - protein, 55 aa, Triticum aestivum
  unsure (1)..(55): unsure at all Xaa locations
  Clone ID: PAT_TA_79300.pep
FFFFFFFFFFFFXAPSCFALVIVLNFNSRVTFRHLPRCCLPNNLPCRDPFFGIPP

SEQ ID NO: 184883 - protein, 34 aa, Triticum aestivum
  Clone ID: PAT_TA_79301.pep
TPRPVRTFCGHKIRFVASCTFPADRLVLLAVYGY

SEQ ID NO: 184884 - protein, 60 aa, Triticum aestivum
  Clone ID: PAT_TA_79302.pep
TRSSSCRWVKVGTVLGLGNLLVAAAGLVIFWTPLCFNACTVSRHLVSWFLVVSVFQKKKK

SEQ ID NO: 184885 - protein, 131 aa, Triticum aestivum
  unsure (1)..(131): unsure at all Xaa locations
  Clone ID: PAT_TA_79303.pep
VRPRVCPPPPPSPXASPAPPTQPPPAPGAPSPPPPPPPPLLQPHXPPAAAGPAPARRRALDRQGARDCRLTPATLPPGIPPPRXPPRSPPPPRSATRLAPPRRSTSSLRCIPPTPSSPSPRPLIPTVTSSR

SEQ ID NO: 184886 - protein, 219 aa, Triticum aestivum
  Clone ID: PAT_TA_79304.pep
STHASDSLILSYNQLSGAIPAEICVGFENEVHPDSEFVQHNGLLDLSYNRLTGQIPAAIKKCSMLMVLNLQGNLLNGTIPSELGELTNLTSINLSSNGLVGPMLPWSAPLVQLQGLILSNNHLNGTIPVEIGQVLPKISMLDLSGNVLTGSLPQSLLCNKYLNRLDVSNNNLSGKILFFCPMDGESSSSLLFFNSSSNHFSGTLDESISNFTQLSSLDI

SEQ ID NO: 184887 - protein, 157 aa, Triticum aestivum
  Clone ID: PAT_TA_79305.pep
VEVVESVLRGARVKREDEPASITGAAEARVADVAREAEGVAHAVDGAEEGRLLGVGEDEPREHGRQRRQKGELRGAPLTPPAQGTAPVWADKGHAETVEAEGEVGGDAEEDVVGGVLPYVGRRLHLHGRRSAHGREGGRLRLARPMRYISLSLSPLV

SEQ ID NO: 184888 - protein, 168 aa, Triticum aestivum
  Clone ID: PAT_TA_79306.pep
KVSGGKDAVRLYLVNSQVAWVQSLHFKLSGISDSVKAVLPRWYNLYKFLVQNAKKLHSEDLTAFSPIDHASLLMSSNVLDGWLHSVTVRLVKFVRQEMDDPLYTVVPYLVKYIDNLAEIYVHFNYFRLVGCTDREDHIISLSIIYHALVTICLVLAPFTPFFTEVLYR

SEQ ID NO: 184889 - protein, 49 aa, Triticum aestivum
  Clone ID: PAT_TA_79307.pep
FFFFFFFFFFFFFFLCKKKLDTIVSAKYDSMYHKYVSTWIKLSHPLKHN

SEQ ID NO: 184890 - protein, 184 aa, Triticum aestivum
  Clone ID: PAT_TA_79308.pep
MARIVSRALPFASRSHLHLSPPLRGAALLSSTPLLPHLPAAASTASLLSSRGFTPTPEPSRFAQPFAGFLSGIRGFRRARRGQAAAKREPPQDPAPPPPPPPKESEIELCARISVEDDLPDDVEVLNVIEIMKLNVPMAMKIALDGLLEYNYKTRDTSISDVRKYEKGEVSVLLCNDNFIQNLN

SEQ ID NO: 184891 - protein, 176 aa, Triticum aestivum
  Clone ID: PAT_TA_79309.pep
RPEFSITSAIEDLSSMSACPRGHRPLRATGAAISTAVALLEGCCSPNTGGRIMVFTSGPTTVGPGLVVETDLGKAIRSHRDIFNGNVPLVEKAQDFYKKVAKRLTDSALVLDLVACSLDQIGAAELRYPVEVSGGLMVLTESFESEQFKSCLRQTFKREGTDYLNMNFNATIEVVT

SEQ ID NO: 184892 - protein, 50 aa, Triticum aestivum
  Clone ID: PAT_TA_79310.pep
FIYSFIIYIGLASLSDLTSSFWNQKLPFYLQCISKKSNIVVCATVGISAG

SEQ ID NO: 184893 - protein, 177 aa, Triticum aestivum
  Clone ID: PAT_TA_79311.pep
IYRFLSTGTIEEKVYQRQMAKEGLQRVIQQEQADDKMQDQGNSLSTEDLRDLFTLHDQVRSEIHENLKCGRCKKDHCMPLDGNGLDLDAAKPDTVSTSKEKLYTDIGGFREISGCVQKMNCSNQQIEQPSEEDLRSWGHHSDPSTVPDTILQCSAGEEVSFVFTNQGDGKLVPVESM

SEQ ID NO: 184894 - protein, 82 aa, Triticum aestivum
  Clone ID: PAT_TA_79312.pep
LNELINKQSLCLDVDTYSLLIHGLCRVGETDWAYQLFEEMVGSEIVPRYKTWELLLDEAQRKNMEGRVERIRNYMTCFGISV

SEQ ID NO: 184895 - protein, 102 aa, Triticum aestivum
  Clone ID: PAT_TA_79313.pep
RPTRPHIICSVGIRQCSGAADVVLYTISRFPLLFSGSTIKLCWWASSTLFQGTLPLLCLPLLLLLYICVLLLVVRLHLYCCNKTGTKVVFSSLRLFFKKKKK

SEQ ID NO: 184896 - protein, 56 aa, Triticum aestivum
  Clone ID: PAT_TA_79314.pep
MDRSRSKRGYHYDQDSPPPRSKPRFDRRGGGGGPNPNANYHRRGPPGGGGGASDRR

SEQ ID NO: 184897 - protein, 161 aa, Triticum aestivum
  Clone ID: PAT_TA_79315.pep
MGRARGGRLLLVLAALFVALLLLSGCAAEGEDEEGSPVAAAEEPEAPMEDKEKAALYAAIGGFVGKAWNGSGLFPDPCGQTPIQGVSCDLFNGLWHPTVVSIGPVLDNSLQCAPDARFSPQLFDLRRLKSLTFYACFPAANPTAIPAANWYRFAGTLETLE

SEQ ID NO: 184898 - protein, 103 aa, Triticum aestivum
  Clone ID: PAT_TA_79316.pep
PHRNAKGTVIEACLDKAKGPLATLVVQNGTLNKGDILVCGEAFGKIRAMYDDRGSLVDQAAPSNAVQIIGLNNVPLAGDEFESVDDLDVARERANARADAMRI

SEQ ID NO: 184899 - protein, 203 aa, Triticum aestivum
  Clone ID: PAT_TA_79317.pep
RPGKLFLVFLIQVIYMDHLIFPQAAINEHQLNYSLPRACFVHQTDFDLVLEFDKNKLSLGKASFGKCRFRPLSETPYIALPAEGPVGNMTKVDQDQQVPDSPDCVDTEDCGAENVNINDNQADVAEEENPTEGGSNPTEHGKSRDEDVCGSLDDWLQNPAPFGAELELPSHLAAIYDKHTKLYSLELKGALSSFGQVLQAIHC

SEQ ID NO: 184900 - protein, 195 aa, Triticum aestivum
  Clone ID: PAT_TA_79318.pep
VDPRVRVDGGAGGGGEAVEAGVAGDAMEVDGGAGGGGGGAGDVEGGGGSGAAGGAQLASSPATVFRIRLKQPPASLKYKMRVPELCRNFSAVAWCGKLNAIACASETCARIPSSNSSPPFWIPIHILNPERPTECSVFNVRADSPRDFVQFIEWSPTSCPRSLLVANFHGRITIWTQPTKGPVNLVRDSSSWQCE

SEQ ID NO: 184901 - protein, 87 aa, Triticum aestivum
  Clone ID: PAT_TA_79319.pep
KSTLMVRTSCLKNELTFSLYITLASPLSTLASTAASGQDEEEDAMQTSCCGRGWSSTTAATALLPLKDKASTRKRNRRWKAAMPNRT

SEQ ID NO: 184902 - protein, 163 aa, Triticum aestivum
  Clone ID: PAT_TA_79320.pep
DPRVRETVPIMSILVLWQFWRQEEFKGSGRCRPEQLSVVLGARIQLVVLISFEYRHFKFQPDWILLIRPPAQERTSEVKFPLIMGKCILICLKIQDRIIVTLNILGKFIHPSVAPFEWYHSPLSLELISHVVVIKLIFWAWITTCVVMEVDPIASTVAWEHFC

SEQ ID NO: 184903 - protein, 158 aa, Triticum aestivum
  Clone ID: PAT_TA_79321.pep
RAPAAATPAPSATPPLARSPAAMLPPPPPSLPVGFKPVDVPPPSLSSSRSDPDRDLLLPPPQTTTLDLPTQLRAVPMAVLVMPPCELVAPTSPKLPMPAATGNCPAPAPATATPTPPMPAAAGGCPAPSTTAAEVDILVPVGAPSLLQPAAPGSSRPS

SEQ ID NO: 184904 - protein, 204 aa, Triticum aestivum
  Clone ID: PAT_TA_79322.pep
STHASEEKEAKKEKQEHNHKEHDKLRENSIDYQIDSLIDSLDTKPLTPPLAPPADDAKVILADENLKKRKNHEMNGYLQNHHEMRPTKLPRPAPSSNHVENGTASHVAAPPSSMKPDAMKIEKAERLPKKEEKVNGNKEAQQRPSLDSGLRDPLPNKKEEKVNGNKEAQQRPLVDTGLRDPLPKKEEKANVNKEAQQRPQVVTG

SEQ ID NO: 184905 - protein, 61 aa, Triticum aestivum
  Clone ID: PAT_TA_79323.pep
TRPRSRENRRNREPPQRFRRRDDGPRPGQGGPPRAGGPGGPGGAPAGAGAVPGAPAPRVAL

SEQ ID NO: 184906 - protein, 183 aa, Triticum aestivum
  Clone ID: PAT_TA_79324.pep
MNWLFIHPHPYHPLPILPIADSRRVPNLKNHRRAHLPEGSAEIEATVTQIILAVSMQITLGPAMNLSETALTSSNGSSTPTSRISVQKLCMAVAQFSQFKRDLAKETGFGGMLELKIMHKTNLKFSSFLMERVDTESSSLLLDVDRVIQISDKDVQDVFGLPIGTRLIPNCMTDMSNACIEFS

SEQ ID NO: 184907 - protein, 120 aa, Triticum aestivum
  Clone ID: PAT_TA_79325.pep
MAAARSALASAGRAANEAVSFVVFMLLDALELLLCLVYKVADYVAEGAWRPCYCSSSAVAAPGKIVVAERGGSKVVSMLSSTKLLLEDISDTLYTRPSLLASAAGSSPPSFSRRREKARP

SEQ ID NO: 184908 - protein, 140 aa, Triticum aestivum
  Clone ID: PAT_TA_79326.pep
MQNAVLACPAPSGGGAGGDGGVGGGGAGVVMVKRAALVACLTCPLCRRLLRDAATITECLHTFCRKCISKEFIDKEICYCPTCNIDLGCAPEEKLRVDHSLQYVRSKIFPSKRRKVVDQEAISPVESPVKRKERSLSSLT

SEQ ID NO: 184909 - protein, 82 aa, Triticum aestivum
  Clone ID: PAT_TA_79327.pep
AWYSTQFSSTTYRKSQMYLYMKVIIRSMTILLEIINPNPIEKISMKLRSSLSCSGRHKTDRANYQIHEGSYGRCHDFHRTRG

SEQ ID NO: 184910 - protein, 175 aa, Triticum aestivum
  Clone ID: PAT_TA_79328.pep
MMEAAEFRPWSDLPPELLGLVLKRLPSLADRVRLRAVCHPWRSNSRLQTLPLPFPWLTLPDGTLLGIPSGEIHHISLPEGACCQGSIDNLLFLMHNDGVCYLMNPFSKTRLQLRKLAKVWKREIYDPEPRINPIFYNLVVPFPLDSSPCSLLAALIMDDGNWGTLCISQSPIVTD

SEQ ID NO: 184911 - protein, 97 aa, Triticum aestivum
  unsure (1)..(97): unsure at all Xaa locations
  Clone ID: PAT_TA_79329.pep
ANYISFICCFPKHWIHEIFCCFPKHWVHENVFSRVRNRXSHVFLERDRYDLCLTNVMRSLAWCVDRERKVREPPATVVACVPPHYLQRGGDAGGQRY

SEQ ID NO: 184912 - protein, 209 aa, Triticum aestivum
  unsure (1)..(209): unsure at all Xaa locations
  Clone ID: PAT_TA_79330.pep
VDPRVRLDMGFRRDXEKIMAATPKDRQTLLFSATVPEEVRQISHVAMRKDYRFINTVKEGDEETHSQVSQMCMIAPLDLHFSILYDVLKKHVADDADYKVIIFCTTAMVTKLVAEVLSQLKLNIREIHSRKSQSARTKVSDEFRRSKGVILVSSDVSARGVDYPDVTLVIQVGIPAGREQYIHRIGRTGRKGKEGLGLLLVAPWESHFL

SEQ ID NO: 184913 - protein, 84 aa, Triticum aestivum
  Clone ID: PAT_TA_79331.pep
TFGVLSEVNYSNILAHFWLCCCIGSNREDILPEPCLHRACVAALHLACCTPIGSKLYWSLFHGKTVGDGGFVVASVYARVVALT

SEQ ID NO: 184914 - protein, 46 aa, Triticum aestivum
  Clone ID: PAT_TA_79332.pep
TDTVEPYKLAPFPINSNCALSALVSNELLIFMIVPDAWVDAGIPDR

SEQ ID NO: 184915 - protein, 224 aa, Triticum aestivum
  unsure (1)..(224): unsure at all Xaa locations
  Clone ID: PAT_TA_79333.pep
ASETTFHTHNGHYEFNVVSFGLTGGPPTFQCEMNETLAPVLRVCVVVFFDDIFVFSATLQDHVKHLRQVLQLLKQHXWRVNEKKCAFAQRSISYLGFVVSGQGVSTDPAKVRDVLNWLVPQSVKELHGFLGLSGYYRKFVRNYGVISQPLTQLPRKNVSFVRTATTQTAFDVLKKAVTSAPVLALPNFCLKFTVETDASDTGXGAVLIQQGHPIAFVSKGLGPR

SEQ ID NO: 184916 - protein, 137 aa, Triticum aestivum
  unsure (1)..(137): unsure at all Xaa locations
  Clone ID: PAT_TA_79334.pep
STHASVASISIHPPLDIAKTPASWPTRPREANQMEIEIAPDSPAPMPRSGDIAVADGTATLSPPPSPPQGPASPSPSLSPRXTCSPSPLPATAPPGAAALSPFAPRSSTKARAPSGLREGSAAGRGSRARPRRPGRT

SEQ ID NO: 184917 - protein, 113 aa, Triticum aestivum
  unsure (1)..(113): unsure at all Xaa locations
  Clone ID: PAT_TA_79335.pep
DPRVRARVTATRRGRRRPRPRRRPPPRRPRGAARPSGPRRRARRRAWCQAPCSRPPPRQRAARSRARSXARRPRRGPPGPSRRRPRCRIRELQRGRRGRPGVCLRRTRRPRKR

SEQ ID NO: 184918 - protein, 192 aa, Triticum aestivum
  Clone ID: PAT_TA_79336.pep
LSQCILYFLTGILANPLKRICVVCMKYKLGIWGFLALSRYLQACVLKCINGDLREAVNMDLVSFAKQLLNSDPLDDQLLGIRILDHLLRSREDQDERYKEKVLTKIRSSLDTVEKAVYMMGLDREVEQDTRGHAARILLELAPGLQVESFPGIFQAISSLLSARKTKTSGSSSNSTCASKELKLLGVDILDK

SEQ ID NO: 184919 - protein, 184 aa, Triticum aestivum
  unsure (1)..(184): unsure at all Xaa locations
  Clone ID: PAT_TA_79337.pep
MSRVRLHRRLLSSTSPPSRSWSPRDAFAAATERLRAGTLCRDDAHNLFDELFRQATSVPERSLNGFLAALARATSSTACIKDGPALALALALFNRVCREEAGPQVAAPTVCTYNILMDCCCRARRPDLGLALFGCILRTGLKIRGGXGCERAASQDEAVNVLLHMMSELGCVPNAFSYSIVLKG

SEQ ID NO: 184920 - protein, 204 aa, Triticum aestivum
  Clone ID: PAT_TA_79338.pep
MATQGADSISTLMDKYFHPSSSETASFAREQLSCENNLQRNDVVAAFVKQHETLNLQEECTARAKQIGGENYQSECSQQYGNVGLSSNMDGSHCSSNLYQNQKANSELLERIASDSIEKPKDTNKALPEVPADRSKAKKARAGKKRTYDWDILRKEVLASRGNEGRGENAKDALDWETIRQIDVKEISNTIRERGMNNMLSERI

SEQ ID NO: 184921 - protein, 179 aa, Triticum aestivum
  Clone ID: PAT_TA_79339.pep
HASGRRLPPSPSAPPFLPFLPFLRLLLPLFSLHPCPPSQISPFPATPPPARPRAPFRRKVSASPAASPESWRGLRQSDGRHGSSLLPCCPGRPRYGLSILGFDRRRRRLCDRVRARRVRAGAEMKGVSAIPAVAIIPSPLFLWRAKVILFLLWGLCCCKIGWDSVMRMSVDLRDLFLYE

SEQ ID NO: 184922 - protein, 73 aa, Triticum aestivum
  Clone ID: PAT_TA_79340.pep
MVEGRSCLPAEIRNGLETLKKRRLERMRLSAQKDTGDNPAMAARSGGDSLRTPANCGVRLHANNVTAGLPSTS

SEQ ID NO: 184923 - protein, 225 aa, Triticum aestivum
  Clone ID: PAT_TA_79341.pep
SAHIYCTWVSEDEYFEAAKIHPRLKTRLNNFNRQFESTDKSDDDYVPIRPEWTTVDRVLASRKNSSGEREYYVKWKELSYDECTWESESDISVFQPQIERYNEILSKRKKSTDKSKNADRAMRHAEGTPEFLTGGTLHPYQLEGLNFLRYSWSINKRVILGDEMGLGKTIQSIAFLASVSEDKFGPHLVVAPLSTLRNWEREFATWAPQMNVIMYFGSGSSRDII

SEQ ID NO: 184924 - protein, 54 aa, Triticum aestivum
  Clone ID: PAT_TA_79342.pep
FFCLICASRLSSFYLFSLIPQFNLVTITCLKSSGGSLQLLDMCYWIKQLLSVLK

SEQ ID NO: 184925 - protein, 205 aa, Triticum aestivum
  unsure (1)..(205): unsure at all Xaa locations
  Clone ID: PAT_TA_79343.pep
MRTMAAPSEAAVEAFKQALATAASVSAYAMLARGMAGELLPDELRAAVHWGAAFVRSRFGARDKERHTIIIRHYDNGSSQNSFFDAARAYLATKINPRXLSRLCLARSLITEPDGSSSWSTLLSMEDGGSVTDHFDGVEFRWAFMEAGGDDGNRAKGGGETLELSFDAEHADTALDKYVPFISSTAEELRRQDRALKIFMNDYGF

SEQ ID NO: 184926 - protein, 93 aa, Triticum aestivum
  Clone ID: PAT_TA_79344.pep
LSPLLLLLLHLVPAPGAAAAVGLAVPLHGCARAWQPKTLGPDPGSPAAAAHPMAARARGGEGGRADWGSMAGGLGEGEGGLGLGLGGNNGLRT

SEQ ID NO: 184927 - protein, 217 aa, Triticum aestivum
  unsure (1)..(217): unsure at all Xaa locations
  Clone ID: PAT_TA_79345.pep
MRPCVADAACVAQLRACGAVLAGKTNMHELGAGTSGINPHHGSTRNPYHTARVSGGSSGGSAAAVCAGLCPVALGADGGGSVRMPAALCGVVGFKPTAGRLSNSGLLPLNWTVGVPGILAATVEDALIAPDQLTPSPSXNLPMLTSTHCMPNIRLARYGKWFNDSSDNIRGCCDKALQILRAHYGWETVDVTVPEVEEMRLAHYVTMGAECSASLAA

SEQ ID NO: 184928 - protein, 99 aa, Triticum aestivum
  Clone ID: PAT_TA_79346.pep
YTINSSYDSATYKSYDSCDRAAFIHPKNEINICVLRAILFVDLFKTFSTMGLTPVIYPSTSKNKQIRRRDIIPSGAGQWKLNSESTPYATLSSRTRGST

SEQ ID NO: 184929 - protein, 75 aa, Triticum aestivum
  Clone ID: PAT_TA_79347.pep
QWFTPRIHDHVRLLVSIHSIHFETNVTAYSLIHKMFAETCDGTETYCTLVCVKGKFNFTGEAEITRLLIGRVGRP

SEQ ID NO: 184930 - protein, 214 aa, Triticum aestivum
  Clone ID: PAT_TA_79348.pep
VDPRVRAFIRWSLLSENQTFEVVDASEALTVEALKHHSSSSAQYGNPCAWISLNASAAGRATIVATFSSESDSYFETFNEPIFLKATSKVSAYYPLLVLQAGNGNQFGGYWVDLSRLQSGIQNMGNNSPMELYLVPGSTMDVFLFGGPEQWDKVVDFVETVDVVGALENYIIGSTAVQKISSGLYRVSCQSKGIFKLLLSRGNMIGKDHPVPAV

SEQ ID NO: 184931 - protein, 145 aa, Triticum aestivum
  Clone ID: PAT_TA_79349.pep
GASRPASSATSEIAPRSVSSPPYPFSPDRLWLPAGQSATSSAGAHGRPISRRAKRAVEMTGGIVTVASGVMNPLIGKLTTLMGDEYKKFKGVRKQASFLEKELSAMNAALQKLELIDEIDPTIKDWRDHVREMSYDMENCIDDFM

SEQ ID NO: 184932 - protein, 165 aa, Triticum aestivum
  Clone ID: PAT_TA_79350.pep
TRPAKTVAEKEAWRLATEHGLDLVVVNPSFVVGPVLGRAAPTSTALVVLALLKGDLGKYPNTTIGFVHVDDVVLGHVLAMEDGRASGRLICSGDVAHWSEVLGSLRERYPQYPIPTECSGGKGDDRAHKMDTSKMEALGFPPFLSIQQMFDDCIKSFQDKGLLLP

SEQ ID NO: 184933 - protein, 233 aa, Triticum aestivum
  Clone ID: PAT_TA_79351.pep
TRPAQALPKVNGSKVNLKTTGSDKEDTVPYTSSKTFYNQLPDWSMLLAAVTTIFLAAEKQWTMLDWKPKRPDMLVDTFGFGRIIQDGLVFRQNFLIRSYEIGADRTASIETLMNHLQETALNHVKTAGLLGDGFGATPEMSKRNLIWVVSKIQLLVEHYPSWEDMVQVDTWVASAGKNGMRRDWHIRDYNSGRTILKATSVWVMMNKTTRRLSKMPDEVRGEIGPHFNDRSAI

SEQ ID NO: 184934 - protein, 104 aa, Triticum aestivum
  Clone ID: PAT_TA_79352.pep
LKNPPLNSGSDGPDLSCPHRPVQPPCSPSSRPPPMSPAAAGAASSGEAPPSREPYTIPASSGWFRWDDIHETERQALPDFFGGAGGTGFGTATRNPRIYREYRD

SEQ ID NO: 184935 - protein, 112 aa, Triticum aestivum
  Clone ID: PAT_TA_79353.pep
MARTSSRRRAAKLMAKPSGSTMVKGNPDDRISSLPNDILVNILDRLDVRAATRTSVLSRRWSQLPAMVPRLTISARDLLPSETKTSISKAEIVRRTTAAVAKDPANVAVSDA

SEQ ID NO: 184936 - protein, 110 aa, Triticum aestivum
  Clone ID: PAT_TA_79354.pep
MATESEPAAAPRLLLGPPLIRAARPSPDSGAAAGDALHPFVDLLDAAFNAPSEAALKAALKPRRALTENCSATYANSGNPCLDFFFQVVPDTPADRVRQLLAADWAQDSL

SEQ ID NO: 184937 - protein, 67 aa, Triticum aestivum
  Clone ID: PAT_TA_79355.pep
LLRELQVRLVVIAVAVAALLLLVARGVGDCGFGRLGCSIVVVVVAGVLQSEPAAPSHFFVATDSGGR

SEQ ID NO: 184938 - protein, 182 aa, Triticum aestivum
  Clone ID: PAT_TA_79356.pep
VVMDDGDNSGSGASTSTCTSAHGTMGSTLPEKMTKLNIEQVIPSQSMKDEAATRQPEPFVFGSNATSSFSSLKKTTSFTSFQTNVSSESKGSRRNLANDSSGSSVTALSEGAAEHALQDEIKKLNINKEGPSAGNVNANDACTPKFSFQSKAEAVPGYCTFPQPKLQESCPFAPLNHSSTFS

SEQ ID NO: 184939 - protein, 160 aa, Triticum aestivum
  Clone ID: PAT_TA_79357.pep
RPTRPPLDIEGRDFFNLSCSRNVESMNVPPLDDDLMEDLTRDIVLNNGIERGATAQVAELINLHRGHLSPEIDFPLAHSRESSSSGNSEQSVPTTLTLGSNFYFSNNIESERQLKENHELLEGQKGLDVSTVTEFDSLVKQKGVADDDSVGVGSQNWLTL

SEQ ID NO: 184940 - protein, 126 aa, Triticum aestivum
  unsure (1)..(126): unsure at all Xaa locations
  Clone ID: PAT_TA_79358.pep
STHASADAWVMRPLRLVPGLLLLLLSRPAPAPASTVVTHLPGFDGPLPFYLETGYVGVEEDTGAELFYYFVESERSPGADPVLLWLTGGPRCSGFSGLTFXVGPVKYMLAPDDGGLPQLVYTPLTW

SEQ ID NO: 184941 - protein, 133 aa, Triticum aestivum
  Clone ID: PAT_TA_79359.pep
ASASPSRPPLSYAPTAAAPNHLPHSDLDPPPPPTPPPPPPSTTITVDEVEADPRSSHAQTRDGRSGDSQATPRQSRPRSESSRRSPPAGLGLAGVPRRRPPPYRSRQLVPLPPPFPADPCSATTAAACSGTAP

SEQ ID NO: 184942 - protein, 86 aa, Triticum aestivum
  Clone ID: PAT_TA_79360.pep
GHLEEGGPCALPSHVEQHRAAAAAVAASSGCRGRGIGLGLEPMVQTRCLGEVQRRSCIPAVGRGVIRWRVRVVLRVHAGRERRGAD

SEQ ID NO: 184943 - protein, 41 aa, Triticum aestivum
  Clone ID: PAT_TA_79361.pep
FFFFFFFFFFFFLEKVFWVALYCFPDFREFTEAELGQTEEP

SEQ ID NO: 184944 - protein, 133 aa, Triticum aestivum
  Clone ID: PAT_TA_79362.pep
RPTRPALSSSSSSPPSAFPTCSASRSPTSPPPFRALDATLCHDSFTVRCSFGLCTSPTSPFVTASARAAPRSWRLLLPGTAVGELSFTITASQPRAPTYPPSRAGSDPPRLPQPLAGRPSRCRTWSLPLFVSI

SEQ ID NO: 184945 - protein, 61 aa, Triticum aestivum
  Clone ID: PAT_TA_79363.pep
STHASDEINHRKSLMLTTREVLALSGWGRCFWYGLPLCTPGLAGRNVTSNLVARWAGLIVA

SEQ ID NO: 184946 - protein, 146 aa, Triticum aestivum
  Clone ID: PAT_TA_79364.pep
FATTQAFRLPSRQNDQIAAQKQNRHRPGTPSDLGAHRMTQINPRLAGQDPRFRAGSIGTAFARDHLMRMREGKGRGGEGRAKGAEIGTIAVLVEEAEGLLELANLLLAQLVRHGKPKPRRGDEDLQMLRELRVDGAMMTWEGLSGR

SEQ ID NO: 184947 - protein, 49 aa, Triticum aestivum
  Clone ID: PAT_TA_79365.pep
PSGAPSTCSCGAGPPWPRPPPRRRSPLRRASSPSSRRSRRDRGMDGRTR

SEQ ID NO: 184948 - protein, 187 aa, Triticum aestivum
  Clone ID: PAT_TA_79366.pep
DPRVRGRLETTESGHALEATAKSVSVKRKYRKKNYHTDTPRRSPRLIQMGECCIGPVEEPAADHKRSHTLGPAEESAASTDPAETAVLTMTHVGSTSCFCSPTSTTLLSLTSTTPKAQTSEGGDAKSVSVNAKCHKNYHTDTPRRSPRLIQMGECFTSPVEEPTADHKRSRTLRPAEESTAFINSAE

SEQ ID NO: 184949 - protein, 129 aa, Triticum aestivum
  Clone ID: PAT_TA_79367.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFARA

SEQ ID NO: 184950 - protein, 198 aa, Triticum aestivum
  Clone ID: PAT_TA_79368.pep
RVRQKIIKSTLIKDLYGEIDRLKAEVYAAREKVGVYIPKDRYQLEENERKAMADQIEQMTASLETNQKQINDLQEKYDSELQHSADLSKKLKATEKCLDHTSNLLSTTKEDLKQAHYNLKEKEFIISEQKKAENALAHQACVLRSELEKSSRDNASLHSKIARGDKLSAANRSVVNSFQADLASKLDILSSTLTASID

SEQ ID NO: 184951 - protein, 145 aa, Triticum aestivum
  Clone ID: PAT_TA_79369.pep
TGISRSFRYYRQEDAHELMVNLLESMHKCCLPSGIPSQSQSAYENSLVHRIFGGRLRSQVRCASCSHCSSKFDPFLDLSLEIANAATLVKALQNFTEEQALDGGEKQYNCQSCKKKVVAKKRFTIDKAPDVLTIHLKRFSPFNPG

SEQ ID NO: 184952 - protein, 219 aa, Triticum aestivum
  unsure (1)..(219): unsure at all Xaa locations
  Clone ID: PAT_TA_79370.pep
LLYGPPGTGKSSLVAAMANHLRYNIYDLDLSHVQNTTLQWLLLTMSDKSILVIEDIDCCCDAMLREVDSKTPARTCKEDGGGSSETSDGTPSPKRKSEVITDVLXSPALLCEHITYTIYLSQCPYAHFCVRRTQITLSGLLNFIDGLWSTSGEERLIVFTTNYKDRLDPALLRPGRMDMHVYMGYCCWEAFKTLARNYFLVDDHPLFPEIQELLMAVQV

SEQ ID NO: 184953 - protein, 209 aa, Triticum aestivum
  Clone ID: PAT_TA_79371.pep
MEYLGDGEGTNGNRGLAVSTAGGDDAFAGAVVAAVEDAQRESIALVHYIGREYVDRPNNLVPLTLKQVSMLTPSARHGGALSIHGMPVNTARLLGRVWNRTESSEEISFVLGDGTGSIEAKIWTIDGEYMRALREVRNGDYVVVNGSIRTRDSVMHIRAYSIRLVTNYNEITNHFLHCIYVSLDLQKQLREREMDIRRANLVVASNEQS

SEQ ID NO: 184954 - protein, 82 aa, Triticum aestivum
  Clone ID: PAT_TA_79372.pep
DYGYRDINVWDVNDVSGDDGMFLLVNFGRCVLHVDTDGKLIDIFNFDLQGFCIYECRLKQSLVQHTFFPSLKGYTVNASPFI

SEQ ID NO: 184955 - protein, 102 aa, Triticum aestivum
  Clone ID: PAT_TA_79373.pep
AAAPPAATSSRPVPHFLPFRLSLHDAPDRSLPPSSVVVFPGPGAPSSTEARDAQRRSPPSAKPLRRPCQVHLRRPLLALIESKGALLVPLERLDPASLAMTH

SEQ ID NO: 184956 - protein, 153 aa, Triticum aestivum
  Clone ID: PAT_TA_79374.pep
QQRPLLLLLAPPINPPPAPAPATPPSWFLGLYCNPSLCLSTRGWKMDGRSRGIQMGMGFRWMVCGEKEKGEKAPRELDPHSCASERNHFHFHHRHAAPSLADPTAAARPISTNAALAPRKPGQSWGLDLAWWWCSWDGGREGWNGGRLADAGS

SEQ ID NO: 184957 - protein, 84 aa, Triticum aestivum
  Clone ID: PAT_TA_79375.pep
HLHPLLHLLLHGAQPHPLDRHDGTAIHPIKHASLALYTARWWDGDEDAAADAEEGGRYFAERSSSTVLKACLTELSKTQPSKPV

SEQ ID NO: 184958 - protein, 184 aa, Triticum aestivum
  Clone ID: PAT_TA_79376.pep
MVGGRCTDAFAKPKHPRPAGGDDGSNGGDAGGGGGIGHAGDRLSALPDDLLHAIMSRLKALQMVRTCMLSTRWRHLWRAVPCLDVDEEETGAYNNFDNFTSNLLHCHDIAVLEDFRLHAARTSDRWVRRAVGQGEAWPCRLKSLHLFRLSNLNLTDIGSHISSRCFALEDVQLRNCSFVLTSNA

SEQ ID NO: 184959 - protein, 178 aa, Triticum aestivum
  Clone ID: PAT_TA_79377.pep
STHASGNRYEVAPSGEIQRLTFYSPLCRAVLSLQRLSSSVQATILSIRVVGEGHPFKSGGEVFCWSSSADGSSTMHEKAVLFHSLEGIPQEDDELDLDGYLPLSRNVVSVESGGGLNVVVETYGGSSTSTHVYFPCEYCNISQRTCLVCGSEVEITVAWSRLVRDKMDLLIDGYTTQA

SEQ ID NO: 184960 - protein, 104 aa, Triticum aestivum
  Clone ID: PAT_TA_79378.pep
CGMSLMVNFWIVVLWSIQLQKQICKIESNDTVLTKNNNSDNCIEDRSETFIYIFSFIFSDRSILKVWQLFTYLIVVGLFFLYLYSSKPFPFVCSGVSYDLERGV

SEQ ID NO: 184961 - protein, 150 aa, Triticum aestivum
  Clone ID: PAT_TA_79379.pep
VSTASSNKRRAYRTSRAHFYWVTREPGSFEWFKSVMDEVAEMDKKGVIELHNYLTSVYEERDARTTLLSMVQALNHAKNGIDIVSGTRVRTHFARPNWREEFTRISAKHPGSTVGVFYCGKPTLAKELKKLSLEMSRKTTTRFHFHKEYF

SEQ ID NO: 184962 - protein, 76 aa, Triticum aestivum
  Clone ID: PAT_TA_79380.pep
LSSLLSHILHHPLFVFNQLLQIVPVLALLPCWFKGSSALLKCWFNGNIALYWLTNSVQQNMLFLLVYTNILETKAW

SEQ ID NO: 184963 - protein, 76 aa, Triticum aestivum
  Clone ID: PAT_TA_79381.pep
SSPVRCDGEGRFQKGAGTDRPVWAWLERADGPREKGIGLTWTHAAGPAKSQRLRRRRGPTAVRGSPPLPPYPRPGR

SEQ ID NO: 184964 - protein, 88 aa, Triticum aestivum
  Clone ID: PAT_TA_79382.pep
RRLRAVPPPPPRRPRRRVRHRPDERHLRRRGGLRRLRLLSDHLSRRVKRESSRSFCSVMFLAIEDLVLVVRSGSDDRLITRLVHRVSD

SEQ ID NO: 184965 - protein, 169 aa, Triticum aestivum
  Clone ID: PAT_TA_79383.pep
CGVDAALTVLADSVYASQAAGDCHYGNLSDYEVTGSCFDSLGGRKRARLMEGSKKKRKRYGGAAQGNRRPLDGSHEEPMPLPNPMVGFNLPNDRLRSVTRRLPQQAIGPPFFYYENVALAPKGVWATISRFLYDIEPEFVDSKHLCAAARKRGYIHNLPIENRFPLLPL

SEQ ID NO: 184966 - protein, 96 aa, Triticum aestivum
  Clone ID: PAT_TA_79384.pep
WLSRDRYLEGSSMDLNASPLPEDDDHEEPVELDFGQDDEDHVESAVEIMRREREERRRKLKRDQPDDGLRPRPQQVRNDHVTQNKIGGYKRVKETP

SEQ ID NO: 184967 - protein, 91 aa, Triticum aestivum
  unsure (1)..(91): unsure at all Xaa locations
  Clone ID: PAT_TA_79385.pep
DPRVRAYVNLKRTPQLVELVQDSQEMEELMSLSPEKILLRWMNFQLKKGGFXQRTVTNFSSDIKDSEAYACLLNVLAPECSAKPSPMSVKD

SEQ ID NO: 184968 - protein, 134 aa, Triticum aestivum
  Clone ID: PAT_TA_79386.pep
CPLAIACCQCWLPVLAQQIWLEPDLPKPALVVCSLCLVEQGCSFHLLISSALFSSFDNLETASKQIPSCSSSNKVVLGEGTMTYFPEEVVEHIFSFLPAQCDRNTVSLVCKVWYEIERLSRRTVFVGNCYAVRP

SEQ ID NO: 184969 - protein, 143 aa, Triticum aestivum
  Clone ID: PAT_TA_79387.pep
MATAAGATGAAALWQPQEEGLREICAVLEAHISPNSDQARIWQQLQHYAQFPDFNNYLVFLLARGQGKSFEVRQAAGLLLKNNLRAAFVSMPPSSQQYIKSELLPCIGATNRAIRSTVGTVISVLFQIVGVTGWIELFQALHQ

SEQ ID NO: 184970 - protein, 44 aa, Triticum aestivum
  Clone ID: PAT_TA_79388.pep
SLSVLSVVIVKCAFYDCILFGDFPFCAREQSLFPTGSKKKRKGS

SEQ ID NO: 184971 - protein, 120 aa, Triticum aestivum
  Clone ID: PAT_TA_79389.pep
TRPLSFPLHKRRGHWQAFPGCEHLFPVSKTLPFGNSYSELIGGLANLPGVPLGREAMVEASRLLSAYHPGADVEPVKRALAAMQVMINQVQRLEPIRKTVLEGWVTGARVAPEHLPYIEH

SEQ ID NO: 184972 - protein, 67 aa, Triticum aestivum
  Clone ID: PAT_TA_79390.pep
MFGFGHHGHHGQNPPAHAPAAAGGNQPTFKIFCKADEGYCLSVRDGNVVLAPSNPRDEHQHWFKDMR

SEQ ID NO: 184973 - protein, 53 aa, Triticum aestivum
  Clone ID: PAT_TA_79391.pep
TRPLSSPAPGGISYGLTSRGDHHDRHTRGGGGVGRGGHKHPRAGRGGILPAAP

SEQ ID NO: 184974 - protein, 75 aa, Triticum aestivum
  unsure (1)..(75): unsure at all Xaa locations
  Clone ID: PAT_TA_79392.pep
LFAKNVAPHQTCLTRIQQVPSLDQLHRKKILXRCPLNTCIGPSIRHFLVSKRTPHSPLPTSPSSMSILLERTPHS

SEQ ID NO: 184975 - protein, 41 aa, Triticum aestivum
  Clone ID: PAT_TA_79393.pep
EIEYSNLLDVRLVKIGCSGTGNRMMRNDIRSYTRTLPTRYE

SEQ ID NO: 184976 - protein, 128 aa, Triticum aestivum
  Clone ID: PAT_TA_79394.pep
EATHFRLAGTTYLALFPWPCPMVPTSVASFTSFNAFSLIALASFAAFSSLIASASFAAFSFLISSATSSNTCLTLASSFSSQASSCTVINSSPKAFASAWEQHLKIGVERPWLYSASMGCFISRTRGS

SEQ ID NO: 184977 - protein, 92 aa, Triticum aestivum
  Clone ID: PAT_TA_79395.pep
MSAYCGKYKDELIKNAAYIGTPGKGILAADESTGTIGERFASINVENVEDNRRALRELLFCTPGALQYLSGVILFEETLFHSTKGGKPFVDI

SEQ ID NO: 184978 - protein, 70 aa, Triticum aestivum
  Clone ID: PAT_TA_79396.pep
RVRKMTPQKSVRGCLMDDLQSLALSLWPALSLWIWWCPWSLAKLASFGVSLRCSSVGLMVFTCWIWLSSE

SEQ ID NO: 184979 - protein, 54 aa, Triticum aestivum
  Clone ID: PAT_TA_79397.pep
RVDENAVYFGDLAAVRDELLSEEAVGVAQHVRGVIDRDASNAGDVDVTGGRVGR

SEQ ID NO: 184980 - protein, 66 aa, Triticum aestivum
  Clone ID: PAT_TA_79398.pep
FRAHLWQKVHESVVMDLCQVLDQELDALEIETVQNVFLHPRKSYKMNSSCADVLLFAAHRWQMSKP

SEQ ID NO: 184981 - protein, 129 aa, Triticum aestivum
  Clone ID: PAT_TA_79399.pep
HRCTRTETPPNPYGRRPLAMRGKQCARGQGRGCRCRTWTERRRRRICRMGEKLRRGGRTEGMLAYPSRSRGRDERAGSRRQMRARRSDAAAGRPDGDAWVLAAGQGRRWGNVAAAGSGRRWGVAGRVGR

SEQ ID NO: 184982 - protein, 48 aa, Triticum aestivum
  Clone ID: PAT_TA_79400.pep
FILASLYSVIILCVQSGGVIFRRQAPPLQCCSFHGPHVDLCRDMFRLF

SEQ ID NO: 184983 - protein, 54 aa, Triticum aestivum
  Clone ID: PAT_TA_79401.pep
HASALCSALLVRENPNPPTTSQPASRRKSRTESLAPNPGDPFGGGEASGQGGMS

SEQ ID NO: 184984 - protein, 214 aa, Triticum aestivum
  Clone ID: PAT_TA_79402.pep
MHRLIGIPVAAAEYPMTHQVCEGTVSVSTCELDDLVSASTSDDSICSAHSHDSPGVSDDFTTEQQCVQSDELTSSVAMSAQQFLVDGSMTAEDSSNHENLGSYNVTSECKDKQLQVQQEQENIELCNNAGRNLAAAVQVNSGHFGDKAVNLKSAIPTESQHEYPKRDAIVLEGMQAALTTVVSGENRNSVNTELDSLGILLGALAEESILADVP

SEQ ID NO: 184985 - protein, 98 aa, Triticum aestivum
  Clone ID: PAT_TA_79403.pep
WWFYVVRRSLTSTTLISIPVPFSIRTGYSSTLDLPIVLIPLAIGNSDDSGVQNSLLLHVRFLVPSQRVDFRLENKNSALFVLPLSGVLINYCSQSIPV

SEQ ID NO: 184986 - protein, 119 aa, Triticum aestivum
  Clone ID: PAT_TA_79404.pep
CQSSYFSSMARDGFDFNMCIYDGISYLSRVQESLARKKTFTPHLQQPSPSSSASVADSVGTTRIKSRIQHWRKGCAEPSKTADGSLVSSLRKLIMGSESYGSRPSMTIDVRSDRQVQLV

SEQ ID NO: 184987 - protein, 79 aa, Triticum aestivum
  Clone ID: PAT_TA_79405.pep
MEIPRSLGVQDNEEEEEYDSVFYEDIEAPKFVDLTAPDAACPADDPSWFCLRVGCDQSHEHVDPEALHRSFVMRVMAAR

SEQ ID NO: 184988 - protein, 102 aa, Triticum aestivum
  Clone ID: PAT_TA_79406.pep
STHASGRASGSRRRHSRGKASGCADGHCSRRRRCRYFGADCRADGECRRRQHCRDFECARRADGGDYAQRCRLPRRLSPVRWSCSCSCRPRGRGRVGAEGIR

SEQ ID NO: 184989 - protein, 55 aa, Triticum aestivum
  Clone ID: PAT_TA_79407.pep
AAAAIAAGRVAGAGVAAFDEESLLSSLRAASFFSKKPRGGDRAAEARRGRRRRRA

SEQ ID NO: 184990 - protein, 67 aa, Triticum aestivum
  Clone ID: PAT_TA_79408.pep
RATIPAGDQVRYIGRSGSTTQNVLAICDFDMHFMYTSVGQPGSMHDTSVLFHAIEADKDTFPHPPKG

SEQ ID NO: 184991 - protein, 65 aa, Triticum aestivum
  unsure (1)..(65): unsure at all Xaa locations
  Clone ID: PAT_TA_79409.pep
SLNHFIKLRTIQSPMSTQGLREIIEGKNXHLLDRWYSRVLQSVRCHLLISCEYLWDHSINHQQSC

SEQ ID NO: 184992 - protein, 37 aa, Triticum aestivum
  Clone ID: PAT_TA_79410.pep
PSPFAMRSNALFITHSVPFSEINKALDLMRMMQRMPS

SEQ ID NO: 184993 - protein, 74 aa, Triticum aestivum
  Clone ID: PAT_TA_79411.pep
MTAAELQAELLRAQLEEHNIDGDEPIVEDDDDNDEDEDEKDDDDVAGVDATGRSRQSRSEKKSRKAMEKLGMDL

SEQ ID NO: 184994 - protein, 71 aa, Triticum aestivum
  unsure (1)..(71): unsure at all Xaa locations
  Clone ID: PAT_TA_79412.pep
MYTARKKTXRQGVEPSEFEDTVAQAFFDLENGNHELKSDLKDLYINTAIQMDVVGNRKAVVIHVPYRLRKP

SEQ ID NO: 184995 - protein, 84 aa, Triticum aestivum
  Clone ID: PAT_TA_79413.pep
MESSITSTGGALSRLQRRRRGVHLRRAHLRVHQRAACPVEPARCSVKAIFCSSGSLRTPARLLHAPVSILDIVLLATYSRTRGS

SEQ ID NO: 184996 - protein, 92 aa, Triticum aestivum
  unsure (1)..(92): unsure at all Xaa locations
  Clone ID: PAT_TA_79414.pep
PTRPPTCPKHPDVTLHTLTLETDVHLHPGARPTARGXGDGEAEGAPPGGQCGLGPHGQARPLPRSFRRGGIYERGSRRGKPWAANWCSHFTI

SEQ ID NO: 184997 - protein, 155 aa, Triticum aestivum
  Clone ID: PAT_TA_79415.pep
QVACRDFPHSRHLCSSLPFGTTSHVRHCTMCYCFVCDVPAPCKYWGKGLLTDDHCHGTDDEMSWKILRQTFRLGRLTASLSEKCQNAVHPPMVPPTQQDVHHQVSAPQSHPSSMPVLPNAGQTVGAVRASPLTRAERCRDNAHTARVTRTATPCP

SEQ ID NO: 184998 - protein, 140 aa, Triticum aestivum
  Clone ID: PAT_TA_79416.pep
THASGRAPLDPLPFLPAVATSHPPRQPLLLQPPPPFSPDPIQVPLVHRPLPPVTTPTSPPAHPWSSRRLSAPPTASTETAVDLRCASWRTAGEANNLSPWADVLQDCVPHVHAYLTGPAYRSDLDLVAGRPPPMPAPPPP

SEQ ID NO: 184999 - protein, 79 aa, Triticum aestivum
  Clone ID: PAT_TA_79417.pep
DPRVRHHLHKHNVIYLYIAAMQGLIFLAKREQGSTMLTYFSDYHLVYLAAEVVPAIPPEYTVLSVQQDLIVGNISWRSR

SEQ ID NO: 185000 - protein, 199 aa, Triticum aestivum
  Clone ID: PAT_TA_79418.pep
DPRVRDLLSWARLLTNLRNELRLSYMEHREVIARVSSNEYIKSLRKFSLVNYSGLMKRTPAFDLHAVVPDKIDKTGQSFTSLVPQSSTPAHMMSPARNICILGISYSTTKGSCFDPDATVPAKKLKSGSGSALAYFKCPPCAEPLPEAVSSVRAESPKYDLLDSSKESPCAMKAGCAVSPMFQEKHNESNAGDVPWCVH

SEQ ID NO: 185001 - protein, 49 aa, Triticum aestivum
  Clone ID: PAT_TA_79419.pep
KRGGASALSCRWDLTTETKARSSSTPHLGSRYGEKKEARAHGGPVVRRS

SEQ ID NO: 185002 - protein, 94 aa, Triticum aestivum
  Clone ID: PAT_TA_79420.pep
FTSAVLDEIDHVLSHPYTAQLTVGATWAKAVDEMGLNWTSKHTYHISDCLSVCHADVYYSSTRCIWILHSPVNCSASTTVTTHIYAYGKTYVYC

SEQ ID NO: 185003 - protein, 57 aa, Triticum aestivum
  unsure (1)..(57): unsure at all Xaa locations
  Clone ID: PAT_TA_79421.pep
SRVDPRVREHLRLQNEGFLSTWTNSFVGPWDPSQGEHNPDXKIKLWLFLSGRHSSVP

SEQ ID NO: 185004 - protein, 202 aa, Triticum aestivum
  Clone ID: PAT_TA_79422.pep
GPDSRVDPRVRGDAPPPTVSSPPPSPCSATGLHPLLLTSHPIPRWPCFRIEQGMPRRSQIRGCSSSRPTDTSSTMKDSRALGSALARPTAAGTELLRAPRPGERLRLRRPRPCLLHTPVVARRGRRSLLPPPYFTEREGRRLVCIFSGNHAAVRSDAAPPREDWTGQGWARLGWGATPILAMPWRFFKLCTTGSQGQQGPPP

SEQ ID NO: 185005 - protein, 185 aa, Triticum aestivum
  unsure (1)..(185): unsure at all Xaa locations
  Clone ID: PAT_TA_79423.pep
PPQYFHDHDLDFAPEGQETDDKLLQRAKEIEERFIIPSGDNHQLNMSRYKRLSSNEMFQLIQCLTEDRKQLADELSSQIKARLEERFNAKEKYKQSVKELEIRTRRLEKEKTEVQSTLEREIDRRSNDWSARLLRFQSEEERXLRERVRELAEKNVSFQRELTSLEAYKVDASDKVASFGKAKHG

SEQ ID NO: 185006 - protein, 162 aa, Triticum aestivum
  Clone ID: PAT_TA_79424.pep
MEAARDSMAALLDAGIFDSAQTLGCFLVSSGGANNEASISMKAESLVLHGDALYGEKEFRRALNAYKQAMQCSKSIPRQATSTARISISTTGRSPSPNSSNVMPFNENEVKSKIAICHSALHEYREALQEMEGIPSKMRNLKMNLMLGKLYRISRNNRAAAI

SEQ ID NO: 185007 - protein, 170 aa, Triticum aestivum
  Clone ID: PAT_TA_79425.pep
PRVRSDDHALPDPEEKSGISVCLDAGPSGNAVAGSNLDGQKDLDWDSEESHLCGNGTGPLFSVYEDPDGNSVHVEVNEDEIVSRCVNADGEGSGDLQSMLSRARVMAKGFESGEREVPKNSSLVRFLATEKKESRGVDADVSVVQTNRTASRAVARGGFAAFCGVRIVLM

SEQ ID NO: 185008 - protein, 108 aa, Triticum aestivum
  Clone ID: PAT_TA_79426.pep
SDMVRGKCSVTTCVKEPWSQRIHMRDPSEQVESVCMHVSLLAACSVHLRPSHGSWRDSRSKIRSVSTWLVHGEFSGVVGLGIGVSFARQECQPLLYKCVALSNQKKRP

SEQ ID NO: 185009 - protein, 214 aa, Triticum aestivum
  Clone ID: PAT_TA_79427.pep
TRPSKFRDIYDEEHFVKRLQNDVRVVNKVPDFVMERFGHNLSNVFNFKIKAWSSSKYYEDVVLPKLVEERFIRISPFANRLSFDAPPVVQRLRCLVNFEALKFSNPIATLSETLISRMREKSAESNGKYIAVHLRFEEDMVAFSCCVYDGGDGEKKEMDVAREIGWRGKFTKRGKVIRPGVIRMNGKCPLTPLEVGLMLRGMGFNNKTAIYLAS

SEQ ID NO: 185010 - protein, 56 aa, Triticum aestivum
  Clone ID: PAT_TA_79428.pep
EGKMERNRRYFQVKQLCEGVLKQGWTQGMVNCLLEIRSNNVYAWSSDSLFSTSFAF

SEQ ID NO: 185011 - protein, 160 aa, Triticum aestivum
  Clone ID: PAT_TA_79429.pep
RPVVSPGGGPAEGLDGVGRAGWAARQRAYDLDAGRLGRHGHVHLPEPRPPVGRRRHHQGLLPPGAELLLLLLLGGRGPSPRAEPHGVVLHACLLVTFSLRKDASRSAPCTLLLLLVVVVVQPRQDRSFLLETLPTYLPSRSSSSSSTSSPCPCRRCTSIT

SEQ ID NO: 185012 - protein, 207 aa, Triticum aestivum
  Clone ID: PAT_TA_79430.pep
ASPGAVIQQNAGFPGNLGRSGNFLDGNSVYDSRSSFQKGQGSVSDPRYMDPRWRPVQQHFDQSSMANEYSAHPANPRPDYGRPGEHYVVGQDVRLENGIYVKEQTGGHPPMFYNESHSHDRSWHVHPNQSHQRYEDPRLNLPPNGRVMDPYADSNSANSAFAPSKVYDMHSTSHSRSSHESPHYYHGSGEHINDAYHNQPVVSSGSY

SEQ ID NO: 185013 - protein, 106 aa, Triticum aestivum
  Clone ID: PAT_TA_79431.pep
MGEVVLISRSGSGCGGGGGVGERKADHQERQGQQGQVLELLLAALRKSVALPCQMADADDPAGGAAGAGWGMDIGWPTDVRHVAHVTFDRLQGFLGLPDEFELQIP

SEQ ID NO: 185014 - protein, 39 aa, Triticum aestivum
  unsure (1)..(39): unsure at all Xaa locations
  Clone ID: PAT_TA_79432.pep
NSREIFCHYRIVXWCHQSHIIMPFTSLFLKPNEKTQLDI

SEQ ID NO: 185015 - protein, 154 aa, Triticum aestivum
  Clone ID: PAT_TA_79433.pep
MAEAAGATPLLTGLPDEITISEILVRLPPKPLLRCRAVSPAWRRATSTRDFLLSHHARQSALPLLYSHNDVADGGQSLDVTLFDHRAGVAAADQFQRVARLKTAPLEGGIDGSFTPLFYPVASCDGLLLLSIDCDLCICNPATRQYAPLEQLDG

SEQ ID NO: 185016 - protein, 239 aa, Triticum aestivum
  Clone ID: PAT_TA_79434.pep
VRNSRVDPRVRDRGRRSAREVNCDSSATPPSRRGRKRKEEVQEADSDEDWDPRKKGASDSDTDVDIGRRRARRGKGSGSAAPRSGGTGRPRGRPRKTDSAAKPSQPAKVKDEEVEEKIEYPSAAELLVQLTSVASDPFNFKGYDSVDVIFSFFSKHKDSKAPSELDDKELLEIFGGKKGRKKSVGSFTKAKHEIEAEQLELETADGQRGRRKSAGGIYSARKAEDSYWCDIIISDFDDG

SEQ ID NO: 185017 - protein, 228 aa, Triticum aestivum
  Clone ID: PAT_TA_79435.pep
TGPESRVDPRVRDFTPPRRFKRKKTHESKAVKGKKVSNNSPTIPTKSDEKKKKKCRPTIWCAPEFIKSAIEILKDCQRKRIKKLGFGWVLSLTVDALRTRNLPVFLMDNTSESLVINVGTQGGLKITPHAVHCVLGLPNGGIDPPPLSRAIKIEQLRELKKLLGVPKDENITVEVLYQRIRLGGDDDLTIRCFIIIVFNRLLFPTTATYITGRDAAWTSDLHNLPNID

SEQ ID NO: 185018 - protein, 41 aa, Triticum aestivum
  Clone ID: PAT_TA_79436.pep
MDLVGLDKLLSKQTIYMAQNFEILIIVTDRLNMSKKKKKKK

SEQ ID NO: 185019 - protein, 219 aa, Triticum aestivum
  Clone ID: PAT_TA_79437.pep
PVRNSRVDPASAEMSSNRRSSKARKSTTNYYRLPFDKHRLFDPDAFLSKDRCANQSQSTQSGSRHTDKLFTTPQLVSALTGIWNLVGHPESSGTTDQRSVSEEILHKEDPVCFTRDREGHTLTSCTESSTGLNSQTCLSTPKSIHEDLRLVKKMLMLRSCSNMIGASATWRHMHLTSKLGNMHYQNIYPMQTKKLGACATSSSMDIKEDDCFGRGDNCC

SEQ ID NO: 185020 - protein, 119 aa, Triticum aestivum
  Clone ID: PAT_TA_79438.pep
CFQNYANRVTLRQPNKQIVQSTKQILDRHCPIQIQPWHERSVDPKRVKETNFFLSRGGRLQQREGLRRQQHTSLLGRQTSTLLTLCIDDRSMVCRKESGQWQSGSCSTLKNRTPYCPPG

SEQ ID NO: 185021 - protein, 75 aa, Triticum aestivum
  Clone ID: PAT_TA_79439.pep
LAGRSAVAARGTGAGARECYLGKRADDAERQQPPPFSLDPAARWPPGGGREMRRRLGFRSSPDRKRRRRQAHHLP

SEQ ID NO: 185022 - protein, 134 aa, Triticum aestivum
  Clone ID: PAT_TA_79440.pep
PAGTGPEFPRSTHASELERYASGGGALLMRRAGSSKIVAASSHLLFRATVLATLALVCLFAVHYPSLLSRSFRLSAAAAASSSSSPPRQTSRHRNLLGSSSAYAGAAWEREVRRSATPRRDGGMSVLVTGAAGF

SEQ ID NO: 185023 - protein, 63 aa, Triticum aestivum
  Clone ID: PAT_TA_79441.pep
PSTVAAAIPTLASVCIRPLPRRQSTAASGAWALARVTGSARRRIARGKAVVTGRVGRPGNPDR

SEQ ID NO: 185024 - protein, 67 aa, Triticum aestivum
  Clone ID: PAT_TA_79442.pep
FAITIGSLHGDLLFEEEHIVIGDPLTQKVSCSCGMFNRTGILCGHDLKVLDLMKYKDIAKKKKKKKK

SEQ ID NO: 185025 - protein, 95 aa, Triticum aestivum
  Clone ID: PAT_TA_79443.pep
MSSTIFPLSPLHSHLNPSPPSFSPSSIHASFLHLVPHCVIVLVGKRPTRIVLLGFDPHYSSWCDGRTIEMGRTRRLIDWSSKFFREAISVARALA

SEQ ID NO: 185026 - protein, 102 aa, Triticum aestivum
  Clone ID: PAT_TA_79444.pep
RKIMEHGKLAFYLRCQLLLYFTMAIFNLHCHGNFTVKYLANLLSTYMGNFTLFLPCHNFTLFFHGIILTLLTWQFYWNIHGNFHCTLPRQKITIFFAMAILP

SEQ ID NO: 185027 - protein, 128 aa, Triticum aestivum
  Clone ID: PAT_TA_79445.pep
MMQFTHAAVTAPPLYPNGHHGLGLGLFLDVGAPRARPWPAAGSLFPTLPPSSKISLGNLNSAGCMEQLLVHCANAIEANDATLTQQILWVLNNIAPADGDSNQRLTAAFLCALVARASRTGACKAVTA

SEQ ID NO: 185028 - protein, 227 aa, Triticum aestivum
  Clone ID: PAT_TA_79446.pep
PVRIPGSTTRPRSISKKRLIRRWIAEGFVSEKQGLSVDDVAETCFNQLIKRQIIRPVQNSTDGKVKSCQVHDMVLEYIITKAAEENFVTVVGGQWSIPTRSSKVRRMSLHSSDSKHARKAYGMNLSHVRSLTVFGSLEQQRFKSFKTGIVQVLDLEGCSGFKAKHASVSDICKMTLLKYLSLRGTDISVLPPNIGGLKYLETLDIRQTEVEELPKTVVLLERISNIL

SEQ ID NO: 185029 - protein, 102 aa, Triticum aestivum
  Clone ID: PAT_TA_79447.pep
HPKTTTYRQSSQGRPCFPQNGTRIKPLRRQYSSEQYSQSRAILAHSRFPQSLWSLLGRNIAPRVGTNTQFTAQHGSRSGRLADTQHQRLILLARHRNRSDAG

SEQ ID NO: 185030 - protein, 98 aa, Triticum aestivum
  Clone ID: PAT_TA_79448.pep
CSTPARHRDLSSHSVPPVPPPPPARRHGPSCPSAPPGPPPPPVRRRGLPLPAARRRGICPAHKQSVRYQRTSGRRILEEMTQVHTTVRLGAFLHSFLW

SEQ ID NO: 185031 - protein, 202 aa, Triticum aestivum
  Clone ID: PAT_TA_79449.pep
REREREKERRDRDKDRSRNRDKNKDKEDREREKLRGKDRGEDADLPKGDEGDQNKGGDLPGEPDQASTSALRDRIARAKEERLKDKKEGGILDDKDDASEILSWVGKSRKLDEKRQAEKEKALRLARVFEEQDDMLAENSDDDYDEADKLGGDHLSGVKVLHGLDKVIEGGAVVMTLKDQSILADGDINEEADMLENIEIGE

SEQ ID NO: 185032 - protein, 174 aa, Triticum aestivum
  Clone ID: PAT_TA_79450.pep
PASVLSCEETQGILNDSLEKKSPVIQTLICDSLIRSSLKHLSKYSSLHALKLCIRGTESFLLKSMYLHHLRYLDLSNSSIKSLPEDISILYNLQVLDLSYCYYLDRLPRQMKYMTSLRHLNTLGCPELKSMPPGFENLTKLQTLTVFVAGVPGPDCSDVVELQHLNIGGQLELR

SEQ ID NO: 185033 - protein, 62 aa, Triticum aestivum
  Clone ID: PAT_TA_79451.pep
HHLIEIFFVFLMLRLQVTMYLKSQICNLSLKALKNKLARIWYIYFVIKFLSYTATYIINIFS

SEQ ID NO: 185034 - protein, 89 aa, Triticum aestivum
  Clone ID: PAT_TA_79452.pep
RKQKLFLSQVHMARAKHHLISTDHGTNNRNHQANARSRNSSRRFSESHGHDGQIKSWRSLPLSGCYLPTPTAPVDSISPDAWVDPGIPD

SEQ ID NO: 185035 - protein, 218 aa, Triticum aestivum
  Clone ID: PAT_TA_79453.pep
RPTRPTGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVASN

SEQ ID NO: 185036 - protein, 223 aa, Triticum aestivum
  Clone ID: PAT_TA_79454.pep
FPGRPRVRAPQYIILVLGADDNGEGGTFALYSLMCRRSRMGLLNSLHAGHGSVSSYNQDEPCKETRSSLAIRGFFEKHHSLRVVLLLFVLMGTSMVIGDGVLTPTMSVLSAVSGLRIKFPELHENYTVLLACVVLVGLFALQHYGTRRVGFLFAPILLSWLACIGGIGIYNIFRWNPTVVRALSPYYIYNFFRKAGRDGWSSLGGIVLCITGAEAMFADLGHF

SEQ ID NO: 185037 - protein, 201 aa, Triticum aestivum
  unsure (1)..(201): unsure at all Xaa locations
  Clone ID: PAT_TA_79455.pep
ADAWGLSGEALDLFAQMEEEGEVMPNEITFLGVLTSCSHGGLVEQGYHHFHRMSSIYGIAPKIEHYGCMVDLLGRAKLLAEAEQFIKEMPIAPDVVMWRSLLFACRACGEVGLAEYVAERIQVLEPNRCGGDVLLSTVYATTSRWVDANKVRTGIYSSRKTKQPGCSFIEVDGCVHEFFAGDESHFETEAIXTTLLGINEL

SEQ ID NO: 185038 - protein, 97 aa, Triticum aestivum
  Clone ID: PAT_TA_79456.pep
REFSIAEHQKHARAHTRHEEDDWVILLFLLASTLLNTRAQGCQNRDFIVRFSDFTIQANPSDSTILVHRIYVFTILIVKILRFTILPSKLGRVGRPG

SEQ ID NO: 185039 - protein, 59 aa, Triticum aestivum
  Clone ID: PAT_TA_79457.pep
ACGRRDSSASKAPTDRSQRSHPLDFMFGQFSIVLPNPDHPSGNSRDFEPSTTGEIRKAN

SEQ ID NO: 185040 - protein, 82 aa, Triticum aestivum
  Clone ID: PAT_TA_79458.pep
FSGCSPYSRCASVECILGKTNRIPTVRRKLRWLAKSLIHRRPLARWSSSEPPPPWPPGWPRRRCKRIREMLRTRGRPGNPDR

SEQ ID NO: 185041 - protein, 219 aa, Triticum aestivum
  unsure (1)..(219): unsure at all Xaa locations
  Clone ID: PAT_TA_79459.pep
TGPEFPGRPTRPVRFLSVFSRPTHTRSFSRALPGWLSRGLVGRTLADPSFPHKMAFEFLATFASSVWWEMNIRKERFEQEWDLAVVNALTASCCNLVILGLLAPCRSYGSTSRFDFQNAIEKLPNNIFEKSYPLREFDLQKRISAFLYKAAELSLVGVVAGSIQGGISKALSARKDGRLSVTLPNVSTNALGYGAFLGLYANLXRYQLLCGLDQYMDQA

SEQ ID NO: 185042 - protein, 89 aa, Triticum aestivum
  unsure (1)..(89): unsure at all Xaa locations
  Clone ID: PAT_TA_79460.pep
SAYALLLSGDIKVTHDGSSYKCPFCSVGNGDYNIHELLQHALXVWAARPCTRKAKQKVDHRALAKHLKDEPSKSHSPLLRPILMDPQPP

SEQ ID NO: 185043 - protein, 167 aa, Triticum aestivum
  Clone ID: PAT_TA_79461.pep
GEMSSPRRRHCRRSPAASPLEDDDLLSEILLRLPPQPSALPRASAVCKRWRGLVCDPRFRRRFRLRHRRNPPLLGFFNRFDRLSFQPTLDAPDRVPLGPFPFQRNDGGYFVSLGCRHGLLLVFLPGILEVLVWDPVTGDRHRVAIPPVVAERAAEIGVGGAVCRAPG

SEQ ID NO: 185044 - protein, 240 aa, Triticum aestivum
  Clone ID: PAT_TA_79462.pep
HASEFLQRDPGLRPQIWQYPPDQRDIVRRAYLMLGPMQPRLENYKPSGELGHQRRFQYSWFGDFPSWLEYSEEKSCVYCLYCFVSNNKENTRGGSHVFTVHGFDSWKRVCGKHCAFLTHIGSGPCSPHNNAVTSGHALMKQPCHIENVMAVRDKEKVERNRLRLKVSIAVVKWLAFQACAFRGHDERPQSKNQGNFLEMVKLLAEFNPEIAKVVLGNAPYGAKYTSHDIQNEILSIFASK

SEQ ID NO: 185045 - protein, 145 aa, Triticum aestivum
  Clone ID: PAT_TA_79463.pep
EFFRVVLRVCVCTSMYVFEGVELNRGQHTGRSSAGAFVAITKCVWFIFFYLCLALLAGGLLGVCCRRVCPNTFLLHRPWLSERGFNAKLLAQTIVWDQDLVQQVFNADVGPHILSIPIKDGFDDLPAWHPDPKGQTSTCTVADRT

SEQ ID NO: 185046 - protein, 164 aa, Triticum aestivum
  Clone ID: PAT_TA_79464.pep
LINLFFQWNFQRIFHVKSLEKTAQDDFQMLASAVFLQVSTISQALIFVTRSRSWSFVERPNFLLVFAFLVAQLIATLIAVYADWAFTSINGIGWGWAGIGWLYNLVFYFPLDIIKFFTRYALSGQAWDLVIEQRIAFTRKKSFGQQERELNAPRTLHGLQPADA

SEQ ID NO: 185047 - protein, 158 aa, Triticum aestivum
  Clone ID: PAT_TA_79465.pep
MFKLHRHRSSDRSVGERFEFRFSSFRAVMVPAVSDRMFLSIVSVDTGKTIAKSSKVAARSGICQWPDSISEPIWFSRDAVSKEFDECQYKIVVSVGSIRTGILGEIFLNLSNFLNLADPTAISMPLKRCNSGTVLQLKVQSLGTKPKLGGVRSSRDMP

SEQ ID NO: 185048 - protein, 96 aa, Triticum aestivum
  Clone ID: PAT_TA_79466.pep
GFKKLFFFPKRAQCRACNERKSVLKEPKHSFKAVLGIAVDYHNPVCLTCFRLFLCLSDPLLHIFTVGQPQTDLTRLILIALPKLSLLKYQLIVATL

SEQ ID NO: 185049 - protein, 212 aa, Triticum aestivum
  Clone ID: PAT_TA_79467.pep
MCGRARCTLSAAQAARAFGFPTTTSAAAGGGGGGDGGGDAPAVRTLQMDRFRPSYNVTPGAYLPVGTLRARAAGGEGRAEEQGPVIQCMKWGLVPSFSSKTDKPDHFRMFNARSESVKEKASFRRLIPKNRCLVAVEGFYEWKKDGSKKQPYYIHFRDERPLVFAALFDTWTNSDGETLHTFTILTTHVSTSLKWLHDRMPVILGDEDSVNA

SEQ ID NO: 185050 - protein, 90 aa, Triticum aestivum
  Clone ID: PAT_TA_79468.pep
DNLAKRGWPHNPQCLLCLQEPETAAHLLTSCSFAKEAWHLTLCKLNMSPAMAAAHDDSLVSWWQRTNSSMGKERAKSWRSILALVWWNLL

SEQ ID NO: 185051 - protein, 87 aa, Triticum aestivum
  Clone ID: PAT_TA_79469.pep
CVHSFSLRGYDVRIVCSFIIFVASVSTQHGSSLLFSPFSLFFNLPRHSFSLLWLCFAGVILMCVLVLAVCILVMQRSGVYSSCFVFP

SEQ ID NO: 185052 - protein, 207 aa, Triticum aestivum
  Clone ID: PAT_TA_79470.pep
LPAVELLSTLPRSTSINLLVMLPTRELAYQVAVEARKLLKYHSSLGVQVVIGGTKLSQEQRSMRSTPCQILVATPGRLIDHLQNTPGFSARIKGVKVLVLDEADRLLDMGFRRDVEKIIAFIPKERQTLLFSATVPAEVREVSHLAMQKDYKFINTVQEGDEETHAQVNQMYMVAPLDLHFSILYGVLKKHIAEDAEYKVIIFCTTA

SEQ ID NO: 185053 - protein, 56 aa, Triticum aestivum
  Clone ID: PAT_TA_79471.pep
IIRCKGLLLGLVRLNSRRSICVIYCILYCTIQRTSISALLQAESCGIIPDFTRKVV

SEQ ID NO: 185054 - protein, 120 aa, Triticum aestivum
  Clone ID: PAT_TA_79472.pep
TRPPGLTSLAVLLIHGRPRPMSGSFADSAFFTSGGASLVTCHTDKLISPFLFVHVLMFCWFDSGSSVPLSGRRSLGGSEFTKLPKGIQVALRAQIRLMDLGLRSPPNSCLIFLHAFFCLV

SEQ ID NO: 185055 - protein, 163 aa, Triticum aestivum
  Clone ID: PAT_TA_79473.pep
MAAAAVGISRTSAAGAGSSNSSEFRFFLSCDISLPLTFRVLQAPIPPPAQDGLDKKVSELFVECKLYIDGIQFGLPVNTRLESSGPPYCWNELITLCTKYRDLTSLAQLAFTVWDVSSGEGKSVVGGATIFLFNSKKQLKTGKQKLQLWPQKEADGRVPTTTP

SEQ ID NO: 185056 - protein, 186 aa, Triticum aestivum
  Clone ID: PAT_TA_79474.pep
GPESRVDPRVRIFTESKVLQPDSLLQLARALIWAAGRPQKVASSPDDEDTAVFCLELLIAITLNNRDRIVLLWQGVYEHIANIVQSTVMPCALVEKAIFGLLRICQRLLPYKENLADELLRSLQLVLKLDARVADAYCENITQEVARLVKANAGHIKSQMGWRTVVLLLSITARHPDASGVGFEAI

SEQ ID NO: 185057 - protein, 52 aa, Triticum aestivum
  Clone ID: PAT_TA_79475.pep
TNIVHPCPCSSSGLHLRKHVINGKNVCFIALRNVCFLVCFGSDFSTIHCHFS

SEQ ID NO: 185058 - protein, 171 aa, Triticum aestivum
  unsure (1)..(171): unsure at all Xaa locations
  Clone ID: PAT_TA_79476.pep
RVRRNFRLRVGAHRPYPPPPPPRIPSPSRSRPNNPPPPTDLKSPXPRRRRNPKDPNPPPRFGVPGRRASPPPCPXPPPAPVPCSPPASRPSAAPPPSRTSWSPPPPPPRACRPPSAAGSASCPRGSGTRPSSCRRPPRRPARPPRRPRSRTGTARCTRWRCAPSARKAPPL

SEQ ID NO: 185059 - protein, 67 aa, Triticum aestivum
  Clone ID: PAT_TA_79477.pep
PTRPPTRSPSPPPPPPPPPNPLRCTAKSPPKAAVQAPDPHFYQPLPHRAGRRRRPALQHFCADAAVI

SEQ ID NO: 185060 - protein, 36 aa, Triticum aestivum
  Clone ID: PAT_TA_79478.pep
YILQLMWIRRARPLRSTTALNSLRSDERRRIDNITL

SEQ ID NO: 185061 - protein, 119 aa, Triticum aestivum
  Clone ID: PAT_TA_79479.pep
MSTDVAADVPAPEVEVTADPVVETTAEAAAGDAKPAKETKAKAAKAKKPSAPRKPRATPAHPTYAEMVSEAITALKERTGSSQYAIAEFVEDKHKAHLPGNFRKILSVQLKKLVASGKL

SEQ ID NO: 185062 - protein, 162 aa, Triticum aestivum
  Clone ID: PAT_TA_79480.pep
YRTPRSSEEASWWYRSPSGQVIPPVYPHVERSPSPVPQRRPVDDAEQQERGSSSRPVVATPSAFPEVELFRSLSKDPAVEALVPAVTNVVAKPAEPALLRKEVAIESRAAVDHEHEAGLKHRHAVQLMENGIQISEQLKRAAIGQESKAGSKDSHAVQLMES

SEQ ID NO: 185063 - protein, 57 aa, Triticum aestivum
  Clone ID: PAT_TA_79481.pep
THLSAIGVWNAKVSCKPTKYQSSRLVCHIWFLWQHLSNFTSVLIARYIHECSRLLYS

SEQ ID NO: 185064 - protein, 59 aa, Triticum aestivum
  Clone ID: PAT_TA_79482.pep
PTRPRSQSATRMLDSRPDHNPTFPRCILHVCSHRHTLAKASPLLDRRRPRSGSELSAGR

SEQ ID NO: 185065 - protein, 87 aa, Triticum aestivum
  Clone ID: PAT_TA_79483.pep
FLIYPGATSCLLSSSFLLFWYCPQTLALVILDWACSSDELIWVGLSPLVASSRLPHGWCFRTSASCQIRCEADVEEIIRQRCVGWLR

SEQ ID NO: 185066 - protein, 225 aa, Triticum aestivum
  unsure (1)..(225): unsure at all Xaa locations
  Clone ID: PAT_TA_79484.pep
TRPVLIIHEKEPPGDILVFLTGQDDIDAALKLLNDEIQHSXKHYFDLVILPLYSGLPRGDQDLIFAPTSKGKRKVVISTNIAETSLTLEGVVYVVDSGFSKQKCYNPISDLESLVVAPISKASARQRAGRAGRVRPGKCFRLYTEEYYLNEMQSDGIPEMQRSNLVSCIIQLKALGIDNILGFDWPASPSPEAMIRALEILFSLGILDEDAKLTVPIGFQVAEMP

SEQ ID NO: 185067 - protein, 236 aa, Triticum aestivum
  Clone ID: PAT_TA_79485.pep
VDPRVRWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKD

SEQ ID NO: 185068 - protein, 202 aa, Triticum aestivum
  unsure (1)..(202): unsure at all Xaa locations
  Clone ID: PAT_TA_79486.pep
VDPRVRYGMVAXRDTVDHNRNILFLRERRDCQILTQKDPCLQLTGPSRAVVSIDPVXLEIKLKVKGRSRSEDRVLIHQTFNYSGNETTLSNDFCKIMLXGCAKLENTVQATIVSVRVTNWRKRKWPFKHDGRVSCIAKGTSKPVKPEQPEEELVLQDQVTANSSDGYLDLSRHVVSVELNGRLEVIISADKSRALKSCGRVF

SEQ ID NO: 185069 - protein, 159 aa, Triticum aestivum
  Clone ID: PAT_TA_79487.pep
KLNPQSLFKWYSEKTIRFYTLTPEFLEFNPALLSYILSSDIEGGEGTLQEASSRRRLPTPPLSLSPSPSLRPALSGSPSPALGLRLSLPPPALSVSPPPSALLLLLQGRERPRETAGGEGRDQERVEEPERAGRPEPDGRPCSTAARHDLEYTPMKGQA

SEQ ID NO: 185070 - protein, 94 aa, Triticum aestivum
  Clone ID: PAT_TA_79488.pep
RRSIWAAGGVRVLGHALPIVDLQVIKNAWDGKSYLLMQSTSKMASRTRYCMGRIKSFVVPLANYSLDTTASLGTRIPSRVCKYLYIVPRMQLPE

SEQ ID NO: 185071 - protein, 97 aa, Triticum aestivum
  Clone ID: PAT_TA_79489.pep
MEGVERKLKTLQLSKAERKGVKLSKRSTGSSLNAKAQAVGKLMSNRPARVDSLVSTLGWIWCPFRGIECKDLGMNIFLFTFREEGGKMKALTSGPDV

SEQ ID NO: 185072 - protein, 45 aa, Triticum aestivum
  Clone ID: PAT_TA_79490.pep
AAPNSRPARPGMGWNSCMPCTARTCLRDGGACREEGASFRSLLRT

SEQ ID NO: 185073 - protein, 222 aa, Triticum aestivum
  Clone ID: PAT_TA_79491.pep
MEHQKRSASEPQPASGIISSGMINNVTAGMVIPPGNALKTAEVAHIPSYRPQATSQTASVNSQNDPGVIRMKARDPRRVLHNNTSQKNDTLNSDQAKSNGIALPAFQDSKDNLINRQQLAEQLQTTVLPSQPVSLSSIARQSTMSASKVDPVSNSQLAASSLIAPQESLVSVNRADPRVAAGQNDSNNAAPATTLGTRPPANQWGDLDDLLNGYDDQQKALI

SEQ ID NO: 185074 - protein, 39 aa, Triticum aestivum
  Clone ID: PAT_TA_79492.pep
SRDYPQLHYTFLGYSFYLDFRPPLTYSRIIYSYLHHLPI

SEQ ID NO: 185075 - protein, 185 aa, Triticum aestivum
  Clone ID: PAT_TA_79493.pep
EIKGGEEGIAPTAPMGGDFALDPAFRDVNQGNKGQFSPSVSLGIISDLKNTGNGQQGMSNWDDNFGDLEADFGEDKLYFRREIIGNFQKPTRVASCPLSVSACVFQEPMGTNEGKMEVNDIGAGQETRLDSPSSAAGLPAVGASDHASHGVTVMPPTVPDVQGARTAPVLVQGRAVVGGPSGLVL

SEQ ID NO: 185076 - protein, 40 aa, Triticum aestivum
  Clone ID: PAT_TA_79494.pep
REKSQIQPGISVTSLNLSKRECKKNNSTKAKSRQNPRTRG

SEQ ID NO: 185077 - protein, 104 aa, Triticum aestivum
  Clone ID: PAT_TA_79495.pep
FFFFFFFRQNVLSYKRRNRRKHIAGKNVGWSEVSNPHHYQVSHKTTLHFPGILPLSYAKLNMLTILLRPRIKTSEPNSPTLICSTIRSDHRHPPTSLEPCPVRA

SEQ ID NO: 185078 - protein, 239 aa, Triticum aestivum
  Clone ID: PAT_TA_79496.pep
RSGIPGRPTRPVFSRHEIVTVLAKIYDSRPGNLEVVFDSEMKRVSANDSRGDMYLIPWNWRAFADPSPDRYWLQIEAMDITGDISVSQLRPFSVNGLFAEVNWTWKEFFVMGIQWASVYHPALQCVLALIFTLLLVPRASVVLLKDQQSVYTYLRAGGSQYTSLKYLLGGFIWLFVELSRMILVWSLLLVYIIYLLVFPWFSGHPVTEDSSLASMTFRGWALKNGMKTFHAGTPDVMVI

SEQ ID NO: 185079 - protein, 124 aa, Triticum aestivum
  Clone ID: PAT_TA_79497.pep
TANFIISVNKLLHSCSFFQNENLCRQHNSVMYLHPDMSEIHAIKNVEQSEDCCVYLLDQITVSSLQAYLASQTINSLKLSKSPNTVLYKHFIEYKKINTNLNYEKQGSRPIYCSMDSDAWADAW

SEQ ID NO: 185080 - protein, 73 aa, Triticum aestivum
  Clone ID: PAT_TA_79498.pep
CPVLLLLFFRGSIMAMSECLLVWNVRGLNNPARRSSIRLFLQSYNISLACVLESKLAVVEKKKKKKKKKKKKK

SEQ ID NO: 185081 - protein, 62 aa, Triticum aestivum
  Clone ID: PAT_TA_79499.pep
FFFFFFFFFFLGMKFSSRIAHKKYTTLFLCIKPDTHKSQNTTAVIILKCNNTVLRIYFYGKI

SEQ ID NO: 185082 - protein, 238 aa, Triticum aestivum
  Clone ID: PAT_TA_79500.pep
RVRVDHRGEEEQYSYEDIQNCMKKVIPLDLKQTIPVDRDLVIRAYYAGHVLGAAMIYAKVGDAAMVYTGDYNMTPDRHLGAAQIDHLKLDLLITESTYAKTVRDSKHAREREFLKAVHKCVSGGGKVLIPAFALGRAQELCILLDDYWERMNLKIPIYFSAGLTIQANMYYKMLIGWTSQKIKDSYTVHNPFDFKHVCDFQRSFINDPGPCVLFATPGMISGGFSLEVFKRWAPSEKN

SEQ ID NO: 185083 - protein, 170 aa, Triticum aestivum
  Clone ID: PAT_TA_79501.pep
RRGRHMRPTSRNKAVNSKQRTGALKPKKKHHRTARPRPRRAQPCRRRRRGSRWSPRSRRCSGRRRGRRTSSSSMRPCSRPRSSRTTRSRPPGCSPPRSRRCPTRSPSSPPFRAPPSSTTRPSSAPSPRHPPSPRPPPRPSPSSPPPARASRRWTSSPSSRSSRSAPRTPA

SEQ ID NO: 185084 - protein, 247 aa, Triticum aestivum
  Clone ID: PAT_TA_79502.pep
TRPNRSQLLFELLDASLGATSSPDCSVKMAYILTNVALTCMAKLRDERFICPTGADSDAVTCLDIISAKQLSNAACNSLLFKLIMAIMRNESSETLRRRQYALLLSYFQYCGSILDSDVPPSVIRFLLLEEQEGDDDELTLQNVLKEQSELARANFAIIRKEAQAVIDLVTKDAIHGSETGKAISFYVLDSLVSIDHEKYFLNQLQSRGILRSCLTDVSNYLSKDMSCSSEFSQRFCTIDAQFSLLL

SEQ ID NO: 185085 - protein, 85 aa, Triticum aestivum
  Clone ID: PAT_TA_79503.pep
ISVPPPGLLPYTFSPARAPTDIASRSTTASAANLRSRTHCCRRSPLQPIYRKGETKRKSNSHPGRRRRRPSDLSPHPLARPPTPD

SEQ ID NO: 185086 - protein, 99 aa, Triticum aestivum
  Clone ID: PAT_TA_79504.pep
ENDDMLFYSDRLGAQKMLTYCFSSNLGCCGSTNIYSTEERLQVDAVFLYDSTASKYFWVIKQGITAVMGISGMPNHALSTKSPAAATPGRGVDPEIRTG

SEQ ID NO: 185087 - protein, 169 aa, Triticum aestivum
  Clone ID: PAT_TA_79505.pep
RVRCRLQDISGCFLFVQSDKSRDMIHVHEATDGYALFVTGNISDQQCLGHWRVSKYQGRLQEVLTEADQCVDNLNNKVLRRPWDVGYWSFGGYRSYILAGGKTKWPYTFAFYTKKPRQILQGQKSSCRLRARSLVVVYFSENLQDTVCCNKAIAWFLKLATPDGSPIYM

SEQ ID NO: 185088 - protein, 174 aa, Triticum aestivum
  Clone ID: PAT_TA_79506.pep
GSTHASEGNTLLPGACLALNNETRGVCHADHREFYSEGCPNKYGWLALLALGAYIISYSPGMGTVPWIVNSEIYPLRFRGVCGGIAAVANWVSNLIVTQTFLTLTKALGSAATFLLFCGVSFMALIVVFLTVPETKGLQFEEVEKMLGSKNYRPWKRYHPEAPTKGREIGPAML

SEQ ID NO: 185089 - protein, 144 aa, Triticum aestivum
  Clone ID: PAT_TA_79507.pep
QRERESGEWRGRSPLPPQDGSEAAPLGLSSSWRSTNTRTTVRCSRCVVEQEVSTAGDGWRLDLPWSFSSFPPCSCSCCGPHRRWWPRQLGRRGGGGGLGSARRGSSRTRPARGCRGAPRHGGEGGGGGPPAEGRRRRWCGADAG

SEQ ID NO: 185090 - protein, 49 aa, Triticum aestivum; identical to SEQ ID NO: 147490
  Clone ID: PAT_TA_79508.pep

SEQ ID NO: 185091 - protein, 191 aa, Triticum aestivum
  Clone ID: PAT_TA_79509.pep
MASPASTSAPVSLSLPLRPSPCRLLPAAFSRPSPRRLALAPARPAAALLSSPSPSQAQHEDDEEEEEEEEEEYGEDEELVEEDELVEVGYVSGAHGVRGDVLVSPRTDFPELRFATPGKRWLRARAAGKMQVRELELLRGKAHTGKKGWIVRFDGVDSLDEARQIVGSAVLVKTEDRPELEEDEIYSLDLV

SEQ ID NO: 185092 - protein, 55 aa, Triticum aestivum
  Clone ID: PAT_TA_79510.pep
MGKAGFGVAAGCAAVTCAIAAVMVAQRVAARARWRRAVALLREFQEGCATPPARL

SEQ ID NO: 185093 - protein, 85 aa, Triticum aestivum
  Clone ID: PAT_TA_79511.pep
MALSTVLFHPINLMEPYAAGSTSRRSGSPDWVLLHRSARFSDLQNSTTVKSKTRDGQADEVTFWVVHPPGVSYFSDHCPCLNEDD

SEQ ID NO: 185094 - protein, 131 aa, Triticum aestivum
  Clone ID: PAT_TA_79512.pep
PRPGEKWARGCRARRWGSPGEHSRTGPGAAADRAEWRTTRGCDGVAERAWHPARQAAPKQGMQRRWPLLSLSAAVLCRHCRCCPASSLMSPSASLHKWCHHVQIKSSARCRKIEHVHLTCLRKFHLETRFD

SEQ ID NO: 185095 - protein, 109 aa, Triticum aestivum
  Clone ID: PAT_TA_79513.pep
RWHSLWRLQIQIRGPKTLICKEDKLYVRQNQRTPNGESLREISLRKSVGNKKKLNGKQMHPCLPSKNDACFCNVVMPQAPESLTYADAWLPFQLESRREHHVLSLSDAW

SEQ ID NO: 185096 - protein, 179 aa, Triticum aestivum
  Clone ID: PAT_TA_79514.pep
HASGVFRREIQMSTMRALQRRQADKRISRSSDPSSRLHVPVPVGASEMGSEPDVEIPAAPTTNDNTMLSVNLEAFAKENYPSTNLESSVKEMERVVGLEDHQMEDSTQKKQSKDEADEDSSIHSPRRGSPTPPLLLKKPGKIALPSHESTMGRFLWAPTWDRDRMQIGMFKDGDGNLLV

SEQ ID NO: 185097 - protein, 183 aa, Triticum aestivum
  Clone ID: PAT_TA_79515.pep
MDPAAAAARRQADKWMSVAEKLLMAKDLEGCKEFSSQAIAADPRTPGAEDLYAAADVLLASQRRRLPSGQPDPYAVLGLDSAKPASRLPDVVHSKFRRLSLLLNRSHPDRPCSVYVAEAARLVADAWAFLSNAGLKSALDAELHAAAAPRASHPPPTLQPWQEWHRKVPSLTLRTMILRCRSC

SEQ ID NO: 185098 - protein, 121 aa, Triticum aestivum
  Clone ID: PAT_TA_79516.pep
GRPTRPLVHASHCSPPRGGPATYNRRRPVRSGEIRRIPPPLPRVGTSGAWIWRLCPREQPWRPCPLLLAGTSSGRGRRRLSDPASTAPVATGSVDPPGGCAPVSPTSPTTCPVAHSSGAAR

SEQ ID NO: 185099 - protein, 142 aa, Triticum aestivum
  Clone ID: PAT_TA_79517.pep
PSLQLVSRLNSMFQCMVPCCAHTIGRSKCEYSHNGRQTVHDDTRPALFPSCCFASFHTKTPTVDLLSEEKAGPPPCHRLRREGPPEGERETAEQVNRDRRLEQLTVVDFEAVVAINHLHQLANEGRHRLGSPYRLIQEAGRV

SEQ ID NO: 185100 - protein, 233 aa, Triticum aestivum
  Clone ID: PAT_TA_79518.pep
TRPAESEHDKLVSHKTFEAGPKEIPSTAVPGEFGVFPQDVSTSQQIKEVEDASERSLDVMADILSTPNTNSVTISADPDAHAPIHSPTVFTGNADAVVPTGRRLETSQQIREVEDVSKRPLDARADRLSTPNTNVVTISADPDAHAHASQADRVEVVAADSEHHKLVSRATFQAGPKEIPITAVPGEYGVFPQKVSTSSVRNPAAKRSRSPEDETAAVSVHSSCDFAASQSKH

SEQ ID NO: 185101 - protein, 134 aa, Triticum aestivum
  Clone ID: PAT_TA_79519.pep
FLCVMVQLKILEETGKLILEGRRVVHQHPHVGQMAKVVRLKICKGSSMLCVAVHSAGIADDTVSVSAGYMISLSAAVYLIWWAQQKASATIPESNMHVVICSPDMFGPYAGGKPGNIYVYKPGFSNSTYKLAKK

SEQ ID NO: 185102 - protein, 145 aa, Triticum aestivum
  Clone ID: PAT_TA_79520.pep
VDPRVRWNAVLAARARDGPLGMGDFRLLRRLGCGDIGTVYLSELSKGGGGAARAPWFAMKVMDKASLESRRKLSRAETEREILQLLDHPFLPTLYAHFETDKFACLVMEFCPGGDLHALRQRQPGKLFPQHAARIYAAEVLLALE

SEQ ID NO: 185103 - protein, 65 aa, Triticum aestivum
  Clone ID: PAT_TA_79521.pep
LRCSRQAWRRAPRVDHLACMVDLYSRAGKLDKAMQFIADMPFKPDAGIWGALLHACRVHRNVELE

SEQ ID NO: 185104 - protein, 115 aa, Triticum aestivum
  Clone ID: PAT_TA_79522.pep
MELEAPVVEADPGRRITRGAGGGGGGGGEGEGPAGRTTLLPCPNCDIQVVHKLAQLLLPGLAAACVDSTLGSPSSALAVQLRAELVRYVAHRSSSPPEAEEEEDPIDRDDPAEAV

SEQ ID NO: 185105 - protein, 197 aa, Triticum aestivum
  Clone ID: PAT_TA_79523.pep
MLARVVLSGESSGAAPAAAWKYAEAALAARLASPALLLTLLSSRVIPQRVARPTAYRLYLELLRRHGFKLCFQMKAANSNKIRQLIDDNLNLSQIFGFSACEPGVFIVEFVLCILWQLVDTALDDESLLELTPEKKAQWPTRPQDISAFEVSFSEQKPEKIEKLQRMNSVITIELIGHLLHNKVITRILSLARENMQ

SEQ ID NO: 185106 - protein, 69 aa, Triticum aestivum
  Clone ID: PAT_TA_79524.pep
IWAISSFQFRWSWADAPPRFCTIIGYSFMNSTSRSPNVRDNFIRGVCEARSWRTSGPKYAAENRTRGST

SEQ ID NO: 185107 - protein, 84 aa, Triticum aestivum
  Clone ID: PAT_TA_79525.pep
PAGTGPEFRVDPRVRDRLRSFIMRGVDVESHVYLLLPHQLCSGLFLNIVWFQRRSISSAEPILKTTTLVSFLISCTVFTLGPEN

SEQ ID NO: 185108 - protein, 182 aa, Triticum aestivum
  Clone ID: PAT_TA_79526.pep
MPPTMLAPVPTRPRSHPFRRRRDAATPLPDQIAAAMAGKRPAESSTSASSSFRSEVVSTTTATSSAALAASQRPEKRPRRQDSGDARPAASECSEVIGGATARPAEVEASESSCLRSVLQPDLACPELLADDAEATEYSSACDELTQSDAEEEVLSAPSPCTDYSLSPLLDTSSSSSEEEEE

SEQ ID NO: 185109 - protein, 212 aa, Triticum aestivum
  Clone ID: PAT_TA_79527.pep
PVRNFRVDPRVRSCHAATAPPLATSPCVPAYLILSLSLFVIFFLRSPVAKGTCLARADVVRAARASRSLRRSSERRERERDGGGAGPGRAGRVDGMNRRQPGWSRLGTCSSSATRMARLSSATSPPASTLGPASPGPSGAAPDIDLFAADRAGTAGPRQETLPGMDVPPGAFLRPAMPGIPQASLQMSVPRAGPPWLPPWSHAAQQPQLLLP

SEQ ID NO: 185110 - protein, 90 aa, Triticum aestivum
  Clone ID: PAT_TA_79528.pep
FFFFFFFFFFWKVILSESLYLFYRIWRIILLESLCASLDAEPELSFSLKNSIGPSDRIPNQVLATLNSTPGRPCATPTTTPDQTARTRGS

SEQ ID NO: 185111 - protein, 102 aa, Triticum aestivum
  Clone ID: PAT_TA_79529.pep
TGPEFPGRPTRPKVAPLSFGSPGRHPLLEFEFRRANGERRAPPPPRAHHRSPSRARDLGFKPPLPVLRRGAPSRPNPPRPRLPPCPWSSRPRPATPPPATSP

SEQ ID NO: 185112 - protein, 116 aa, Triticum aestivum
  Clone ID: PAT_TA_79530.pep
RGRRRRFASTSISPASPPAAVASVSALILVVGGSRRALSGEREREGRAAGFLGFMPPGLLGCLWAVAVLLVRPPVANQRRLLRVVTLAAAVRGVGEVLVVKGVAGETKLVRTRGST

SEQ ID NO: 185113 - protein, 45 aa, Triticum aestivum
  Clone ID: PAT_TA_79531.pep
VQRERSLRCISYLRTSPSDKVDGTSLSEGEVFKVHQLLKDISLRT

SEQ ID NO: 185114 - protein, 156 aa, Triticum aestivum
  Clone ID: PAT_TA_79532.pep
MGAAAVLLCAALRRSRPAAAALLLPRTLPSAPVPLPPPPLARALPLLPRLPFSAGCSYSTVAEISEPPAKPKGKPKRSPMKQSRIDFTKVDAALLPTIILVGRPNVGKSALFNRLIRRREALVYNTPGDHVTRDIREGVAKLGDLRFPVLDSAGLE

SEQ ID NO: 185115 - protein, 73 aa, Triticum aestivum
  Clone ID: PAT_TA_79533.pep
TVKKGNKKLSRISACDRASRKATRNPGIQADPLIHPKKSKHIQACASNFFTRIQTDNAAKKIQLLHKHGIADN

SEQ ID NO: 185116 - protein, 137 aa, Triticum aestivum
  Clone ID: PAT_TA_79534.pep
MRLPAWLTAVPPDPRVYGDLIQRCAEAGHLAAGRQLHARLATLSVIPSNFLASKLISLYSRTGRLHDARRVFDAIPQPNLFAWNAILIALSLHSPQPSAALRLFAASDVSPDEITVSALLKSLAASGTGLSPLVAGE

SEQ ID NO: 185117 - protein, 119 aa, Triticum aestivum
  Clone ID: PAT_TA_79535.pep
CRFVRSSCCDRRNKSQSTPGEGSLPCLYHCLFILTGAGEMSLSLSYNLVSRFEFQKKKVSRFETGVRYLQVIRVYGMSFSAARLRLASHLGVDRVVTLISTSAATQSFSQLTLGHLQCG

SEQ ID NO: 185118 - protein, 207 aa, Triticum aestivum
  Clone ID: PAT_TA_79536.pep
CRYRSGYPGRPTRPEKSYSTGTPDTVWNVKVLLMSGMSNGAFADICSLRSAEERIAHWNNVLKFAVFKKDHALITIGGPWSAAIDGGDPLIDCSCLVRTAIRCTKELVQIDLSNCTHWNHFLEVHYNRIGKDGLFSHKEITVLFVPNLSECIPLVELWKKTWITYRNSKVYREKLAIKSENAPCDTKEQKEGADDGHMREGDILQDA

SEQ ID NO: 185119 - protein, 114 aa, Triticum aestivum
  Clone ID: PAT_TA_79537.pep
SQILNRHGYLSVRAGSNQFGLQFFWWQITIRVLLFTDKSSTINQERAEAARLEEEEEEELVVVPAGSVVGHGHRHGGVGRERAPAAADGEPVEAGLPPDAWVDPEIPDRYRRRP

SEQ ID NO: 185120 - protein, 56 aa, Triticum aestivum
  Clone ID: PAT_TA_79538.pep
QPRPHGTFMHLRHMTCQLIVFSRQPNADNGILQLARFLDVVPRLETLHLDMVYLNL

SEQ ID NO: 185121 - protein, 219 aa, Triticum aestivum
  Clone ID: PAT_TA_79539.pep
PVRNPGSTPRPDACANSEAIEEAFLYFDAMSRDHDIEPGMEHYVGIIEVLGKSGHLNEAVEYIEKLPFEPNAMIWESLLNLARMNGDIDLEDRAEELLVSLDPSKANPKKLPTPPPKRRLGINMLDGRNKLGEYRLPPKIEKKVVNEQRYVPDTRYVLHDIDQEAKEQALLYHSERLAIAYGLISTPARTPLRIIKNLRICGDCHNAIKIMSRIVGGEL

SEQ ID NO: 185122 - protein, 80 aa, Triticum aestivum
  Clone ID: PAT_TA_79540.pep
LEMTFDSWFLRWYITLKHFNFWLWLSIIYYFTTEIWLLMIYVTIVFVVFDSIKDRKCISYHCSCLLVDLANPLSSFSTKI

SEQ ID NO: 185123 - protein, 154 aa, Triticum aestivum
  Clone ID: PAT_TA_79541.pep
GRLQVPVRNFRVDPRVREEKEARKNGMKWMKKEVLRAFENYKSADKNLEYEVVMIHSQCLIFDTFSKSYHHYNFTMRTRQSRSKHWNYQQFFAEAKSMEGKTQYFCIPLQPSEHGHCFGCRKVGVSLRHPESGGYEKGNSGSGFPFDTDSESAD

SEQ ID NO: 185124 - protein, 75 aa, Triticum aestivum
  Clone ID: PAT_TA_79542.pep
SEQCQNNTLVDSMRCLKPSFYLENVKRHTLLDLMRWLKPPILPRNCKKIYASRLDEMAITTPISGLGMETYCVAQ

SEQ ID NO: 185125 - protein, 59 aa, Triticum aestivum
  Clone ID: PAT_TA_79543.pep
LRLSHRIQKKVTCNHHQNIATILIWGVSLHGNRTLGTSWGMQQFSSPDQANTSAGCIST

SEQ ID NO: 185126 - protein, 56 aa, Triticum aestivum
  Clone ID: PAT_TA_79544.pep
GPEFPGRPRVRDTPFNQAAYGLVDKLGSLVVRIVFLPFEESSYATFTQLASGFSFA

SEQ ID NO: 185127 - protein, 121 aa, Triticum aestivum
  Clone ID: PAT_TA_79545.pep
PAASSCRRALPSQVSGEVPEDPVLSTKSGLLFERRLIQRYIEDHGKCPVTKEELAMDDLVTVKTNKIPKPRPLQAASVPGLLGMFQNEWDALMLSNFALEQQLHTARQELSHALYQHDAAC

SEQ ID NO: 185128 - protein, 193 aa, Triticum aestivum
  Clone ID: PAT_TA_79546.pep
MASDTEGIAALFSMYNDDDEEDADEPGPPSPPPPAAATSPSTSPRARGESSNPNSNPNPSPEHSPPPLPEEQAGRKTLASPQVSPALPPLPSRRSPLPFAVSSPSPSRPQLSAPPPDLPRPPRRGSLAIVDYAHDEMAMSPDQEDGEIMSGIGGLGSDAQDAEGILEERVLSGTVHILTPKVLSETSQHLDAP

SEQ ID NO: 185129 - protein, 73 aa, Triticum aestivum
  Clone ID: PAT_TA_79547.pep
EFLKDLDDGKIDNVPAPAIAIDYWRLPANATLKDVVTVVRADEAHHRDVNHFASDVYYQGMQLKATPAPIGYH

SEQ ID NO: 185130 - protein, 81 aa, Triticum aestivum
  Clone ID: PAT_TA_79548.pep
CLPAIVVVCCCLHIGDEFRTLYHSKSSTYDWLLKKTYWSTESCDHPAAVVAQRLEQYTGGSVTGTVLHARTVPAVKKSVNG

SEQ ID NO: 185131 - protein, 123 aa, Triticum aestivum
  Clone ID: PAT_TA_79549.pep
PPLSAPSASDPASARLIWWLRGQTAGEVADEPDDSKLDGGGDIFSTASSTIPAHIVLRARRRRWRLLGITSRPAGEEQQLADEQQVEERSGGDNTELEVEDELQFQVRALETQAGAGPGGGGA

SEQ ID NO: 185132 - protein, 184 aa, Triticum aestivum
  Clone ID: PAT_TA_79550.pep
MDKHAAADAAAAAAAEDVETGEHERKGTVWTATAHIVTAVIGSGVLALAWSVAQLGWVAGPLALVGFACVTYYTSTLLANAYRAPDPVTGARNHTYTDAVRSYLSPREVFMCGIAQYGNLWGTMVGYTITATISMVAIRRSDCVHENGQGARCDAPGTVLMLAFTVVQVVLSQFPGLEHITWLS

SEQ ID NO: 185133 - protein, 66 aa, Triticum aestivum
  unsure (1)..(66): unsure at all Xaa locations
  Clone ID: PAT_TA_79551.pep
MEHPMQRSDEGGLRGSSMRADMDELDLMEEFLLASPGPDFPEFLHPGGASPSXFSPLFDLGSTITT

SEQ ID NO: 185134 - protein, 141 aa, Triticum aestivum
  unsure (1)..(141): unsure at all Xaa locations
  Clone ID: PAT_TA_79552.pep
MATRCGGAGGGGVVGAVASVLVLWLAAGGAAGLVATDPGAEERARDRVEALPGQPAVAFAQYSGYVTVSERHGRALFYWLTEAAGGDPARKPLVLWLNGGPGCSSVAYGASEEIGXFRIKPHGTGLYLNKYSWNREANLLF

SEQ ID NO: 185135 - protein, 92 aa, Triticum aestivum
  Clone ID: PAT_TA_79553.pep
GRPTRPRSVIPLFDPHVPLSMLHVEMPQCHYSDHPEGMPPLYYSDHPEGCLEAVSPLCHSDDHQREPQWTETYYMRGRSFDRILVLDRERPL

SEQ ID NO: 185136 - protein, 94 aa, Triticum aestivum
  Clone ID: PAT_TA_79554.pep
LLNQHCGCQVLPASRTVQQEMPHLELHILVPAEDTHRALLYIDVPDRDSFLQFFSHTPSKIIPLGISFEYESNGIFLGVHNSYFTGQIYGQSKF

SEQ ID NO: 185137 - protein, 153 aa, Triticum aestivum
  unsure (1)..(153): unsure at all Xaa locations
  Clone ID: PAT_TA_79555.pep
GEAAAPSGSTSSSTKHTPRIAIQKVIEVVAGLSDYKRFLVEEIGFEGVLRIPMIQKINLKFSKFLMTKVDVEEHCIILXDGGTPIPFYPEDFHKVFGIPCGQRDIHGKDADTTPEAIEVIRNSIGWTDKSDRSLSSLEVFIGKEINELSQPIG

SEQ ID NO: 185138 - protein, 81 aa, Triticum aestivum
  Clone ID: PAT_TA_79556.pep
VYITSIILYCILSSSTQNFFTMSLCCAIITTGVLVTMDDDIEREGHLCVPIIKVIWVPPKVYSLIYSQKRNSFLKPFFFYF

SEQ ID NO: 185139 - protein, 112 aa, Triticum aestivum
  Clone ID: PAT_TA_79557.pep
PVRNSRVDPASEQELAIQKVNTEAPINKMQATLGILIDSDDDGDYEGADSDWSASCVILKLEAGCPGDEVVAEEATSEGEGEALEILRRARKRRRREANANANATVLVQDQR

SEQ ID NO: 185140 - protein, 223 aa, Triticum aestivum
  Clone ID: PAT_TA_79558.pep
TGPEFPGRPTRPDESYKRWVLRSASKKWKDFKVVLKRKYYKADLSRARNILNGCDNRIPIGQWEWLVKHWRTEKAKEKSERNKATRASQLEGCKGTHTAGSRSFAVVLDQMEMVEGREIGRAELYVVTHTKNNGYPVNQQSGVKMDDIKKRIREDPSLIGEEARDGDLYSSIFPKEKKGRPSGLGLLVGGVASERLAQVEAELHAAKQENMELRHVVHTLVAN

SEQ ID NO: 185141 - protein, 197 aa, Triticum aestivum
  Clone ID: PAT_TA_79559.pep
GPDSRVDPASDETTEDIQFRDAEMDEAMDTMQSNPETTEDIQFRDAEMDTMQSNLETTEDIQFRDAEMDAEGFQGEHVHDSPIVAFKEAMQLVRVKLEHVQGKLVTAQDAVQYFKLLEMASTKAEELSSSIQLCCLDVQKEQEDINALKSALSASHERENALEGKIFSPAASCWDLHLKTEALASSQATQLSHLFIH

SEQ ID NO: 185142 - protein, 49 aa, Triticum aestivum
  Clone ID: PAT_TA_79560.pep
MCSILQCKPYINSEVKIHYTQSKKYCVKHTTFTVLKHTNYSVNLRYITV

SEQ ID NO: 185143 - protein, 212 aa, Triticum aestivum
  Clone ID: PAT_TA_79561.pep
MAALHRLLLLLLPLVGLLVLHPLPIVASDDSSYLLAAKAVLSDPAGALSIWEAGSSHSLCAWPHVLCAGKSTAVAGLYLGKLSLAGGFPASFCSLRSLQHLDLSQNDLVGPLPACLAALPALLNLTLAGNGFSGEVPPAYGYGFRSLVVLNLVQNSISGEFPWFLANISTLQELLLAYNAFTPSPLREKLGDLADLRELFLANCSLSGEIPS

SEQ ID NO: 185144 - protein, 53 aa, Triticum aestivum
  Clone ID: PAT_TA_79562.pep
WRSTDNLYNKGNCLHYFIFSLYVDPWKSNMEFEMVCTSSILQLMRMLIWSCGY

SEQ ID NO: 185145 - protein, 130 aa, Triticum aestivum
  Clone ID: PAT_TA_79563.pep
MRRVQIIYYLCRSGQLEHPHFMELAQFPHQPLRLKDVMDKLTLLRGKGMPALFSWSCKRNYKNGYVWNDLSESDVIYPSDGVEYVLKGSEIFPGCSSAVAGERFQHLRVTDRSPTKPPLALPHNHPHPAA

SEQ ID NO: 185146 - protein, 83 aa, Triticum aestivum
  Clone ID: PAT_TA_79564.pep
FFFFFFAGRQGDRRGRHCSAGDADDCGEEEEAGVSGEEEAGVSGEEGCEHARWGRAGGEGKGLARVLCSVGADAWVDPEIPDR

SEQ ID NO: 185147 - protein, 131 aa, Triticum aestivum
  Clone ID: PAT_TA_79565.pep
MGTVTPADPHPAFLADKGARVFVAGHRGLVGSAILRRLLALGFTDVVVRTHAELDLTRQAAVEAFFAAERPRYVVLAAAKVGGIHANSTFPADFIAANLQIQTNVVDAALRCGSDRKLLFLGSSCIYPKLA

SEQ ID NO: 185148 - protein, 112 aa, Triticum aestivum
  Clone ID: PAT_TA_79566.pep
PVRNSRVDPRVRLLLADFSLVLLTSLQLYSYSMVDILLVLFVLPLGILAPFPAGINALFSHGPRRSAGLARVYALWNITSLVNVVVAFVCGLVHYKSSTKRHPSMQPWNLGG

SEQ ID NO: 185149 - protein, 155 aa, Triticum aestivum
  Clone ID: PAT_TA_79567.pep
GSTHASDWGSLVDVVGYCFLNLGTKYQPPPELSQWLQQGSKPIYIGFGSMPLDDEKKVTAIILDALREMGQRGIISRGWGDLGSFSEVPADVFILEDCPHDWLFPRCTAVVHHGGAGTTAAGLIAGCPTTVVPFFGDQLFWGEIDHARGVGPAPI

SEQ ID NO: 185150 - protein, 125 aa, Triticum aestivum
  Clone ID: PAT_TA_79568.pep
NNVSLCRAKNQSHLEIDRSTLNSWGLLSLSIGIPWPGQPLVRLTGRHHQPPPRSPPLGHQRRPPRVGHQRRPPRVGHQRRPPGRAPPPRRPRPAMAWPLRSPPPPGSPRCPPRRAWPGRLPRGSA

SEQ ID NO: 185151 - protein, 120 aa, Triticum aestivum
  unsure (1)..(120): unsure at all Xaa locations
  Clone ID: PAT_TA_79569.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGIXLKLLDSHLVPSAT

SEQ ID NO: 185152 - protein, 189 aa, Triticum aestivum
  Clone ID: PAT_TA_79570.pep
ARRILLPRRLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKSITLEVESSDTIDNV

SEQ ID NO: 185153 - protein, 76 aa, Triticum aestivum
  Clone ID: PAT_TA_79571.pep
PRVRTGSPAASVNRKQHSSPRADYIYSPPPASPPKPRAYVRTSCADRTMHRQMAVAAWALLLLLSEAASRSAGQAL

SEQ ID NO: 185154 - protein, 129 aa, Triticum aestivum
  Clone ID: PAT_TA_79572.pep
WLSPTMSTPRISPHSGASSPPARFSPLSLYHSPKTHTRSRVSSSDIAFIVGASLASSSGSSPSSVAPPDALSPPNGPPRAGRRGGTPLMGSTDAVHPAAIGPRRGLAPRLVLVDDGCGEYRCCSSSANS

SEQ ID NO: 185155 - protein, 85 aa, Triticum aestivum
  Clone ID: PAT_TA_79573.pep
PVRNFRVDPRVRVKVTDVSLLLVSSINTLIACVQSSTPAYLGFLSFCFNKKRLDHGCAILVPRCASSWIFFFNHCTSDQIQKKKK

SEQ ID NO: 185156 - protein, 113 aa, Triticum aestivum
  Clone ID: PAT_TA_79574.pep
PVRNPGSTHASGALASFLVKASKEDSAVSVESSFVVQVINACISLGLLEQAHDLLDEMRFSGVRVGSSIYSSLLKAYCKEENHEDDITALLKDAQQAGIQLDSSCYEDLIQSR

SEQ ID NO: 185157 - protein, 74 aa, Triticum aestivum
  Clone ID: PAT_TA_79575.pep
CIQKIYGEDGSGHETPYAQVLLMPQTAQYPAGRQTHISHESLWLEISKGSLNRCIICLNPSITGVHISVASHTY

SEQ ID NO: 185158 - protein, 73 aa, Triticum aestivum
  Clone ID: PAT_TA_79576.pep
TGPEFPGRPTRPCRHTHAELYVVISFDVVFHLPHLFMYLLKDGKIAGFYNVYVYINTTCLCLYKPFLTKKKKK

SEQ ID NO: 185159 - protein, 180 aa, Triticum aestivum
  Clone ID: PAT_TA_79577.pep
NTMSDTTTHTCYIDSLDSLQEAERFFNKNHKKYGEVVFSITGCDQLVAAPMLLAAVNRAKKKANSDKLSIEGLPLLQELKERAEELERKLRVLEAIADTEHNDEDNHFIGDPDTHTTSYHHTTNMQSLLSSVQTMDINAFHELDKDVDGNIRRFEHHRAMFEDTRMEAKEKWIPSVENEL

SEQ ID NO: 185160 - protein, 144 aa, Triticum aestivum
  Clone ID: PAT_TA_79578.pep
MPISLPARSLPPSFPHALAAAGSRSPRPSSPRLPLLSSDSSQGRSPNALSPPSRQRRPSLPRRAPASRSHSCVAGSRPMLPWIPQNQAAAPHHLVDSARATASPPRPELQVHRPPLPLPTSAAPSPSSREAVPPRAPMVLHSSS

SEQ ID NO: 185161 - protein, 65 aa, Triticum aestivum
  Clone ID: PAT_TA_79579.pep
FLGLKTYYHHFGVVNEQFQLFIKIHSANLTFKIVLLYIESGDNWYSTLEAKYYSLRSKISVAVLN

SEQ ID NO: 185162 - protein, 192 aa, Triticum aestivum
  Clone ID: PAT_TA_79580.pep
MAMAAAGRCLLLSRPSPLRLRVLRAALSTAVPPSSPALAAPAPPPRHELLLERLRLRHLKDSSSPGPPKPLRERARSGERGSPQQQQRSVEVESFEELGLEEEVLAAMREAGITKPTEIQCVGVPAVLSGTSVVLGSHTGSGKTLAYLLPLVQLLRHDEVTLGMSMKPRRPRAVVLCPTRELTEQVFRVAKS

SEQ ID NO: 185163 - protein, 215 aa, Triticum aestivum
  Clone ID: PAT_TA_79581.pep
GPEFRVDPRVRGSVVPPEGDADSPYSSKATTTEEEGSAGGGGEANSASSAAATPRRPSPAAAAGPSPRDTRWGDTSSYGAKKKNRVFCQLPNGDWALCTVITTSGDESVLKVPEGKVLRLKTESLQPANPEILDGVDDLMQLSYLSEPSVLYNLQYRYSQDMIYTKAGPVLVAVNPFKKVALYGNEYIKAYRNKTMDSPHVYAIADSALREMKRD

SEQ ID NO: 185164 - protein, 138 aa, Triticum aestivum
  unsure (1)..(138): unsure at all Xaa locations
  Clone ID: PAT_TA_79582.pep
GRPTRPGDSWSCKLEIKWHGAKSLMLYVSLGYSLDSCVVMHLHWSLENSQGKRHDYXRLNGHRSLQDEGEMPMIGGHQVLGPFRRGTRVLSRIRSSSGDDKKDSLAMNESNMVIVSARNCTEVPLRLHSIAIESDGDG

SEQ ID NO: 185165 - protein, 174 aa, Triticum aestivum
  Clone ID: PAT_TA_79583.pep
MWWPHGDHMDKRIRCSATVLCAKAQCDQLDCHGDGGPFRVALVGTDYRNLRSHATVYSSETREWRDTISVHNLDFVNGRGNSAVVGNKVYVQCVESDKVVEYNTHEQKLSLITLPFEDQEGIDESIDLMGVDDGSLLFASVLKAKLCLWTMEAGPGGAAGWARRWAIELKHRSL

SEQ ID NO: 185166 - protein, 183 aa, Triticum aestivum
  Clone ID: PAT_TA_79584.pep
ASGNFQVYTACGRGSRSTLRILRPGLAISEMARSMLPAEPIAVWTVKKNINDMFDAYIVVSFANVTLVLSIGETIEEVSDSQFLDTTHSLAVSLLGEDSLMQVHPNGIRHIREDGRVNEWRTPGKKTITKVGSNRLQVVIALSGGELIYFEMDMTGQLMEVEKQDMSGDVACLDIAPDPEGRQ

SEQ ID NO: 185167 - protein, 246 aa, Triticum aestivum
  Clone ID: PAT_TA_79585.pep
TGPEFRVDHASAHFSGTAGLALESELLGFMNELEGQWGSRRRRRKFVEAAIFGDHLPRGWKLILGIKRKERAAWINCRRYVSPRGHQFATCREVSSYFMSLLGYVEAKPTTVQNNDVEVRDMSAVNTAGLHQQNDSTGDMQSAVSATSVTLPIHNGDSQGQRQKPYKDEAPIEAVRKECKKCNLTFEDQGAYVQHQLSFHQRKAKRRKVDKSVGLGVGKDGKLETQESQRTSEDKPGYFWHGVADV

SEQ ID NO: 185168 - protein, 57 aa, Triticum aestivum
  Clone ID: PAT_TA_79586.pep
FLFGRGGSGEAPVVPDAGEVGRGAEQRDGQELGQRRAPGGRREVQLRAHRHHRLPPA

SEQ ID NO: 185169 - protein, 83 aa, Triticum aestivum
  Clone ID: PAT_TA_79587.pep
AGSAGLPIMSKQIAFQAFLVSDTLAMCSSFVVAFICLIIPKCDGDACGCCLLPWRHPCVQCTGAPPLPYGPSCVFVVFWAVIQ

SEQ ID NO: 185170 - protein, 222 aa, Triticum aestivum
  unsure (1)..(222): unsure at all Xaa locations
  Clone ID: PAT_TA_79588.pep
ASERNPGSVESVPICTSSPGLSPSTTPPLPPAERASERTGGRGGHGGRRGGEAREGGAXGGHLCHVCGHQYPNPNPSAKLRRSHRRNSCRKVTPAAEEEDAGPRNAGEGRLVLGAAGGPGDGEEPGNGAASGGSASPGSANGGVESAEDKENAEHASTNAARPQAITSDYIETGLIPNNSSETADEGNGTDSERPSTNGIPHKASESFTGIGPLAAAHPTER

SEQ ID NO: 185171 - protein, 138 aa, Triticum aestivum
  Clone ID: PAT_TA_79589.pep
RPTRPPLFILNAAYDSWQVRNILVPGGSDPRWRSCKHDIKQCSAKQLKILQGFRDHFLEAIEAQGDSPTRGLFINSCFAHCQSEIQEIWFAPGSPVLGDKRIASAVGDWFYGRSWFQKTDCPYPCDSTCHVFKNSSHT

SEQ ID NO: 185172 - protein, 234 aa, Triticum aestivum
  Clone ID: PAT_TA_79590.pep
MFLNKHNDRVLNPDRTTFISRLAQLLASVPDKARMGASSALTASSFFKSVVSQLLVRAEEAAIESSANKEFNEQDALSSVLLFVGEVLSRVSRRGSTGILVAELIPMIRNHLQRCVAPDCKTIIPDMIKHVPQSRFWFNVVEALRDQHSIERLTEEMLRQLASHHLNDEEAYWILWTLFNQSIMHIAVMRAMFIDKFLLWKTFPLCCLRWILHYAVFEFPPNSVAEAQMRKPSN

SEQ ID NO: 185173 - protein, 109 aa, Triticum aestivum
  Clone ID: PAT_TA_79591.pep
AAHPRHRQMGPPRLKRRRRRWVQTRTVKNDHPTRESPWQPTIDCPCFHPPGQREAYTVSLLGWPARKAGPSVSRSSLITQRTEERAPRCLPRRWKVRCHWTAVQIERTG

SEQ ID NO: 185174 - protein, 56 aa, Triticum aestivum
  Clone ID: PAT_TA_79592.pep
SGRSRSRTSQMKELEGLCNPIIAKMYQGAGADMPGGMDEDAPAASGGAGPKIEEVD

SEQ ID NO: 185175 - protein, 124 aa, Triticum aestivum
  Clone ID: PAT_TA_79593.pep
TGPEFPGRPTRPQEFKDGYTKVLISTDVLARGFDQAQVNLVINYDMPIKYNTRDEPDYEVYLHRIGRAGRFGRKGAVFNLLCGQTDEAVMTKIEDYFQHKVPEVPNWKSEDNFETALKDAGLLE

SEQ ID NO: 185176 - protein, 100 aa, Triticum aestivum
  Clone ID: PAT_TA_79594.pep
LYGYICPANYIMQREPMSVPSAMSLSHPNLKLYMLFTVIITRAFIVNVFTGHDLPYLGRRRGAESHGAKNAFERFSYDGVYGLMKKYTGPPCFFFRIVVP

SEQ ID NO: 185177 - protein, 211 aa, Triticum aestivum
  Clone ID: PAT_TA_79595.pep
PVRNFRVDPRVRNLNHGQQHGEGSSITSFQALTDLLRSLLYCNDDGRIIVARHKPGGQPEDAYIKFVMLCAEKTFSEVTDDAHVVIMAGGTLQPIEETRLRLFPGLLPSDIKFFSCNHIVPPESILPIAVTCGPSGKKFDFSHSSRSSLNMIEELGRFLCNIVTIVPEGIVMFFSSYEYEKQVYDAWMASGTISKISKKKHVFTEPRSSVD

SEQ ID NO: 185178 - protein, 131 aa, Triticum aestivum
  Clone ID: PAT_TA_79596.pep
YHYFHYRRHENVYFLYIAPDPNRPVCTLRRYNRRNDARGPNTCGMYEMNPAFAPCPKYSLACSSSLPCRPPVGTRYSGAPHNLLHAPHTSLLHRYLNRATLTWQPFIPPWGQMPRIILYQHFDKTCIKLAY

SEQ ID NO: 185179 - protein, 147 aa, Triticum aestivum
  Clone ID: PAT_TA_79597.pep
PVRNFRVDPRVRVQLLHERENRMNFSVVSHRLESEQSSADLERTTNSSSAGTFLHGEAIKVSDVDAAGPPLSLTELAETHRGCRNISVKDTMTMSTSPCALPDHTFRDSFGQHQSWFSTSGKFSSGPSHESNVSPSKELNFRSQLNV

SEQ ID NO: 185180 - protein, 217 aa, Triticum aestivum
  Clone ID: PAT_TA_79598.pep
PVRNFRVDPRVRQGSPPVNPPHPHRTVVQTQKPHAECSAASPAPPRAGSAAPSPRPRPPRGPRGPSSSSPTSTSRGRRRRARPCTSTRPRSSPASPSPPTSSTRAPSPTPPPACSAPSRATSPPSAATASSSCASGSPASSSTSPPPASRCSARSATCPSSPAWTSTRRSRASSATRSAASSTASRTSTAPRGPPCTSTSGSSLSPKAGTDRLTGMP

SEQ ID NO: 185181 - protein, 157 aa, Triticum aestivum
  Clone ID: PAT_TA_79599.pep
PVRIPGSTHASGKRANAMRRWAVSPSLPPAAFASATLGLGVGPPQARTLASAATPPPLGHCSPPCPRRPRRRRSLCSSSAAASAATTALAVEEARRGRKQLGMDPPLYDYLLSNVREHPVLRDLREETASMRGSQMHVSPAQAQLLAMLVQILGAER

SEQ ID NO: 185182 - protein, 74 aa, Triticum aestivum
  Clone ID: PAT_TA_79600.pep
TGPEFPGRPTRPRLSSSANNSDSENTNKMLPISSVNLSEDLNPFVDHKSVVDMDFDMTDSGEVDSITASCQHPI

SEQ ID NO: 185183 - protein, 104 aa, Triticum aestivum
  Clone ID: PAT_TA_79601.pep
PVPRIHHAPVLRVATQEDSAAYALAIMKHPDPIGEGLAMEAFAEAAGPECIVPGQQAPLRLMGLKVWPLDIDMKFLEPFGRELQSMKKFMDKSCSVMDSSMANK

SEQ ID NO: 185184 - protein, 54 aa, Triticum aestivum
  Clone ID: PAT_TA_79602.pep
TESPPSKLGDNAFIWSNHVRKQSSTLHQKSCCSASSHPHHICCNTTAGLHSTYL

SEQ ID NO: 185185 - protein, 153 aa, Triticum aestivum
  Clone ID: PAT_TA_79603.pep
MATRADVEKGGVVRKEPGKVPSPLYPQHEGEREWVPWIVPVFFVGNITVFVITMYVNNCPTHTTTPRDAKCVARFLGRFSFQPLRQNPLLGPSSATLTKMGALVWEKVVHHHQGWRLLSSMWLHAGVLHLVANMLCLLFVGMRLEQQFGYVRI

SEQ ID NO: 185186 - protein, 47 aa, Triticum aestivum
  Clone ID: PAT_TA_79604.pep
SSYVTASTTHCPLSTQREFVCNRTEGKKKEMASTVASLSIPATTTFA

SEQ ID NO: 185187 - protein, 53 aa, Triticum aestivum
  Clone ID: PAT_TA_79605.pep
FFFLDSKDSPPRHKAEFQDAPRHFNFSKFGYVCTHQGSEPSSLNILLTRQTEA

SEQ ID NO: 185188 - protein, 158 aa, Triticum aestivum
  unsure (1)..(158): unsure at all Xaa locations
  Clone ID: PAT_TA_79606.pep
IGYAMPFILXALICCCLPCIISLMGFREDLNENRGATSDAINALGTYKFKTKKPRNTEGNEGGGGVFAPGTDKERAVSAEDAVCCICLARYVDNDDLRLLPCGHFFHKDCVDKWLKINALCPLCKAEIDIVPTTAPPAIGFGRRHSDNRVGNDIESQR

SEQ ID NO: 185189 - protein, 190 aa, Triticum aestivum
  unsure (1)..(190): unsure at all Xaa locations
  Clone ID: PAT_TA_79607.pep
LFVAMVVVHPLVLLFDRYRRRVQHYIAKIWATLTISMFYKLXGRCFKFISKTSIFMFPIIGWAMYLLGVIPLRRMDSRSQLDCLKRCVDLVGKGASVFFFPEGTRSRDGKLGVFKRGAFSVAAKTGAPVIPITLIGTGKLMPSGMEGILNSGSVKVIIHRPIQGNDAETLCSKARNVIADTLVLHGYGVH

SEQ ID NO: 185190 - protein, 109 aa, Triticum aestivum
  Clone ID: PAT_TA_79608.pep
HSITRGPLLRPARRRLRRRPTRGNGCGECGHRSHREKVVITRLVSLWLCSSNRQCLVLTSWGLCFASDARDLHNTVLDMDALCSLAIERKFITLLQMVFLQSNAELSSF

SEQ ID NO: 185191 - protein, 254 aa, Triticum aestivum
  Clone ID: PAT_TA_79609.pep
EAGILMIIIMSFSFTLATHSFRRSVVKLPSPLHHLAGFNAFWYAHHLLVIAYILLVVHSYFIFLTREWYKKTTWMYLIVPVLFYACERIIRKFRENNYHAEIVRAAIYPGNVLSIHMKKPQGFKYKSGMYLFVKCPEVSPFEWHPFSITSAPGDDYLSVHIRTLGDWTSELRMLFGKACEAQVTSKKATLTRLETTVVADARTEDTRFPKVYIDGPYGAPAQNYRKYDILLLIGLGIGATPFISILKDMLNNLK

SEQ ID NO: 185192 - protein, 53 aa, Triticum aestivum
  Clone ID: PAT_TA_79610.pep
IYIALGRSTRSIVKHVLHISYNYKKNKSKTTICGVAPPTPDVRYPCLGGGRVK

SEQ ID NO: 185193 - protein, 109 aa, Triticum aestivum
  Clone ID: PAT_TA_79611.pep
MLPSYLYDFPFLGDDSTITVDDNCVDPLYKHIFPPEVAPHLSFIGLPWKIIPFPLFELQSKWVARVLSGRVKLPSKDKMMEDVKAFYSKLEALGWPKRYTHNFSNHQVA

SEQ ID NO: 185194 - protein, 122 aa, Triticum aestivum
  Clone ID: PAT_TA_79612.pep
MQDAATKILLQVNIDAYTEEYVHTINTRVHASSTTELPPHTTQLRRTREHMRTIRMCYIYIYIYIYASTDDDMAIESVGAAAAGEHPRGAREQPRRLLPPRPGPGPGRPPARAHHPPPQRAQ

SEQ ID NO: 185195 - protein, 211 aa, Triticum aestivum
  unsure (1)..(211): unsure at all Xaa locations
  Clone ID: PAT_TA_79613.pep
QKVPHVIFCAPPSSSDDYPGDVRKCVQXAASNWSGEGSFLFTSSTALYDCSDNSMCNEDCSSVPIGRSPRTDVLLKVENVVLEAGGCVLRLAGLYKIDRGAHVFWLRKGTLDTRPDHIINQIHYEDAASLAVAIMKKRLRSRIFLGCDNKPLSRQEIMDAVNKSGKFDTKFEGFTGTDGPLGKRMENSKTRAEIGWEPKYPSFTEFLGIRR

SEQ ID NO: 185196 - protein, 74 aa, Triticum aestivum
  Clone ID: PAT_TA_79614.pep
LLISSHFFPKGKKKPVQYRPCCEVQSARTSSSSSSEQSTPPVFTSTAPNSSNQGERKSKKKNQMNRQVLVLIES

SEQ ID NO: 185197 - protein, 78 aa, Triticum aestivum
  Clone ID: PAT_TA_79615.pep
FFFLSFGLSSQTCESFVWRLIAILHLDLALIAWEPGADYLTLASHVHTCKTPPWQKKCLFESSMLESEMFLRWNLGFR

SEQ ID NO: 185198 - protein, 96 aa, Triticum aestivum
  Clone ID: PAT_TA_79616.pep
QEEQRRRWRWQGRRRRQEAPLRQELMRMREGAGPCSPDLTIVGVLLLLMTSSSLFFLLLLFYCTCVGLPSLMDCFNCCLRSNPVSPTVGRTTHHYW

SEQ ID NO: 185199 - protein, 115 aa, Triticum aestivum; identical to SEQ ID NO: 178870
  Clone ID: PAT_TA_79617.pep

SEQ ID NO: 185200 - protein, 115 aa, Triticum aestivum
  Clone ID: PAT_TA_79618.pep
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVNKEHIKIHGF

SEQ ID NO: 185201 - protein, 204 aa, Triticum aestivum
  Clone ID: PAT_TA_79619.pep
PGFFNSVFPMLYEVSSQSVISKTKNSAGAELDESEGASISLDKVLNCATSCISVAFPQDIINQKKNVLELILNSLSPEESWQVKLSSFLCIKELCLKFHSSGDSNTWPQDTACLVQELFHLVSPKLVDSIRLVKIAQVHIAASECLLDLSKLYRDFPLLERTEAKFEDELTELCESEKSEQAKAILEECLAILKTLPGVTMTTD

SEQ ID NO: 185202 - protein, 68 aa, Triticum aestivum
  Clone ID: PAT_TA_79620.pep
MGLLDQLWDETVAGPRPDSGLGRLRKYSSFSPSSSSSSSAAFPPAPAPAAATSDAPAPAVTHKITIGR

SEQ ID NO: 185203 - protein, 146 aa, Triticum aestivum
  Clone ID: PAT_TA_79621.pep
MAEVELPQQEVKLFSRWSFEDVQVNDISLADYLAVNPTKHATYLPHTAGRYSAKRFRKAQCPIVERLTNSLMMHGRNNGKKIMAVRIVKHAMEIIHLLTDANPIQVIGDAIINSGPREDATRIGSAGAVRRQAVDISPLRRVNQGI

SEQ ID NO: 185204 - protein, 55 aa, Triticum aestivum
  Clone ID: PAT_TA_79622.pep
FISVTPLNVHGQVEPEMGAPASDWLSAAVSLDKEKDAAPAAAEQQDVAAEEKEAP

SEQ ID NO: 185205 - protein, 114 aa, Triticum aestivum
  Clone ID: PAT_TA_79623.pep
GFKEEETFMRLETAPSAEPEEEAIQEDGDQEGRKKKKKKKKNKETEETPAVEADGEKKKKKKSKEDGEPVAALEGEKKKKKKISDADGENVAMQTEASAKKDKKKKKKRHADDE

SEQ ID NO: 185206 - protein, 236 aa, Triticum aestivum
  Clone ID: PAT_TA_79624.pep
ARGLEFVGDTCKKLLRLRIERGDDDPGQEEQGGVSQIGLTAVAVGCRELEYIAAYVSDITNGALESIGTFCKNLYDFRLVLLDKQNKIADLPLDNGVRALLRNCTKLRRFAFYLRPGGLSDVGLGYIGLYSGNIQYMLLGNVGESDNGLIQFAMGCTNLRKLELRSCCFSERALAVAVLQMPLLRYIWVQGYRASQTGQDLMLMARPYWNIEFVPPGPESAYRVMADGQPCVDTHA

SEQ ID NO: 185207 - protein, 229 aa, Triticum aestivum
  Clone ID: PAT_TA_79625.pep
QPALYSKELLEQRAAGPAMMHPSEAVAKGPRWADLFEPGVKHALFVGIGIQILQQFAGINGVLYYTPQILEQAGVGVLLSNIGLSASSASILISALTTLLMLPSIGIAMRLMDMSGRRFLLLATIPILIVALAILVVVNIVDVGTMVHAALSTISVIVYFCFFVMGFGPIPNILCAEIFPTTVRGICIAICALTFWIGDIIVTYTLPVMLNAIGLAGVFGIYAVVCILA

SEQ ID NO: 185208 - protein, 93 aa, Triticum aestivum
  Clone ID: PAT_TA_79626.pep
QGVQESFYRDMAVMFGRWPEFEPTDLEKPPFPVHLFQGDEDGVVPVQLQRHICRKLGWVNYHELPGTGHFLSAVTGLGDRIVSTLLSSPPASA

SEQ ID NO: 185209 - protein, 50 aa, Triticum aestivum
  Clone ID: PAT_TA_79627.pep
NAANSCWLIPKVLPLLATYYLLQAGTEYINIYIRRQKSKSAITIVIRLGP

SEQ ID NO: 185210 - protein, 29 aa, Triticum aestivum
  Clone ID: PAT_TA_79628.pep
LVCLLTLFPNGGGTYSASFLGDPFFIGGI

SEQ ID NO: 185211 - protein, 153 aa, Triticum aestivum
  Clone ID: PAT_TA_79629.pep
MEQLFVDDPAFASSMSSLEADIFSGAGQLPSSPWLDLDLDDDVQDLSMAPTTANAVSSGYGSGGSGSHRKLSHNAYERDRRKQLNELYSSLRALLPDADHTKKLSIPTTVSRVLKYIPELQKQVENLERKKKELTTTSTTNCQPRVLGSQLMS

SEQ ID NO: 185212 - protein, 133 aa, Triticum aestivum
  Clone ID: PAT_TA_79630.pep
DNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSTVPEDSIS

SEQ ID NO: 185213 - protein, 71 aa, Triticum aestivum
  Clone ID: PAT_TA_79631.pep
FGHDTHLNLCQLPCTIAFYELTGSHTLTVTRCCTSPYCLGTLVCTNIKAVTCCTMQRQMQKHRLYRKKKKK

SEQ ID NO: 185214 - protein, 115 aa, Triticum aestivum
  Clone ID: PAT_TA_79632.pep
MEGKDGKHDVPATTAAPPPAGAPQPAAPAPPAESARWGTRQMGPPAAPGAHPENQEAARWTAARGDQELPPYVVMGEPVAVQRGKGDSPMEHILDFFNTWSRKAEELASNIWFNL

SEQ ID NO: 185215 - protein, 160 aa, Triticum aestivum
  Clone ID: PAT_TA_79633.pep
IPAAKRMSNVAVVVPKSGSSIWADLWVIPCATRFQTDQIGSRTRGPSPLIHQWFDFCLQSARSLPFCQDVIPGASPLYLENPVPEVPQDKNKRKPKLETNLVRGVPPPEILERCEFLEPLSGKALEDYQWLMSKVQRPRLGFFGNVLQKMSAVLDFKRRF

SEQ ID NO: 185216 - protein, 136 aa, Triticum aestivum
  Clone ID: PAT_TA_79634.pep
SEELSRTPSVLIPLQAPCSCSHQSYNDWFSDSWGHATPSPDRMLHHICSVYEQETEVITRLGLPDHRGDNQNLLQVHGAATIGGLVAHFKPQPEKDFQFEGCPAFPIELVTLYKSRIYIPDCDGKLLNATLYTLLD

SEQ ID NO: 185217 - protein, 78 aa, Triticum aestivum
  Clone ID: PAT_TA_79635.pep
WPLWYETITEDMHGYPCEPYYLHNTGNFEGDSDLDSEHRREVHKQYYDLQDGNNEMTSRLKKYVAGFSDDSDWEPYAP

SEQ ID NO: 185218 - protein, 113 aa, Triticum aestivum
  Clone ID: PAT_TA_79636.pep
SSMLSRVDPRLYCLSLVERESSAKRLLQVEFSGFGSNAGTILLLFHYARGRSTQIMVNEKLSTSTSTVVYLRRHQRVCYWEGLAKRCPLLFYNLIALISLFLVRIICWFLVLL

SEQ ID NO: 185219 - protein, 108 aa, Triticum aestivum
  Clone ID: PAT_TA_79637.pep
MAAAALRPLTAPNAALPPRGPGKEHRTAITVPEFKRWVKQFDTDHDGRISRKELREAIRRRGAWFSGLRALFAVRRADRNRNGFVDDSEIEGLIDFAERELGFRITTE

SEQ ID NO: 185220 - protein, 107 aa, Triticum aestivum
  Clone ID: PAT_TA_79638.pep
MWSFASNAIAGSLKKKGQPSKCSISNPDCSDDEVSSCTSREEGLDCPICWESFNLVENVPYVLWCGHTMCKNCILGLHWAVVKFPSLPIQLPLFISCPWCNLLSFRL

SEQ ID NO: 185221 - protein, 138 aa, Triticum aestivum
  Clone ID: PAT_TA_79639.pep
KWTLIEGLRRPRWGCFWCSFEGKLYVMGGRSSFTIGNSRFVDVYNPNNHAWDQVKNGCVMVTAHAVLGEKLFCIEWKNQRSLAIFNPADNSWQKVPVPLTGSSSTRFSFGVHEDKLLLFPLEEEPGYQTLMYDPAAPM

SEQ ID NO: 185222 - protein, 176 aa, Triticum aestivum
  Clone ID: PAT_TA_79640.pep
MGRGGIGGAVGMAMENADSARAFVKDVKRIIIKVGTAVVTGQNGRLAMGRLGSLCEQVKQLNFQGYEVILVTSGAVGVGRQRLQYRKLIHSSFADLQNPQMNFDGKACAAVGQSGLMAIYDTLFSQLDVTSSQLLVTDRDFKDPSFGDQLRETVFALLNLKVIPLFNENDAISTRR

SEQ ID NO: 185223 - protein, 71 aa, Triticum aestivum
  Clone ID: PAT_TA_79641.pep
CLLFRPCPVFEVSVWSVIEALVSLKYLYGSICMVCVVSEFVSWTGCVPLCSTLNYSAAAYGLILNKCDVGI

SEQ ID NO: 185224 - protein, 77 aa, Triticum aestivum
  Clone ID: PAT_TA_79642.pep
QFIFSRISYGESQMLDKAFYEEEVKRLCLSFEQQFHYAVFFAYIRLREQEIRNLMWISECVAQNQKSRVHDSVVFIF

SEQ ID NO: 185225 - protein, 127 aa, Triticum aestivum
  Clone ID: PAT_TA_79643.pep
MQTVRGVVLQHLRLRAAPAIAARGGSGRPALYGFARGMSAPAGQEDSKGSSSPDPERDIRTRVVNLVKKFDKIDADKVTETADFQKDLSLDSLDRVELVMAFEQEFSIEIPDDKADKLTCCADVAKY

SEQ ID NO: 185226 - protein, 135 aa, Triticum aestivum
  Clone ID: PAT_TA_79644.pep
NTISEFYDALVKLLDNNADASTKEIVEAMTRSLASVGSLPEEQIQDTTELATKMLLKSLQAGDIVFGKVSRAVYFAFRGVVLGGGAKGKKLAEAPLRRLGAAKLADRVVKAGEVLIKMAVISEKVHGQWYKALAL

SEQ ID NO: 185227 - protein, 56 aa, Triticum aestivum
  Clone ID: PAT_TA_79645.pep
METTSNQTREHLHWLQNCQDVKYCMLLQFLVRKLYCSTILNVTASAYRLQIRLRKT

SEQ ID NO: 185228 - protein, 65 aa, Triticum aestivum
  Clone ID: PAT_TA_79646.pep
INLGSIRRYIHNMSNIALGCSNFSTAQGKINATKEIALCIYEIGHVSLRFIVGQEVHKVNLEFII

SEQ ID NO: 185229 - protein, 177 aa, Triticum aestivum
  Clone ID: PAT_TA_79647.pep
MGIDLVAGGRNKKTKRTAPKSDDVYLKLLVKLYRFLVRRTKSNFNAVILKRLFMSKTNRPPLSMRRLVKFMEGKSDQIAVIVGTVTDDKRINEVPAMKVCALRFTETARARIINAGGECLTFDQLALRAPLGQNTVLLRGPKNAREAVKHFGPAPGVPHSHTKPYVRSKGRKFEKAR

SEQ ID NO: 185230 - protein, 93 aa, Triticum aestivum
  Clone ID: PAT_TA_79648.pep
IDDEVKVILIKSNVPDKIALSTADLESAPGLFLSDREKVFSEAEEMAKRYREQLPVMSQNPILDDGIPGEMLPFDDEAKLYANWQWFKFLHHN

SEQ ID NO: 185231 - protein, 70 aa, Triticum aestivum
  Clone ID: PAT_TA_79649.pep
ETNFRHHFSIFMQCNNFFPFFNLKFHLAKISFLGRNLISSFACNAWKECFFFIFDCNLSSEECMAITVVR

SEQ ID NO: 185232 - protein, 145 aa, Triticum aestivum
  Clone ID: PAT_TA_79650.pep
FTLQLFCFCFFLFLLLLVILREKLISRVFIYYQFLIEERWRERRTASTSSSPSSSRPSASSSSSDAGMSSGSACCSPSSATSPASSTPSTPSPSNSSLVTTSSTKSSRDGLQTASSIFSIAVCLLEFGNDICIQNSVLSAPILVI

SEQ ID NO: 185233 - protein, 238 aa, Triticum aestivum
  Clone ID: PAT_TA_79651.pep
KVEERDQVYQPTEEEIRRWLDPYENVVCIECNQGGDDSLMLLCDICDSSAHTYCVGLGREVPEGNWYCGGCRLGDEGPSYTGIQRTVAYERQTYRNHVDSSSVSFGMLASSGTFERPPSINPRHSFQGIDLNLSPREFPGESHPAESQVSTDSVSTPTGRRTVSARRQIHRYIRILLARPRQPSRPDVFHNIAQHSGGVPRTEPNRQNFPSSSEANTSHNLPDGIQNHHGSLPFVQAQ

SEQ ID NO: 185234 - protein, 56 aa, Triticum aestivum
  Clone ID: PAT_TA_79652.pep
FLWRTVFCYKQIFLSGGSTHHDFNALSKDVLNFIASYPSVETMIIKASQSTIVSAL

SEQ ID NO: 185235 - protein, 67 aa, Triticum aestivum
  Clone ID: PAT_TA_79653.pep
LRNYRVQRAYKLTTKVTYISFSQLRHEANKTRQRHPQFFNDLHALISVPWISRWALHLGSQDEPHVP

SEQ ID NO: 185236 - protein, 68 aa, Triticum aestivum
  unsure (1)..(68): unsure at all Xaa locations
  Clone ID: PAT_TA_79654.pep
CFFSPKLTQLLGNFLGNLQKLAGSXXINXKATNKGLGXLSPPPRKFXXNLPNXMVXELMLYPKLGEXK

SEQ ID NO: 185237 - protein, 156 aa, Triticum aestivum
  unsure (1)..(156): unsure at all Xaa locations
  Clone ID: PAT_TA_79655.pep
MERVLAVLFLLAAHAASAAAGVTSPYRRSLQMLPDMPLDADVFRPPPGDNAPEQVHITQGDLTGRAMTISWVTPEHPGSNVVRYGLAADNLNLTAEGTVQRYTWXRHLTVPLHPTTPSSTXSTKPTSXXKPSASXXNVXSFSFKTPPKPGPEAAXK

SEQ ID NO: 185238 - protein, 131 aa, Triticum aestivum
  unsure (1)..(131): unsure at all Xaa locations
  Clone ID: PAT_TA_79656.pep
MAPPSLAPAAALFLAALLLLSASPASAARPRSSSKAAAGPHDIPAVFAFGDSTLDPGNNNRLPTVVRADHAPXGRAFPAGXPPSGRFSDXKLIXDYIVPALGIKELXPPTPGVHAKATNGGKLRVVGSQRH

SEQ ID NO: 185239 - protein, 133 aa, Triticum aestivum
  unsure (1)..(133): unsure at all Xaa locations
  Clone ID: PAT_TA_79657.pep
MAAKEPMRVLVTGAAGQIGYALVPMIARGVMLGADQPVILHMLDIEFAAEALKGVKMELIDAAFPLLKGXVVATTDVVEACTGVNVAVMVGGFPXKERMERKXDVMXKNXSIQQKLKHPAPESSMPPNRVWLV

SEQ ID NO: 185240 - protein, 102 aa, Triticum aestivum
  Clone ID: PAT_TA_79658.pep
AALSPFPIPPTLPLFRSLAPGLPPSLFTPTSPPLLPLRVSKKGTTRRERRERSWGWSRIDPVRLQEAAARAQELRIGAQEVHVADFFYLDILQEQASSALPP

SEQ ID NO: 185241 - protein, 126 aa, Triticum aestivum
  unsure (1)..(126): unsure at all Xaa locations
  Clone ID: PAT_TA_79659.pep
GPAIPLAYAAAGFSALLSSFCYAELATEIPSAGGSFSYLRVELGDMAAFLAAGNILLEAVVGXAGLGRSWTSYLAALFGLETDALRIXVPALAEGFNLLDXXAVVVLNLLRPQFRGAAQLQQIWGP

SEQ ID NO: 185242 - protein, 76 aa, Triticum aestivum
  unsure (1)..(76): unsure at all Xaa locations
  Clone ID: PAT_TA_79660.pep
LQPVKXEXELNKDKGKPTIXISLAWTSFMLMVPGAVSPPVPTGDDGATHDMLLRYPAQGSLPRRALCPGHGRSWTH

SEQ ID NO: 185243 - protein, 82 aa, Triticum aestivum
  unsure (1)..(82): unsure at all Xaa locations
  Clone ID: PAT_TA_79661.pep
EGVNHLSLPTPLYYRISGQQLARLGMMKKQLGCLXVXXHFAXGGFNLPICFPGXTXVESKALXWXKRILWPXNFRPPNGFRV

SEQ ID NO: 185244 - protein, 90 aa, Triticum aestivum
  unsure (1)..(90): unsure at all Xaa locations
  Clone ID: PAT_TA_79662.pep
DGTNKSQANLVSDRPEARRILLPQRLKMQIFVKTLTGKTITLEVESSDXIXNVKGKIQDKXGIPPEQQXLIXRXKQLXXXRXLGGLKNPK

SEQ ID NO: 185245 - protein, 83 aa, Triticum aestivum
  unsure (1)..(83): unsure at all Xaa locations
  Clone ID: PAT_TA_79663.pep
LXAXRXGXPGXXTXXXXGXRPPGXSAXRRXSCSXPWLLPXSPRGYXTVARGLRKRNKQQAARRSRRRGRGXPARRGLFRWWER

SEQ ID NO: 185246 - protein, 89 aa, Triticum aestivum
  unsure (1)..(89): unsure at all Xaa locations
  Clone ID: PAT_TA_79664.pep
LLTVLLYPLHLMVVFFFXIEAGALELALIFHLLQIYWNITSLFLHFYADTAFQHIFLKSPFRIPSYRIIMAFTKLVKRIAFLAEYWCSG

SEQ ID NO: 185247 - protein, 107 aa, Triticum aestivum
  unsure (1)..(107): unsure at all Xaa locations
  Clone ID: PAT_TA_79665.pep
MGKEKTHINIVVIGHVDSGKSTTTGHLIYKLGGIDKRVIERFEKEAAEMNKRSFKYAWVLDKLKAERERGITIDIALWKXFETTKYYCTVIGRPWVNVDFIKNMITG

SEQ ID NO: 185248 - protein, 132 aa, Triticum aestivum
  unsure (1)..(132): unsure at all Xaa locations
  Clone ID: PAT_TA_79666.pep
XGKXVXXXRENWAXWXXSQKXGPAASPESAXLWGXSKECLLLFLFLAFNGPNGPLCHSSGICLCRRRSCGHGRSRIHLRGHRPTSTAPQAVVPPARGRAVVASGLLLPGLPLLREKQAFVVRPFNLSIDSCG

SEQ ID NO: 185249 - protein, 84 aa, Triticum aestivum
  unsure (1)..(84): unsure at all Xaa locations
  Clone ID: PAT_TA_79667.pep
LIWQRYTYRRNYWIRLTLIIGELISRNAKKNLFKGPRVLVSPRXPEISGPALLXLGQKDXXMFXXGQPPXVGGGGPXPNQKHWF

SEQ ID NO: 185250 - protein, 135 aa, Triticum aestivum
  unsure (1)..(135): unsure at all Xaa locations
  Clone ID: PAT_TA_79668.pep
MYQAIPYSAGRLPAWPRQFEPAEVDGAAGLESRRAGDGGEAVRRAVAESPVLVMGRRGCCLSHVVTRLLXGLGGEPRKCTSPDEARAPPGLPGGEGRRPRQPVFRWGKAGGLRGSAVAKSRRSSAQSGTPRRPGL

SEQ ID NO: 185251 - protein, 60 aa, Triticum aestivum
  unsure (1)..(60): unsure at all Xaa locations
  Clone ID: PAT_TA_79669.pep
KILNHXTTFANNXKLKPNSLICRDLHYKGHKFFFPKPRVVLLLCRLKPMSLQLLITGKLE

SEQ ID NO: 185252 - protein, 126 aa, Triticum aestivum
  unsure (1)..(126): unsure at all Xaa locations
  Clone ID: PAT_TA_79670.pep
FFFXEKXFLPVLXVPLTKFFKDXQLNYLIXLSLLLNWKQFAALTLLTFPPIQRTNGLIFYTFNSLCGLVESKGMVDMSNDRHVIDNFLSIIPQNSSVLNLAVLTAFECHTRNTLPALLQFLPSNSF

SEQ ID NO: 185253 - protein, 115 aa, Triticum aestivum
  unsure (1)..(115): unsure at all Xaa locations
  Clone ID: PAT_TA_79671.pep
MSGRGKGXKGLGKGGAKRHRKVLRDNIQGITKPAIRRLARRGGVKRISGLIYEXTRGVLKIFLXENVIRERRYXTEHARXKTVXTAMGRXSNPLKRQGRNLLVPSKPPTRQPFPK

SEQ ID NO: 185254 - protein, 134 aa, Triticum aestivum
  unsure (1)..(134): unsure at all Xaa locations
  Clone ID: PAT_TA_79672.pep
ERSDARPLLAASSHRPAAQQQRCCXRRPLSLLARADCTLLPARGRALCRAGARLLLTCINKRCDEVLXGRRGAXTXHAXAVLVLAPGAAVEPSXPGVPFWWLLXGLATGSNPSPXXRWLXIXGSNXEQSPGGSF

SEQ ID NO: 185255 - protein, 142 aa, Triticum aestivum
  unsure (1)..(142): unsure at all Xaa locations
  Clone ID: PAT_TA_79673.pep
MQIFVKTLTGKTITLEVESSDTIDNVKAKIQDKEGIPPDQQRLIFAGKQLEDGRTLXDYNIQXKESTLHLVLRLRGGIIEXPSLQALARXXYTKEKMICRQSATPRLASKGAVNWPAKKEVLANSNQEGPRKELADCSAFLG

SEQ ID NO: 185256 - protein, 144 aa, Triticum aestivum
  unsure (1)..(144): unsure at all Xaa locations
  Clone ID: PAT_TA_79674.pep
ETNGGGNTRDKDERGGGDGEADGGRREAPTKRATHHHHHHFPLSLQLRSYACSRGPPVPLGLINPVIPARGCGPSVRRALPSVGWLVRAAVPPXPAPPPPPPSSSXANXXWSQSXNLXXPXXAFSPPXPXPQXXPXPXRPXGXQ

SEQ ID NO: 185257 - protein, 139 aa, Triticum aestivum
  unsure (1)..(139): unsure at all Xaa locations
  Clone ID: PAT_TA_79675.pep
MAAQGLLSGRQLLGRPLQSSISRSSSSRKSAFVVRASSSPPAKQNDNRQLWFASKQXSLTYLDGTLPGDFGFDPLGLSDPEGTGGFIEPKWLXAYXEIFNGRTAMMGVVGMIAPEALGXXGLVPPENGRIPWFXSRFPP

SEQ ID NO: 185258 - protein, 125 aa, Triticum aestivum
  unsure (1)..(125): unsure at all Xaa locations
  Clone ID: PAT_TA_79676.pep
MAPLGDGVAPVAAAAAPGLVVSFGEMLIDFVPNVAGVSLAESGGFVKAPGGAPVNVACAVSKLGGSSAFVGKFGDDEVRPHAGWTSSKQNGVEXEGCLFERSXXRNALGPSVNLKXNXGNVKSMF

SEQ ID NO: 185259 - protein, 120 aa, Triticum aestivum
  unsure (1)..(120): unsure at all Xaa locations
  Clone ID: PAT_TA_79677.pep
TEEEELVAKTTTAFGRYXLGKELGRGEFGVTRRCKDAATGEALACKTIRRHRRRGGRGANRKAAGGGAEAAARAAAAAAHAGRRAEGGGHHTHVCPRWHGRCCGCRPRTKECSVHLVMLC

SEQ ID NO: 185260 - protein, 132 aa, Triticum aestivum
  unsure (1)..(132): unsure at all Xaa locations
  Clone ID: PAT_TA_79678.pep
MEKISVAVRFRPPKSSVDADADSPSFSGGGAVGNREWRIDDSGISLLHRAVPVPGTSFVFDHVFNESVTNARIYGLLVRSLIXVAVDGFNXTAFAXGXPTVXKTFNMNXSGAEPGXIPLRCSRTFDTGRRLQ

SEQ ID NO: 185261 - protein, 73 aa, Triticum aestivum
  unsure (1)..(73): unsure at all Xaa locations
  Clone ID: PAT_TA_79679.pep
XFXFXFXFHKINKISFPIISLLFNRWLQNCQSLYYPLTTRFTANLIHPLATCCSPPPNKTLRNQSQTKNLATS

SEQ ID NO: 185262 - protein, 129 aa, Triticum aestivum
  unsure (1)..(129): unsure at all Xaa locations
  Clone ID: PAT_TA_79680.pep
MAASMITSPIVAPTSVPSLSRRGSSFAVVCSGGKKIKVDKPLGLGGGLTVDIDANGRKVGKKGVYQXFVDKYGANVDGYKPXITRQEEWSESGDRYAGGTTGLLIWAVNLAGLLGGGVLLVYNNXALAG

SEQ ID NO: 185263 - protein, 79 aa, Triticum aestivum
  Clone ID: PAT_TA_79681.pep
MQVTSRKDQRQYWIHSDETYRYVAVKNFAEAFQSFHVGQAIRSELSVPFDKSRSHPAAQINIEHLLLVLDKQPPNPKHL

SEQ ID NO: 185264 - protein, 140 aa, Triticum aestivum
  unsure (1)..(140): unsure at all Xaa locations
  Clone ID: PAT_TA_79682.pep
MAPAEKKPAAXXPAEEEPAAEKAAEKAPAAKKPXAEKRLPAGKTASKEAGGEAKTXGRKKGNKAKKNVETXKXYIFKVLKXVQPDIGISSKGMSIKNSXIKEIFQKLPPKAPNSPRXKRKPTSTSRENXNFVRXLLPGXV

SEQ ID NO: 185265 - protein, 84 aa, Triticum aestivum
  unsure (1)..(84): unsure at all Xaa locations
  Clone ID: PAT_TA_79683.pep
IFLLLVYHSIFYFGLELICFLESFDREVLESTPTNHNEPNFLENLQFLIEMLPARLPFKSSVVLDXQXSPXXQXSSQRETAWAK

SEQ ID NO: 185266 - protein, 167 aa, Triticum aestivum
  unsure (1)..(167): unsure at all Xaa locations
  Clone ID: PAT_TA_79684.pep
DXTQSSPPPSSTSTFDPSNETMAIETEPAAPPRLLGPPVVRGVRPPADSAADPASHPFLDLLDAAFNAPSDAEIKAALTPAXRAQPXNWSGNVTXNSRETPXSNSFLPKVGGPTTPAPKRRGAGLXXRPXXAKXAAQRGXKVRLETSAGAGGTGKXRKREGFXXGXA

SEQ ID NO: 185267 - protein, 96 aa, Triticum aestivum
  unsure (1)..(96): unsure at all Xaa locations
  Clone ID: PAT_TA_79685.pep
MASRLLTRSKALALAAARADAXAPSPLAAAWGTRALSTLPRDPXAASPASSPRXPAXVSPLGLSKIXGYEQGISXSGXTKRICLRWFSNXGSNXIS

SEQ ID NO: 185268 - protein, 175 aa, Triticum aestivum
  unsure (1)..(175): unsure at all Xaa locations
  Clone ID: PAT_TA_79686.pep
ESAVLSYEFLCRRSRSTTMASCGRLFVFFLVAAALAAAPAASMANVVPLLTGRRHHAAPAPSPXHALACGLAFXTAPPASPAPPTSRXVRQSSAFGWVRXGLVRPRSGTGWXLSVIQGWXRGXRXQXPXXVWGRPPAKGXXPGFGTGXXXRXXXPXERGLXKGXWTXGXNXQXSX

SEQ ID NO: 185269 - protein, 145 aa, Triticum aestivum
  unsure (1)..(145): unsure at all Xaa locations
  Clone ID: PAT_TA_79687.pep
MANPRVFFDMTVGGAPAGRIVMELXKDAVPRTVENFRALCTGEKGVGKSGXPLHYKGSSFHRVIPDFMCQGGDFTKGNGTGGESIYGEKFXADEKFVHXHTXPGXLSMXNXAGPXNKGSQFFIXNVPGIWVXGKHVVLGEVLLGI

SEQ ID NO: 185270 - protein, 78 aa, Triticum aestivum
  unsure (1)..(78): unsure at all Xaa locations
  Clone ID: PAT_TA_79688.pep
XTPAXAGEHRSRGQPADDRGSGSDRASSAGRERRKQGXHGGRSGARGVGWERRKGDSGSGGDRAFGVRALSFSRTVGA

SEQ ID NO: 185271 - protein, 106 aa, Triticum aestivum
  unsure (1)..(106): unsure at all Xaa locations
  Clone ID: PAT_TA_79689.pep
PASSLLTVAASSQSSPSSPRHHPPRKGGCLAAAATADAAPAASAATAAAGARCSPTLRPPPAPPPWSCPPPPTRGAPAGSRRPAXRPXVATXPPXKWHGRAPAGSC

SEQ ID NO: 185272 - protein, 112 aa, Triticum aestivum
  unsure (1)..(112): unsure at all Xaa locations
  Clone ID: PAT_TA_79690.pep
MPPPGPGAAXAPIQLGVPPPYLRTHGAKMARRHMYDWIVLLLLAAIEVVLNLITPFHRFVAEXMMXDLRYPMKXXNIPVWGRPDXRPSSLPMLXXAGXXFNKKNAXTAPTPK

SEQ ID NO: 185273 - protein, 157 aa, Triticum aestivum
  unsure (1)..(157): unsure at all Xaa locations
  Clone ID: PAT_TA_79691.pep
ALVVGHPLLPLDYPLDQXCDRXXAFSEKYGVQVYLDPGEASITKSTTLXEVTVLDTLFNGKNLAIVDSSIEAHMLDLLIYRETXKVSPNEGEHPYMVCGKSCLAGDIFGDFRFDKELKXGXRISFXDAAGYXMVKKNWFNGVKMPAIAIKEXDGDPL

SEQ ID NO: 185274 - protein, 141 aa, Triticum aestivum
  unsure (1)..(141): unsure at all Xaa locations
  Clone ID: PAT_TA_79692.pep
MDPIKIXINGFGRIGRLVXRVXLQSPDVELXAVNDPFITTDYMTYMFXYDTVHGQXXKHHEVKVKDSKTLLFGQKEVAVFGCXEPEEIHGLLLGAEXVVXVNGVFNEKGXGASSKLRGGAKXKXXXSGPXKDXPKVWPGAK

SEQ ID NO: 185275 - protein, 128 aa, Triticum aestivum
  unsure (1)..(128): unsure at all Xaa locations
  Clone ID: PAT_TA_79693.pep
MVKAVAVLTGSEGVKGTIFFTQEGEGPTTVTGSVTGLKEGLHGFHVHAXLGDTTNGCMSTGPHFNPAGHVHGATEDEIRHAGDLXGNVTAGVDGXASINITXWQIPLNWKFKFWAVVVVQWGKLFKRG

SEQ ID NO: 185276 - protein, 65 aa, Triticum aestivum
  Clone ID: PAT_TA_79694.pep
SCRIRHEGRRRIRLTTTMATRLTMTMARTSANSKFCLRQTRWFSGNKKSYASSGQLYFLDEALLC

SEQ ID NO: 185277 - protein, 101 aa, Triticum aestivum
  Clone ID: PAT_TA_79695.pep
PGQPRQQRFLAAMDPSARRRLPARPRVGGADRRRGRLRRWCRVPPVHPARRSPRGGSRGTPPQRAVSGYRGEAASTLGLRTRHGDHKLSARVVRWTVEAPC

SEQ ID NO: 185278 - protein, 80 aa, Triticum aestivum
  unsure (1)..(80): unsure at all Xaa locations
  Clone ID: PAT_TA_79696.pep
NXQTLKHPEPCTCIIPFRXGTAXXRXWVRRRHCHHRGVLRGVNGPRGGLQVGEAGEDDEGDEEGMTGGSHXAAVVWTCGD

SEQ ID NO: 185279 - protein, 57 aa, Triticum aestivum
  unsure (1)..(57): unsure at all Xaa locations
  Clone ID: PAT_TA_79697.pep
LEXKNXWKKSEEXXXNGAXILXNGPINTCXXXDKACHMLSKKKKKKLGTSSLSLSLS

SEQ ID NO: 185280 - protein, 99 aa, Triticum aestivum
  unsure (1)..(99): unsure at all Xaa locations
  Clone ID: PAT_TA_79698.pep
WCASSTCPAPPPPSPTVPSXRSLPRACEXPRRPRHPSPPCRRWGSRXXLXRSARXGPXXXRALKALSLDQXHQRXFWXFXIIXLXSSLGSNXXNXWCXL

SEQ ID NO: 185281 - protein, 116 aa, Triticum aestivum
  unsure (1)..(116): unsure at all Xaa locations
  Clone ID: PAT_TA_79699.pep
VCAASSHRRLRRXVTGVRLRRLALATPPLRSSEHQRQPWPGLEPWSPPSVPTKRARLLQPSPPLPASSQHRSQAXLPRLLYXXKGQXTMLRVKLRQSTQSGSVGKWPWKXTMGRXM

SEQ ID NO: 185282 - protein, 84 aa, Triticum aestivum
  unsure (1)..(84): unsure at all Xaa locations
  Clone ID: PAT_TA_79700.pep
PGSDPPHPVWLPRLIPNPQLIPPPPRAQERAAAACERQVRRDQPGXPXPGVPRLLSRTIGRRGSKSMSEKDKGREGMQNERLVT

SEQ ID NO: 185283 - protein, 67 aa, Triticum aestivum
  unsure (1)..(67): unsure at all Xaa locations
  Clone ID: PAT_TA_79701.pep
QRTSNVHXGIDXHPLHSAYIYEFITVAKLNXACHNAPAVRPASHRSVHHRPRNQVNIRRXGPWKRXP

SEQ ID NO: 185284 - protein, 85 aa, Triticum aestivum
  unsure (1)..(85): unsure at all Xaa locations
  Clone ID: PAT_TA_79702.pep
FFSSSLSLTLSPYCAAADQAXTTFCRQRSTHYYWLRDHSLYFYVSLTLRSAPSLVKMAQDLLPVLDNTSCTCRRQALICVWSEIS

SEQ ID NO: 185285 - protein, 121 aa, Triticum aestivum
  unsure (1)..(121): unsure at all Xaa locations
  Clone ID: PAT_TA_79703.pep
XRRNXRXXIGPVPEDQXPLTPAXALISSHTPRLRQELVVLLCTPGCPLRKDVMLCXIPADIPLAVAAGAMPQQQARRTTATTRRSCAPAMAELSSGRRTDDGSMALKWTEHLSWLASRSEL

SEQ ID NO: 185286 - protein, 83 aa, Triticum aestivum
  unsure (1)..(83): unsure at all Xaa locations
  Clone ID: PAT_TA_79704.pep
GRXFIDMNAGXPXLGQVXMNARRSRLEPNRXMMEHNSTSGKSAQPWGPNMTQSIDVVVLEIKIRLMFCIVSTSKSRQQTELNQ

SEQ ID NO: 185287 - protein, 76 aa, Triticum aestivum
  Clone ID: PAT_TA_79705.pep
AINGVVRTIHSLMRSAGESSGRPTVAGCGRRRGRGPEVSRLWSDVRGAYRVPPQLNGPKPKRLDTKSTQQEEHEQL

SEQ ID NO: 185288 - protein, 157 aa, Triticum aestivum
  unsure (1)..(157): unsure at all Xaa locations
  Clone ID: PAT_TA_79706.pep
LXTIHGXHWGLGLNDVWXKRETWGGLXPSPTPVEKXLASXFLFSWLXMVDLEAPKXVVSMPVLVATTTVQTRXVRRRPGEPPLWTSSVPSTESSCGSPYIRXXRGFRHKXNRRXSXIAATLIHLXPFRTHHPGLDPHRMAPPHRHGRIRAPLPLLPA

SEQ ID NO: 185289 - protein, 208 aa, Triticum aestivum
  unsure (1)..(208): unsure at all Xaa locations
  Clone ID: PAT_TA_79707.pep
STSRPAMPPGGGGGATGEQRFGEQDLPPATGHGCRDEGPPSRSPSPLTPLLPGLAVTPVASENKDQGGKGLGXQGGXKEXPGELSRGDVSHPXILVAGLPLTSRLXPISKLRCPKTNGLAPPGSAPXRSDKEGPPQXPCXGLSFNFNLRXGRFPKKFCXGEXILPIRXTXKSPFSLXPGSYKFFQVIQXIASNKXSSFCKXFXKSXXX

SEQ ID NO: 185290 - protein, 81 aa, Triticum aestivum
  Clone ID: PAT_TA_79708.pep
DVLRALCAEAGYVVDDEGNVTRCPERSPGVGASGSSDHLQPSSHSGATEATAGDIHQALLEPEAEPKHKISLELTLSFSYM

SEQ ID NO: 185291 - protein, 168 aa, Triticum aestivum
  unsure (1)..(168): unsure at all Xaa locations
  Clone ID: PAT_TA_79709.pep
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHXGVIPKXXPVLLPXRTAXKEGQGXPKSPKERPPSXPKKGRQPXKKTECALLS

SEQ ID NO: 185292 - protein, 111 aa, Triticum aestivum
  unsure (1)..(111): unsure at all Xaa locations
  Clone ID: PAT_TA_79710.pep
AVNHVHALAILVATFHYEKQPPALDQDTFADYTARTSFERPLLSGVAYAQRVMHADREAFERQQGWIIKTMKHEPSPXKDXYXPVIYSXGEXSYIEGLXIIPRRKDPEENP

SEQ ID NO: 185293 - protein, 100 aa, Triticum aestivum
  unsure (1)..(100): unsure at all Xaa locations
  Clone ID: PAT_TA_79711.pep
QKSAWRSGTKEKTEKETKKRKRVTNNLLSHGGSPKGISMQLAPANLHNSSEFLKFSHNGRGGGYLVLKSASIPLLPNLPTCCKGAMFLLXSAPLVNVPVE

SEQ ID NO: 185294 - protein, 127 aa, Triticum aestivum
  Clone ID: PAT_TA_79712.pep
IRVTPKDSNGAAGKHHLRGTLILFGAFSSYALWYPIQVKVLKVYPWKHWSSVLTCVLGGVQTFAIGIIMSRHKLAWQIGWNIQLLTIVYSAALGTAAKYWLNLYAVEKRGPVFPAHVQQPYRRSHHF

SEQ ID NO: 185295 - protein, 137 aa, Triticum aestivum
  unsure (1)..(137): unsure at all Xaa locations
  Clone ID: PAT_TA_79713.pep
PTIHYPSSLGGVXCLXQALFVRPXXVILFSNLHQIQAGQSSKRKGKTGIATTRMQNLSLLTXQPAVRGTXPALDEGPAXRGTPSSPACXGGSVCTLAQNHLVGAXGGRXNQPDIPPXPQXNMNATXPVPPLXXLSKV

SEQ ID NO: 185296 - protein, 164 aa, Triticum aestivum
  unsure (1)..(164): unsure at all Xaa locations
  Clone ID: PAT_TA_79714.pep
HPTREPPQHLAAAAAAAEVDDXMWRSRARALLLLRSSVPRSPPPQQNPLRSLARAPPPPPRLLSRFLSSSSPEALPDAPSSSAEALPDDPFAFPPGAISGXADPPKAXKDNLAALWEXDCGRTPKSFSASSENGRFPKAGRVAPGFVLGSNPGDKISQRPIKLR

SEQ ID NO: 185297 - protein, 109 aa, Triticum aestivum
  unsure (1)..(109): unsure at all Xaa locations
  Clone ID: PAT_TA_79715.pep
RXRRTRKETXQTKNDGDGEAKRXRXKDPTXLXRKSKXTRSEIRRLRARATRXTSETXSCSAAARPGIAXRRAAGPGLGLRXXGGDGGGGRSGXWXIAGWAGEQEEDGXE

SEQ ID NO: 185298 - protein, 82 aa, Triticum aestivum
  unsure (1)..(82): unsure at all Xaa locations
  Clone ID: PAT_TA_79716.pep
ARISSTLHRCCELIHADSPAPCYNCCKPGRHXQGPKQGKLEMGXVRYAFEXXPKKVXKRXXMVQLXLKXQXREXTFQXTNXX

SEQ ID NO: 185299 - protein, 120 aa, Triticum aestivum
  unsure (1)..(120): unsure at all Xaa locations
  Clone ID: PAT_TA_79717.pep
MGISRDSMHKRRATGGKQKAWRKKRKYELGRQPANTKLSSNXTVRRVRVRGGNVKWRALRLDTGNFSWGXEAVTRKTXRLLDVVYNSSNNELVRTQTLVKNAIVASLMLPXFKXLVPGLN

SEQ ID NO: 185300 - protein, 107 aa, Triticum aestivum
  unsure (1)..(107): unsure at all Xaa locations
  Clone ID: PAT_TA_79718.pep
MAGRKGGDRKKAVTRSVKAGLQFPVGRIGRYLKKGRYAQRVGSGAPVYLAAVLEYLAAEVLELAGNAAKDNKXKTRIIPRHLLLAXPQTXRNSGKACXPGVTIAHGX

SEQ ID NO: 185301 - protein, 97 aa, Triticum aestivum
  unsure (1)..(97): unsure at all Xaa locations
  Clone ID: PAT_TA_79719.pep
LTFLSQCNCLGWDSVWAHMGCXLKECSXVSSXFPKGAXSXXPQXPNXKVXPXQKXPLXSXLNVLDKXIXXSQIQNWAPXXKXSESWXXGPGFXKKXG

SEQ ID NO: 185302 - protein, 77 aa, Triticum aestivum
  unsure (1)..(77): unsure at all Xaa locations
  Clone ID: PAT_TA_79720.pep
WTLCGLQNREGSCKAAKDQLXXIFPWXXMNFSHKFLXIXNXKDELRHSLKISRFLXWPXQMXXSXXGSESCWGTGXI

SEQ ID NO: 185303 - protein, 61 aa, Triticum aestivum
  Clone ID: PAT_TA_79721.pep
GCNSSGSTYMVLFGLMQLLLSQLPSLHNIAWLSVVAVATSFGYSFISLGLCRRQVGLPWRR

SEQ ID NO: 185304 - protein, 83 aa, Triticum aestivum
  unsure (1)..(83): unsure at all Xaa locations
  Clone ID: PAT_TA_79722.pep
LQLACSVCHSGHFLASTTAMATADVQNPTAALTEEAPAVETPVAAEEVAKTEEVPXPXXAEVXAPAPVEVXGEQGGRTGRPPE

SEQ ID NO: 185305 - protein, 136 aa, Triticum aestivum
  unsure (1)..(136): unsure at all Xaa locations
  Clone ID: PAT_TA_79723.pep
MQIFVKTLTGKTITLEVESSDTIDNVKAKIQDKEGIPPDQQRLIFAGKQLEDGRTLADYNIQKESTLHLVLRLRGGMXXFVKNLNGQRQSTLEVESSGQLSTNVXAKIKTKEGHPSRTTXSQSFAXKQLXGLAAPC

SEQ ID NO: 185306 - protein, 93 aa, Triticum aestivum
  Clone ID: PAT_TA_79724.pep
MKLMPTVFCLLLVVLALDGARVEARGTPSADQGSKNQWSSMFVFGDGFVDNGNLPKTDTWRQWSYPYGSYLNSPWICDSCSNWDAFPTIGIQS

SEQ ID NO: 185307 - protein, 100 aa, Triticum aestivum
  unsure (1)..(100): unsure at all Xaa locations
  Clone ID: PAT_TA_79725.pep
SYKRHETTSDYATTSATTALRDVGANTQLCYYQRFGLMEPTIQFSFLLPSYFSLLEPSSLFAPTGVLGLFGIWSNCKFCXFCFHQAVLFCWKPASFFAKT

SEQ ID NO: 185308 - protein, 93 aa, Triticum aestivum
  unsure (1)..(93): unsure at all Xaa locations
  Clone ID: PAT_TA_79726.pep
PNFPTKXXIXGPNPKPLNPRXFHLXLKNRXPXFYXQXTXXTFLALQTXINXILRALLGFYFSQNXXRSIQLFXLGXASLCNQNCKXHCGGTIT

SEQ ID NO: 185309 - protein, 92 aa, Triticum aestivum
  unsure (1)..(92): unsure at all Xaa locations
  Clone ID: PAT_TA_79727.pep
MGWRWHXDGEGDRGRXGLGDIPDLAGRGXGEGAHXGTRRVVQSRCHTXEVXPGRFVRKCEXTXXLXLRDCVGRPSELGGSRKLRTPEDFTLK

SEQ ID NO: 185310 - protein, 155 aa, Triticum aestivum
  unsure (1)..(155): unsure at all Xaa locations
  Clone ID: PAT_TA_79728.pep
EQAXRGRGVHLRQEHGXNPNLSGRLEFLVQEEAPGRAGIXRRAATGTASVISRRGPLYGSSTGQIMSADSXVXGKGCAMAQVXIQGSVEIQKPSNXXAVAPVIAGLLFGSLXGTKGRRXKNXXAGVGXKWEGKTNLGSFXAKILGGTKFPNLXKK

SEQ ID NO: 185311 - protein, 64 aa, Triticum aestivum
  unsure (1)..(64): unsure at all Xaa locations
  Clone ID: PAT_TA_79729.pep
RRXTWRRRYGXTWSSVXQXXPPXKQRXLTXAMPSSSPLLNPNEPNGTEPDREPRXEWGGEANPC

SEQ ID NO: 185312 - protein, 134 aa, Triticum aestivum
  unsure (1)..(134): unsure at all Xaa locations
  Clone ID: PAT_TA_79730.pep
GLINAAVGAWGVEDLEVVVRQSSGYDQTRTYNFPHNCLNLPSCLRRLTLGKYCALPPLHNYNTLTKLVLRDMSASTPVNMYERVFRDCIGLQVLHLTSCCCALTTLGNLVIRFYWAEXMGYXPXPPGXGICPQP

SEQ ID NO: 185313 - protein, 143 aa, Triticum aestivum
  Clone ID: PAT_TA_79731.pep
MGISRDSMHKRRATGGKQKAWRKKRKYELGRQPANTKLSSNKTVRRVRVRGGNVKWRALRLDTGNFSRGSEAVTPQEPVSWDVVYNSSKQMSFVKDSKPVKCQLLQSLIACPPFKAGNLELNYGSIRLGKKKSLLANLPKKGA

SEQ ID NO: 185314 - protein, 137 aa, Triticum aestivum
  unsure (1)..(137): unsure at all Xaa locations
  Clone ID: PAT_TA_79732.pep
MARTKQTARKSTGGKAPRKQLATKAARKSAPATGGVKKPHRFRPGTVALREIRKYQKSTELLIRKLPFQRLVREIAQDFKTDLRFQXSSAVSALQEGAEGXSLGLFXGHKLCAIXAKRVTXMPKEINSPRAIRGXXA

SEQ ID NO: 185315 - protein, 142 aa, Triticum aestivum
  unsure (1)..(142): unsure at all Xaa locations
  Clone ID: PAT_TA_79733.pep
MQIFVKTLTGKTITLEVESSDTIDNVKAKIQDKEGIPPDQQRLIFAGKQLEDGRTLADYNIQKESTLHLVLRLRGGMQIFVKDLNGXRPSRFEVESXDTIXDNVKGQRXKGQREGHPPRDQANGLYPFAWAKQAWEGLGPPL

SEQ ID NO: 185316 - protein, 129 aa, Triticum aestivum
  unsure (1)..(129): unsure at all Xaa locations
  Clone ID: PAT_TA_79734.pep
KAHRDLRPTPPPNHTRRSAPPCNLVPPFPIPRLIRARGREDCFDAPASARAVGQAVAGALRRRPPEMGRKMEARRRRVPLLPARCNKRWPEGGGWSGRTAASRTIMKHDHTHDPGVSSVSIFCEXXMDL

SEQ ID NO: 185317 - protein, 99 aa, Triticum aestivum
  Clone ID: PAT_TA_79735.pep
LIGESRKVKKKNTVEKKKLTMSRSCGRRRRRRRRLATAASGAPSSYPPASAGPALPPPSRAADTWWPVADPPLGRAGAAAPGRRRRRVDPQLPIFPPAA

SEQ ID NO: 185318 - protein, 186 aa, Triticum aestivum
  unsure (1)..(186): unsure at all Xaa locations
  Clone ID: PAT_TA_79736.pep
TTPIVSSSSCRHLLHQSTLNHSTYKSITDRSQEQQAQTKATTTYREQLSSSSRKKEEQEMAARAVXIWQRXXSSSXRRSCXXRVRAXXERVHAXSHXACPPASTXHGERNXAIQIVLARXSPTVVKLQSPELPXAWRSKPXPAAXRAXGTFXXNPRPXPPRTSXGXXIPPXQKTXPSPPXKFAVXP

SEQ ID NO: 185319 - protein, 32 aa, Triticum aestivum
  unsure (1)..(32): unsure at all Xaa locations
  Clone ID: PAT_TA_79737.pep
FXFFFFFFFFFFFFFFFFFFFFFFYKRKCSSF

SEQ ID NO: 185320 - protein, 58 aa, Triticum aestivum
  unsure (1)..(58): unsure at all Xaa locations
  Clone ID: PAT_TA_79738.pep
FFFFFFFFXMRDPLDLINPLLVTSNNARCNPAKKKKTMHDVGISSNSSQPTKCPTQLP

SEQ ID NO: 185321 - protein, 154 aa, Triticum aestivum
  unsure (1)..(154): unsure at all Xaa locations
  Clone ID: PAT_TA_79739.pep
MAPFXPXPPAGGGGXPPPPRGGSKXPRKAXXGXERPSNRPPGGXSXPVSXGXRKKEGGIGPPHQXPXSXRVGGRRVQXQAEXFXPXSPATHLPPXAKPGTRPVLARELGFGWTPRLAPPFAVRTPPADKCARRRKGESESRGRDRGSSQRGKWR

SEQ ID NO: 185322 - protein, 132 aa, Triticum aestivum
  unsure (1)..(132): unsure at all Xaa locations
  Clone ID: PAT_TA_79740.pep
PVKSTKXYMNFLLANIDKFLIACKVSTSDDIREKRGDKNDAPKAFEASFLFFCHVFHECHFVMKPCQRGWPIEWAGCGCQGAATMSQLRARAHNRGMAVWHHDDQHKAGCEPRKSYLGDKKKEQWYMCLLAR

SEQ ID NO: 185323 - protein, 175 aa, Triticum aestivum
  unsure (1)..(175): unsure at all Xaa locations
  Clone ID: PAT_TA_79741.pep
MASCMLKLRGGMXIFVKTLTGKTITLEVESSDTIDNVKAKIQDKEGIPPDQQRLIFAGKQLEDGRTLADYNIQKESTLHLVLRLRGGMQIFVKXPSPGKTITLEVESSDTIDNVKGEDQDKXGIPPDXQRLIFAGKQLRRXGAPXAGYNIQEKSPPSNLVLKAPLVCFSLTGEKP

SEQ ID NO: 185324 - protein, 171 aa, Triticum aestivum
  unsure (1)..(171): unsure at all Xaa locations
  Clone ID: PAT_TA_79742.pep
KCSENPFALLTTFNEVDMTNLXVSPQLGVKLGLMSCFVKAAVSALQNQPIVNAVIDGDDIIYRDYIDVSVAVGTSKGLVVPVIRDTEGMNFADIEKGINSLAKKATEGALSIDEMAGGXFTISNXGGVLWXVLISTPINQTPPXVSKFLGMQFLLSKRPWWLLDGLQSKAN

SEQ ID NO: 185325 - protein, 139 aa, Triticum aestivum
  unsure (1)..(139): unsure at all Xaa locations
  Clone ID: PAT_TA_79743.pep
XGAXGXRXAAXXRATTTNVGSGLXLRRRXXXTGLIXXRNPTKGQATAASPARXYQAPWQSNTHHRGPDPDPGAXPEPDELAASGATASAMAPSRSRLGIGAGGPAGGRAGGLGFGVGRGGGNSVRSRTLASWGTLELGQ

SEQ ID NO: 185326 - protein, 97 aa, Triticum aestivum
  Clone ID: PAT_TA_79744.pep
WILDSYNGQYNAVFGDAIFFEWSPHNLMEPGQLYEYARRPVTYRLEQPDVPQIQPPTGFVGLPPPLHPTDDDWFSRECPWQEEVTRQYRFEPPNQLI

SEQ ID NO: 185327 - protein, 136 aa, Triticum aestivum
  unsure (1)..(136): unsure at all Xaa locations
  Clone ID: PAT_TA_79745.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDNNLCAIHAKRVNIMPXDIQLARRXRGXXA

SEQ ID NO: 185328 - protein, 155 aa, Triticum aestivum
  unsure (1)..(155): unsure at all Xaa locations
  Clone ID: PAT_TA_79746.pep
MQIFVKTLTGKTITLEVESSDTIDNVKAKIQDKEGIPPDQQRLIFAGKQLEDGRTLADYNIQKESTLHLVLRLRGGMQIFVKTLTGKNITLEVXSSDTIDNVKGKXKKKEXIPPGTNNALIXQGKQLGGWSQPLAGLTIQGPPLLGGSREAKIFN

SEQ ID NO: 185329 - protein, 167 aa, Triticum aestivum
  unsure (1)..(167): unsure at all Xaa locations
  Clone ID: PAT_TA_79747.pep
MANPRVFFDMTVGGAPAGRIVMELYKDAVPRTVXNFRALCTXXXGVGKSGKPLHYKGSSFHRVIPDFMCQGGDFTKGNGTGGESIYGXEKFPDEKFXVHKHTKPGISPWANAGPKQQXGSXFFICNRSPCKLGSKGNVVLPAKVPKGNSKKSKKGAPPKGTVNFIPE

SEQ ID NO: 185330 - protein, 170 aa, Triticum aestivum
  unsure (1)..(170): unsure at all Xaa locations
  Clone ID: PAT_TA_79748.pep
MQIFVKTLTGKTITLEVESSDTIDNVKAKIQDKEGIPPDQQRLIFAGKQLEEGRTLADYNIQXKESTLHLVLRLRGGTRGGYLNVEXNLLQLALKYNEEENGLPAKCYARLPLKSNNXRKEXXAGQQATSWRPKKKVRQTSLSTEELNQDGEKKQGKDLMNVWGLFFKNF

SEQ ID NO: 185331 - protein, 125 aa, Triticum aestivum
  unsure (1)..(125): unsure at all Xaa locations
  Clone ID: PAT_TA_79749.pep
SAHHSLLRATTTGRLPLWCDRPIATRWCTPSPVRPKPLSGLCPNIAMLPRXRRWVVRKNWXSDRGXXPCSMRAICPTDARLVWANPXHXSKIXTKHXMXVDXGKFWLGKDKXCVVHKVKGGTXKC

SEQ ID NO: 185332 - protein, 120 aa, Triticum aestivum
  unsure (1)..(120): unsure at all Xaa locations
  Clone ID: PAT_TA_79750.pep
RDANHTHTQHVIFIXFSSQQQRAHRAXDXXDGGDXXPSAXTARPGGPPRPGADHAGRXGRGXAAARXLWRPGETXXASXPXXAXCTXAQGXXISXVXXPICXXPXLGSXFXXXRLXGANL

SEQ ID NO: 185333 - protein, 204 aa, Triticum aestivum
  unsure (1)..(204): unsure at all Xaa locations
  Clone ID: PAT_TA_79751.pep
AEKAEKPGEQGFTPLHVAAGAGLCEMIEVLLSKGADVNWFSYRGTLLHSAIIGKQVAAVKLLLDHHADCNKPVSLHYTPLIAALHARSLKCVKLLIEAGADAKGVPPLTPLIIAANDGLTDFXKPLLRAGADPDVRDDGGQLPIXKLAARNNKXGKNVEXXFFQVTTSXFPMXLNWSVXGXNLLNVKSIAERRXDDPFYKNGAN

SEQ ID NO: 185334 - protein, 90 aa, Triticum aestivum
  unsure (1)..(90): unsure at all Xaa locations
  Clone ID: PAT_TA_79752.pep
XXFLEGGXLXTXNTGSWITQKPATGTTCIQXMCMKFXTYMHLNISHXKHLRSPLRTLLSSESGLFEANPRACASSVINGPRDTTPLLIQD

SEQ ID NO: 185335 - protein, 111 aa, Triticum aestivum
  unsure (1)..(111): unsure at all Xaa locations
  Clone ID: PAT_TA_79753.pep
VSTRXVYPPXXXGLXRNGNXKRPGLTPEXGARERSGXFRFQEEEDWFXGNCPGVDLRRLALSPXGCFLRLLWVERRCRRRVSPGVIRRTLLARRASRACASFYPSLASTPR

SEQ ID NO: 185336 - protein, 63 aa, Triticum aestivum
  Clone ID: PAT_TA_79754.pep
SLSQGLFERATNYSLFTILCYSPSDHLQGRRAPGLRSADTIVCWLLRAWSSQGVKITTALSGR

SEQ ID NO: 185337 - protein, 139 aa, Triticum aestivum
  unsure (1)..(139): unsure at all Xaa locations
  Clone ID: PAT_TA_79755.pep
LQXSKPGVITPQIITNXFIFSIQAAASSRHHWVWGGLAPRAAPTALCSLGGHREGDRTQLPRKSPCCKAPLSSPSSPPSGSREVAFPQGRWRSCPRRAAVADPRRRAALAVEFVGAACDRRALAPPPPPWLLILASFDF

SEQ ID NO: 185338 - protein, 177 aa, Triticum aestivum
  unsure (1)..(177): unsure at all Xaa locations
  Clone ID: PAT_TA_79756.pep
RRAKPSPLLSLTAPSSHPPEPPSNQMYSTRRRSSAAAPAPTEDERETAGVDRSWPFMFEGMTPFTTTSKAFPPPPLPPFAVRTAKXSGLADVTPDLSRYEFRATNYFSASAYPSCSDWTPEFGHCKDTGRSRDAGLLTLSSRXPTTHEAMWVIKCTIPGSDNCQANAKLGEAVFRPR

SEQ ID NO: 185339 - protein, 173 aa, Triticum aestivum
  unsure (1)..(173): unsure at all Xaa locations
  Clone ID: PAT_TA_79757.pep
MAPKADXKPAAXXPAXEEPATEKAPAANKPKAEXRLPAGXTASKEGAGGEANYXGPEXGQQGEKGRPRRTKXYIFKVLKXVHPDVGISSKAMSIMNSFINDIFEXARPPRAAKAXRRFKXRRPPSTSPGXIQDLPFRLRPPPGGPSNPLLRTKGRQTLKLQLHAFALYIYYLG

SEQ ID NO: 185340 - protein, 92 aa, Triticum aestivum
  Clone ID: PAT_TA_79758.pep
EVFEGTLMMTLPASLVGRAELKTGGSNQWQSLQTYVAIAHHLVLRGTGIRLRLDVADCNSAMRRLFYQVFPLLPSKHPVFTGLFWRFVLPMI

SEQ ID NO: 185341 - protein, 56 aa, Triticum aestivum
  Clone ID: PAT_TA_79759.pep
HIFCIANYKVFRAVCHQLLLISCQQLGVQPASLSTDCRGKRASMKLCLTIVLRSTP

SEQ ID NO: 185342 - protein, 152 aa, Triticum aestivum
  unsure (1)..(152): unsure at all Xaa locations
  Clone ID: PAT_TA_79760.pep
MAPKAEKKPAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGEAAKAGAXNKKPNITSGEIXTSVRLVLPGELAXXVSEGNKGVNKFQPPS

SEQ ID NO: 185343 - protein, 153 aa, Triticum aestivum
  unsure (1)..(153): unsure at all Xaa locations
  Clone ID: PAT_TA_79761.pep
SPFPSPKISPPATTPSPNPXPPPPAVXRQPWPPPPAAPCSSSSPPPPWXSSRRPRRPXPAPAAARRRCSSXSXPSPAPTXTPPDPVRPLXXHRSSPVLRGPPASGXAXAFQGXNEPXXPPSXIXPXPGPKPSPRPPTEFRGLLPFQGRQMGQL

SEQ ID NO: 185344 - protein, 193 aa, Triticum aestivum
  unsure (1)..(193): unsure at all Xaa locations
  Clone ID: PAT_TA_79762.pep
KVEHLFFAQQYHDRKQQEARMSLPRAERAHAPFVDFLKPIIADGDTGFGGATATVKLCKLFVERGAAGVHLEDQVVGXTKKCGHMAGKVLVAVSEHVNRLVAARLQFDIMGVETVLVARNXTPVAATLIKNNIHARXQXFILGATNPRLKKPASTGNSGPSARRNGGFKAIQGWTQRGKKNLPRVGKIAKGKL

SEQ ID NO: 185345 - protein, 177 aa, Triticum aestivum
  unsure (1)..(177): unsure at all Xaa locations
  Clone ID: PAT_TA_79763.pep
MAAAFSSTVGAPASTPTNFLGKKLKKQVTSAVNYHGKSSKANRFTVMAXAENLDEKRNTDKWKGLAYDISDEQQDITKGKGIVDSLFXAPKGDGNHEXAVLXSYKYVSQGTQRSNFQQWGPNNLPFNNLVFLLPNFNNPCIKSNPVTLGKAKGQRENQFQLTFPKMGHQTQFLLPRG

SEQ ID NO: 185346 - protein, 111 aa, Triticum aestivum
  unsure (1)..(111): unsure at all Xaa locations
  Clone ID: PAT_TA_79764.pep
MRECISIHIGQAGIQVGNACWELYCLXHGIQPDGQXMPGDKTVGGGDDAFNTFFSETGAGKHVPRAVFXDLEPXTXLMXVRTGAYRQLFHPEAXYXWQGRDXSPTNFXPVH

SEQ ID NO: 185347 - protein, 198 aa, Triticum aestivum
  unsure (1)..(198): unsure at all Xaa locations
  Clone ID: PAT_TA_79765.pep
QSSPPTISPGNLRSERSEGSLVLLLKMQIFVKTLTGKTITLEVESSDTIDNVKAKIQDKEGIPPDQXKRLIFAGKQLEDGRTLXADYNIQKESNLHLVLXLRGGMQXFVKNLTGKTITXLXVESSXTNLQMXXARFXTKEGIXPPDXXRLDXCRAXXSKDWPQXLXXXNIQXXSSNPPTLGLXGXLVGMQIFFXKTXT

SEQ ID NO: 185348 - protein, 125 aa, Triticum aestivum
  unsure (1)..(125): unsure at all Xaa locations
  Clone ID: PAT_TA_79766.pep
GVIVPPRLSSPPPLPSPPMATPALPNPSPLLDDPLPPEPKPRREPKVRDPDAREPPAAAQDPEEDAPEEPEPRXGXGPGAARPSPPTRFEPTPVRRRRWDGDDTSSVSSLVRPPLPTECPAAGGQ

SEQ ID NO: 185349 - protein, 55 aa, Triticum aestivum
  unsure (1)..(55): unsure at all Xaa locations
  Clone ID: PAT_TA_79767.pep
RFRIXRLAKPGAXNLXXFGRISXSIEMXFXLNKLITLGPYDLIFFFHTGQHXPTI

SEQ ID NO: 185350 - protein, 151 aa, Triticum aestivum
  unsure (1)..(151): unsure at all Xaa locations
  Clone ID: PAT_TA_79768.pep
MAVHQWTVALFVAVALVAGPAISYAVETSNALAGAQPXAXTTEEQQLIEKANIAFKAAVAAAAVVAPADKYKTFQATFSLNFGWSIEGITGTFNFQATFTNKIAFAQXQAXHFXKGANLXGKYETFVGIXXQSLRINRESSKVNVPRPGRE

SEQ ID NO: 185351 - protein, 140 aa, Triticum aestivum
  unsure (1)..(140): unsure at all Xaa locations
  Clone ID: PAT_TA_79769.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHXTAKGXAPLXKAQRRSKGLPPPXTKRTKRMVIPERAQRVLKATLG

SEQ ID NO: 185352 - protein, 105 aa, Triticum aestivum
  unsure (1)..(105): unsure at all Xaa locations
  Clone ID: PAT_TA_79770.pep
EXIFFWGSPHPKXGLXVGLTRENWAXARLSRFQPTKGXLTLIHFGQFIXRFXQNXSXGFQKSFLYSPVKHLIVKHWYHLGSTIGQGXGTRQIPXTSGNAGSITPS

SEQ ID NO: 185353 - protein, 99 aa, Triticum aestivum
  unsure (1)..(99): unsure at all Xaa locations
  Clone ID: PAT_TA_79771.pep
FTPHIIGFFHSSAIRXARDGNLIYLLLIYNNNNNNNNKKARXASWWYVVTVLQKSPYVFGYSTRSSFLNESEKTFCFYKKHPFAASATTDRTQRLHARA

SEQ ID NO: 185354 - protein, 120 aa, Triticum aestivum
  unsure (1)..(120): unsure at all Xaa locations
  Clone ID: PAT_TA_79772.pep
MLDKLWDDVVAGPRPETGLDKLRRGRRHPTPRHQHKLQGRRLSSRRRCPTTPTTPVTPSSSTPPRWRQRVGGXVFQPREANLGQPKKPRPNLLSNGPAKPKSPQPFFKRERRTRKGNQPA

SEQ ID NO: 185355 - protein, 111 aa, Triticum aestivum
  unsure (1)..(111): unsure at all Xaa locations
  Clone ID: PAT_TA_79773.pep
TLEVESSDTIDNVKAKIQDKEGIPPDQXQRLIFAGKQLEDGRTLADYNIQKESTLHLVLXLRGGIQIFVKNLTGKXINLEVESSDNIYNVERRXFKTREGNPPGPVSSLPG

SEQ ID NO: 185356 - protein, 88 aa, Triticum aestivum
  unsure (1)..(88): unsure at all Xaa locations
  Clone ID: PAT_TA_79774.pep
PQNKSQPPSHLVKEISSVENGVXIIGDHLHRQIPSDCSEAPPGQPGQGFXXPVLXXPGRLGXXGKLGAATLESGXSQWXGQSIXRNLE

SEQ ID NO: 185357 - protein, 120 aa, Triticum aestivum
  unsure (1)..(120): unsure at all Xaa locations
  Clone ID: PAT_TA_79775.pep
PPPNPTRAAAPRGSSATMSGRGKGGKGLGKGGAKRHRKVLRDNIQGITKPAIRRLARRGGVKRISGLIYXETRGVLKIFLENVIRDAVTYTEXAXRKNVTAMDVVYALKRXGRNLXXFRG

SEQ ID NO: 185358 - protein, 136 aa, Triticum aestivum
  unsure (1)..(136): unsure at all Xaa locations
  Clone ID: PAT_TA_79776.pep
GQPNRPPVPRNQRQHHHPPMASLAARSGLRSLAARARAPAPAPVGRRMSSSAHDDAYEDGXVGRXSTLWGAVNLXLLGXLXNSPRGQPQLXIXRPXLTNXLAQSRKQREFPPXGNPMXXVXRXKQQXIXVXGXSXN

SEQ ID NO: 185359 - protein, 66 aa, Triticum aestivum
  unsure (1)..(66): unsure at all Xaa locations
  Clone ID: PAT_TA_79777.pep
MERSDSLSESPRKRNGLLRDQVQLVKSKDTSRYEIVPFPEPLSFEKGFXVMIRAXKLLVQKNEXEI

SEQ ID NO: 185360 - protein, 65 aa, Triticum aestivum
  Clone ID: PAT_TA_79778.pep
HEFDFLKLMLGCSPALKKMTLKLSRDVWSRKDGCTIINDIFKAYPSVQCYVYLSYGFIHGYQNYH

SEQ ID NO: 185361 - protein, 86 aa, Triticum aestivum
  unsure (1)..(86): unsure at all Xaa locations
  Clone ID: PAT_TA_79779.pep
RSAPPPWPRXSPTSPXXATPAPPPTASPPRPPPPPPPRATCPSAPGPSPASAASRTRGPVAPWAGLARSPGAAVGGGVAAGAGRRA

SEQ ID NO: 185362 - protein, 92 aa, Triticum aestivum
  unsure (1)..(92): unsure at all Xaa locations
  Clone ID: PAT_TA_79780.pep
LFXGXKXSKTPXSXKIXSVFSXXEXKFPXXSGLFXXEXFGXRVGAXIXXGWXWGYPEFGPRRNPSFPRARGLSIXVQLARKQRRRRRTFASC

SEQ ID NO: 185363 - protein, 69 aa, Triticum aestivum
  unsure (1)..(69): unsure at all Xaa locations
  Clone ID: PAT_TA_79781.pep
GFXFXXKXPSWXPFXQSCFCPVPAHSXDGWTXLEAGVIXRCSGSAAPWGDDAGGRRRRRQQNPSWGRSI

SEQ ID NO: 185364 - protein, 104 aa, Triticum aestivum
  unsure (1)..(104): unsure at all Xaa locations
  Clone ID: PAT_TA_79782.pep
VRGGRRXAMHHRPSSSSGPXXXRXSGAAPPPXAPSXXAXXHLCAPVAAATARPXEEETSRWXCCSAXAMYGVGIGSRSERVASPASCLFGGMGALRAAALVRLA

SEQ ID NO: 185365 - protein, 98 aa, Triticum aestivum
  unsure (1)..(98): unsure at all Xaa locations
  Clone ID: PAT_TA_79783.pep
RCXXKXLKKVFLLAXVAYCTXXKGLGKKVPKGTSERTKPLIXLRXTICVXYHMXNLKFLIPPQTSGEIYMSKARFMHPVQEYQIIKRMIPSPLYSSPN

SEQ ID NO: 185366 - protein, 83 aa, Triticum aestivum
  unsure (1)..(83): unsure at all Xaa locations
  Clone ID: PAT_TA_79784.pep
IXIXIYIYIYRERERERERERERERAATSERSGKCRHESPAEDLRRHGIRDPRAGFELRSGEEPKAGRRARGGRGRRTQVRFC

SEQ ID NO: 185367 - protein, 132 aa, Triticum aestivum
  unsure (1)..(132): unsure at all Xaa locations
  Clone ID: PAT_TA_79785.pep
PHLNPTPQPSPXPPPRPHHGSPPPPPFPLALPPASPSPPPXSSASPPPTPATPHRRPSSPSPTPRSRSPHPRRPPGRMRRSAGPDLXRTSRPXRFEQXARPNPPAGILXGKEGLPVPSKGTPGPRXFPPVFY

SEQ ID NO: 185368 - protein, 98 aa, Triticum aestivum
  Clone ID: PAT_TA_79786.pep
AKHQPRLPKEATCQSPSTLPVAMDMGLEVSSSSPSSSSLAKRPAGRTKFRETRHPVYRGVRRRGNAQRWVCEVRVPGKRGARLWLGTYATAEIAARAN

SEQ ID NO: 185369 - protein, 124 aa, Triticum aestivum
  unsure (1)..(124): unsure at all Xaa locations
  Clone ID: PAT_TA_79787.pep
MAARRAHAAATLDLLVAALVLSAAPAPAEGAVANCGXVVSYLARSSIYXGKVXSPGXXCXNRXRXLKAXGGNPXERKNXWKLPQTTSGXXXGXSKPNLLPXGNPGKXXGXKIPFPSKGNRFGAF

SEQ ID NO: 185370 - protein, 107 aa, Triticum aestivum
  unsure (1)..(107): unsure at all Xaa locations
  Clone ID: PAT_TA_79788.pep
GEQSDPAPPPPPPNPPAHVAGEXKKGKMARWKGQRKKAVTRSVKGGLQFPVXRIGRYLKQGRYAQRIGSGAPRXLPAVLRSISAXQVLELXPGNAGXWQTXXXRIIP

SEQ ID NO: 185371 - protein, 127 aa, Triticum aestivum
  unsure (1)..(127): unsure at all Xaa locations
  Clone ID: PAT_TA_79789.pep
MARGAAAAAAAAKGKKKGSVSFVIDCTKPVEDKIMEIASLEKFLQERIKVAGGKAGNLGDSVNVTRDKSKXTVTSEXAFSKRXLKXYLTKKYFKKHNVXRDWLRXVXQPTKERNVYELPVLQQSLKN

SEQ ID NO: 185372 - protein, 112 aa, Triticum aestivum
  unsure (1)..(112): unsure at all Xaa locations
  Clone ID: PAT_TA_79790.pep
DRLKHCVWNSETPTEFEDRWKSFIQXFKLEDHEWFAKRFQLRATWIPAYFMDIPLAGLLRTTSISESANSFFKRFICRKLTFVEFWLRFDTALKCQRQNXLIADNTRSTQQS

SEQ ID NO: 185373 - protein, 145 aa, Triticum aestivum
  unsure (1)..(145): unsure at all Xaa locations
  Clone ID: PAT_TA_79791.pep
WSKYAAPSDGSSDAAPSDGPRGAAPSDGSRDATQRGGAATSSNKHVKESKKGKKRDDPMVEVMAQYVEIKRKQAEESALLVGAKNAQEFSISKCIAVLHKMESIRRDERATAYKVFKSXRNREIFPXSAAXNEKNCCIVSFAKMG

SEQ ID NO: 185374 - protein, 141 aa, Triticum aestivum
  unsure (1)..(141): unsure at all Xaa locations
  Clone ID: PAT_TA_79792.pep
MANPRVFFDMTVGGAPAGRIVMELYKDAVPRTVENFRALCTGEKGVGKSGKPLHYKGSSFHRVIPDFMXCQGGDFTKGNGTGGESIYGEKFADEKFVHKHTKPGDPLHGXSGPNTKGSXFFIWNRSLGNWFPTEILFGRFF

SEQ ID NO: 185375 - protein, 138 aa, Triticum aestivum
  Clone ID: PAT_TA_79793.pep
FLPPLEGRRRRPEENNPRGWFLLRGPDGLRRKTRGEAAPGRRRRGGRRSRASGGAWRPRRRGSATGRGGARGKRAGGGPARARAPGRRRRTRPSSTASSPPRTPWTGRRRRARAGAWAASVAAQGTAWRGERGSREGV

SEQ ID NO: 185376 - protein, 112 aa, Triticum aestivum
  unsure (1)..(112): unsure at all Xaa locations
  Clone ID: PAT_TA_79794.pep
LVXNSARGPPSFLPRRRGSSLGFLAPALPPHRRPRTPCXXMEGRPSRSSRPRSPRRTMXRMTWHTSXRRXVDYKXLNXLXAKAGQXGXLXGXGLKXIGKEMSLPIPTKCPKN

SEQ ID NO: 185377 - protein, 120 aa, Triticum aestivum
  unsure (1)..(120): unsure at all Xaa locations
  Clone ID: PAT_TA_79795.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYXFGGLKRGACWALAHKALGAG

SEQ ID NO: 185378 - protein, 37 aa, Triticum aestivum
  Clone ID: PAT_TA_79796.pep
GERERERTSLEFFFFFFFFFSQKFPLTCILIKPSSFS

SEQ ID NO: 185379 - protein, 183 aa, Triticum aestivum
  unsure (1)..(183): unsure at all Xaa locations
  Clone ID: PAT_TA_79797.pep
MAPTVMASSATSVAPFQGLKSTAGLPVSRRSNGASLGSVSNGGRIRCMQVWPIEGIKKFETLSYLPPLXSTEALLKQVDYLIRSKWVPCLEFSKVGFIFREHNASPGYYDGRYWTMWKXLPMFGCTGPTGYSTKVEGGQKRSYPGRVISQSRIPTTRPCAFKFPPSSQPSGSPGKGKLHNANI

SEQ ID NO: 185380 - protein, 70 aa, Triticum aestivum
  Clone ID: PAT_TA_79798.pep
PRPRGLHRSCPRPACRRSLDAAAHPTAWASLSSTSFLSSQSLASPKMNVAAFSLRYSPEYFVIFFQPSLQ

SEQ ID NO: 185381 - protein, 138 aa, Triticum aestivum
  unsure (1)..(138): unsure at all Xaa locations
  Clone ID: PAT_TA_79799.pep
HSSWWKHLISSHHRSIPFSPSLPRLSHSPTPVKQQSTKLQAETVTDRIATHLPSCFASLISLASRHNSSAQKLMQILSVLEAWQXSAWPDGSKDLLLSVSCSRYSSPSSWVFQWXAIVXSSFRXPDGPWGXXXDLDXP

SEQ ID NO: 185382 - protein, 142 aa, Triticum aestivum
  unsure (1)..(142): unsure at all Xaa locations
  Clone ID: PAT_TA_79800.pep
TPEKGATQGGNHHRSGPPAGARANTTRRKPNXGRMPEIRRHQPPRPPPCCPCSRGGTATAGVPWGRRPSIPHPPRRRTPRGTVAPQPEASSRGTEASPPPPSAKRASLAGLLRRRRGEQRRGESGAAAARVCPSRPLDAARA

SEQ ID NO: 185383 - protein, 93 aa, Triticum aestivum
  Clone ID: PAT_TA_79801.pep
NILGTHTGRVPRMICFCYCSVASLTAPLMALFSARRGTSETPRKDLHQVFHFIYRQQEHLHPHPTYSNSYIVSKNIYLNCYMKSSQFPIWSIS

SEQ ID NO: 185384 - protein, 137 aa, Triticum aestivum
  unsure (1)..(137): unsure at all Xaa locations
  Clone ID: PAT_TA_79802.pep
AKPSIPNRSTMXRTLPAGKPPXRATQPXEPAXPSPKXRMXDXQLPERKXXVSPSAGPXNKXNXEDQIAAGRARXETSGLXLSRSSMXGYPADXAPGXGQTXTGRDPXXRSKXSGRXAQIIXGRPDXPXLXWSXQEXK

SEQ ID NO: 185385 - protein, 63 aa, Triticum aestivum
  Clone ID: PAT_TA_79803.pep
RTPQVSGFKMRQMHNVMQLISTYFPFEATLCQLTRKKRGDKTYLKMLNTRISHDSDSDSLPVK

SEQ ID NO: 185386 - protein, 205 aa, Triticum aestivum
  unsure (1)..(205): unsure at all Xaa locations
  Clone ID: PAT_TA_79804.pep
SPHYSSSQPQVTATTKNTTRTQEHAETDTHDLQRLGGDGGGPRVHDPLRRPLRRPVAQHCHRRAAASAAAAVRGQGDLAGAGAQAPWSPRCCTSSPGTPRRRRTSSRRPRTXRCAGRARWTAASACEFFGTGXKEQGPVAGXNWTAPKGXLAGNXGXGXQKAGEREKEXKXXPGASREXPRWGKFGQPEXPPTXXPPPWXVLXRD

SEQ ID NO: 185387 - protein, 116 aa, Triticum aestivum
  Clone ID: PAT_TA_79805.pep
GKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTP

SEQ ID NO: 185388 - protein, 195 aa, Triticum aestivum
  unsure (1)..(195): unsure at all Xaa locations
  Clone ID: PAT_TA_79806.pep
VIDLQQIRAIDMEARTDRQPPSGDPPPGQPRWVLLQGNMICEDPAARATTPIASDDLDAETVADALTSGGRNVRVSFHLAAPPAVSRLRVDIPGLPDGTQLLAEIIAANADSVLKRGRRPADPAGLILTNATRLDYFVYNGXGRRRRTPPARPFAVVCCPLTKRGHPRWKPTYXCXKTTGXPAPRXTRNLXRXAX

SEQ ID NO: 185389 - protein, 117 aa, Triticum aestivum
  unsure (1)..(117): unsure at all Xaa locations
  Clone ID: PAT_TA_79807.pep
XTGAPPFGQXQGXXGRXXGTXXLCFNXELPGXSHTFXEXXLHCCSHQMHIPGVQGLPVPARLPPQLGEXFQLSSSSSSLPFYNFLXIGPVHRERAPSERRADVSEGEIDLELKLWKG

SEQ ID NO: 185390 - protein, 179 aa, Triticum aestivum
  unsure (1)..(179): unsure at all Xaa locations
  Clone ID: PAT_TA_79808.pep
RGEPRTRRPSMDLPGASLRAPPPRGLGALAVSADAVRLSTITAILRDRDHYEVTVCTDPAAAMAVLRAGNKFEVLLVDMHSLXCGAPALXALGVCRRRNARSHTCYFEKWRXLWTPKDEGXRYYQECHLQMKQPXGLKXTGRPMPNNSMQQLNRXGQXPTTTTLINFKEXGXTXKEDXE

SEQ ID NO: 185391 - protein, 155 aa, Triticum aestivum
  unsure (1)..(155): unsure at all Xaa locations
  Clone ID: PAT_TA_79809.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREXHNASPGYYDGRYWTMWKLPKFGCTDATQVXNEVEXVKERXPDXISATSGFNKMR

SEQ ID NO: 185392 - protein, 81 aa, Triticum aestivum
  unsure (1)..(81): unsure at all Xaa locations
  Clone ID: PAT_TA_79810.pep
MQIFVKTLTGKTITLEVESSDTIDNVKAKIQDKEGIPPDQQRLIFXAGKQLEEGRTLGDYNIQKESTLHLVLRLRGGTRGG

SEQ ID NO: 185393 - protein, 128 aa, Triticum aestivum
  unsure (1)..(128): unsure at all Xaa locations
  Clone ID: PAT_TA_79811.pep
LIILVLFQVGSHPVLPFPDVCAWQLFSSARRVSATSICVFVSAQLLFEKKGIARQLWFENICSMCLAALGNARKLFLHFYIYLKKNVXRLHGKEVKLNQMYXPFEXLTKTNPHXESVPLPGXXMNINC

SEQ ID NO: 185394 - protein, 156 aa, Triticum aestivum
  unsure (1)..(156): unsure at all Xaa locations
  Clone ID: PAT_TA_79812.pep
MASAVACKGKVPVPASLLKSGAPVAFCALQSPAVTAARRPYNTQFKVKEVSRYDXDDDDYXAGRDLVIPSFFSQXDVARPARXAEPAMERLLSLMEGRPNLKTGPLLPLLGGVXGSGRLGWAKGGTNXRGSNLKVPDRGLDQELWRLPPGKILGWI

SEQ ID NO: 185395 - protein, 62 aa, Triticum aestivum
  unsure (1)..(62): unsure at all Xaa locations
  Clone ID: PAT_TA_79813.pep
QGIXSGIVRXXXSHWAKCFVCNGECGRXTFCXILXCVXXQLHFKLSKKKKKNSRLVLSLSLS

SEQ ID NO: 185396 - protein, 91 aa, Triticum aestivum
  unsure (1)..(91): unsure at all Xaa locations
  Clone ID: PAT_TA_79814.pep
MQSLGHPTSASELRALAWTTLLVPMCAVYARSACRRLRPGWPRLAAILPTLPVFIYLPCLFNSYHLRLFSTFFHTWLAXKKLXXLXFELXP

SEQ ID NO: 185397 - protein, 129 aa, Triticum aestivum
  Clone ID: PAT_TA_79815.pep
MELRSRRCPSEQPSGGPDCISVLPDDLLLLILARLGCAGAAARTGVLSRRWRGLWPRLRQIVFRDVPYASLEAALGGVSRPPPPVSLLEFRVPDKRLPGHRKPDSRRSTRCLARNGGSKPEALVVALPT

SEQ ID NO: 185398 - protein, 80 aa, Triticum aestivum
  unsure (1)..(80): unsure at all Xaa locations
  Clone ID: PAT_TA_79816.pep
TTQLTTGTMTIEVXVGSLLSSRTMMIXRCNITSANTRPFPSKHQGQGRLSSFRVXGPCPPRPLPSQKMLTTLSRRFSRKR

SEQ ID NO: 185399 - protein, 126 aa, Triticum aestivum
  unsure (1)..(126): unsure at all Xaa locations
  Clone ID: PAT_TA_79817.pep
MASKVELVVEVKSPAEKLWTAIRESTELFPKIFPEQYKSIETVEGDGKSAGTVRLIKYXXGFPMVSVKAWWAKLVNFYKELQGDASYRQRAPGGRPVGLGHGPSKGRTRWPEAGPSSGEPARTLPT

SEQ ID NO: 185400 - protein, 105 aa, Triticum aestivum
  Clone ID: PAT_TA_79818.pep
MSGRGKGGKGLGKGGAKRHRKVLRDNIQGITKPAIRRLARRGGVKRISGLIYEETRGVLKIFLENVIRDAVTYTEHARRKTVTAMDVVLRAQSAKEATLLRISAG

SEQ ID NO: 185401 - protein, 115 aa, Triticum aestivum
  Clone ID: PAT_TA_79819.pep
PRAELEREDLISPGSQAMDCPLCKNPPAVCGDLDGPPCHISVPMTTFYWVEAFVPCCNRRVIGSCIEHMRSIAAKENKPMCSTIFVTRELLEYEVLIDHGAKKTRIQGDGWHKFP

SEQ ID NO: 185402 - protein, 82 aa, Triticum aestivum
  Clone ID: PAT_TA_79820.pep
MRECISIHIGQAGIQVGNACWELYCLEHGIQPDGQMPGDKTVGGGDDAFNTFFSETGAGKHVPRAVFVDLEPTVIDEVRTGA

SEQ ID NO: 185403 - protein, 61 aa, Triticum aestivum
  Clone ID: PAT_TA_79821.pep
SGQRTPKINYTRSHGNIYSILCDTSRRNHILEHHRHIYKTSRASNSKSGICMPKKLETSSP

SEQ ID NO: 185404 - protein, 118 aa, Triticum aestivum
  unsure (1)..(118): unsure at all Xaa locations
  Clone ID: PAT_TA_79822.pep
XGPRRTEVWRXXXGGGXGNRAXWXHPGSGAGXAXGAPTVRRPGERCXRNPVGGPPXRWGPAMXXGAXVPHRAGDGGGRGLGKRRQQRRHAAASRLGDWIGGGLVEERRWPEMAEAGRA

SEQ ID NO: 185405 - protein, 111 aa, Triticum aestivum
  Clone ID: PAT_TA_79823.pep
MRYAAERSPAGVQKPNTGRFNVLVHVGGAIYVVYKHIYMGGGDRALLPSSITILAVGVAKYVERVLALWQGNLGNIRSSSKKKKKKKRQRRRYTDGSGSAKRNGAGQMSKP

SEQ ID NO: 185406 - protein, 54 aa, Triticum aestivum
  Clone ID: PAT_TA_79824.pep
GGYTRGPWVTTPLLLLATGLQSSTCLRSDLELNCALLCCGPYALCPPMSFKIQD

SEQ ID NO: 185407 - protein, 87 aa, Triticum aestivum
  unsure (1)..(87): unsure at all Xaa locations
  Clone ID: PAT_TA_79825.pep
MGKEKTHINIVVIGHVDSGXSTTTGHLIYXLGGIDKRVIERFEKEAAEMNKRSFKYAWVLDKLERPSVRGVSTLIFALWEIXRTTXY

SEQ ID NO: 185408 - protein, 158 aa, Triticum aestivum
  unsure (1)..(158): unsure at all Xaa locations
  Clone ID: PAT_TA_79826.pep
AKRRRRRLPSSRRSRRMRARRMWLYRRALHLRRLINGTLRGSLLFQLRPRPRHRRRRGFGVPGGSCPTPTALPRADAAGSWPVEEELDADCSSAWSCSPPTRPCEGRGDGSTAPSSSDVLLLVPWRSNPTLAPCPLFQGTGTATTNLXTNLKQXITEX

SEQ ID NO: 185409 - protein, 127 aa, Triticum aestivum
  Clone ID: PAT_TA_79827.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRNLYGFRRLSRGPNRSTRQAARPNRLLVGILI

SEQ ID NO: 185410 - protein, 107 aa, Triticum aestivum
  unsure (1)..(107): unsure at all Xaa locations
  Clone ID: PAT_TA_79828.pep
NPTRAGRPVNRGSSAARFGRAWRXSRITLHRXRQHVEQFVLXELAYXEAKGRMRKGDRVWXIGXXAPGFKCNSAAWECIHPAPVAADGPWATCVHRYPIDVPDVLKH

SEQ ID NO: 185411 - protein, 147 aa, Triticum aestivum
  Clone ID: PAT_TA_79829.pep
TPIVMPCSPAENKASNMTEGTFRKIREELMRGYVLTKDLGSHDFEWAWIFEPFPYSTTYEQFLRIALCAPTSEELHDWTGWVKSRFPYLILKLEDNGIECDPNSSQEVDHTVIKPNIGYHWGPPSLKSNPSWISSLKFIICSIFWEK

SEQ ID NO: 185412 - protein, 60 aa, Triticum aestivum
  unsure (1)..(60): unsure at all Xaa locations
  Clone ID: PAT_TA_79830.pep
PRXXFXYAWXGCGLLETCXLTILTSLLFICQASNHXSEXCHPVPSAXFKFSCLGGKMCPP

SEQ ID NO: 185413 - protein, 34 aa, Triticum aestivum
  Clone ID: PAT_TA_79831.pep
FFFFFFFFFFFFFFFFFFFFFFFFFFFNFNNKTF

SEQ ID NO: 185414 - protein, 146 aa, Triticum aestivum
  unsure (1)..(146): unsure at all Xaa locations
  Clone ID: PAT_TA_79832.pep
QKNKKKKPHPQPPDPHLPRALRHRPRPPPPTGRVHRAAVTSPDDLRPYAPRHPHKPRLPLALRAAPPPXAPTTPGPARRAAATPPPRATMVPTRPPPSRRRHLRRASARARLRSGPLHLDSLARRFLRAGDLAPLETFPTSLRQRG

SEQ ID NO: 185415 - protein, 60 aa, Triticum aestivum
  unsure (1)..(60): unsure at all Xaa locations
  Clone ID: PAT_TA_79833.pep
WRRRXGGTGXXWPRRGRPRSSXTRRXAMHSSSXLINXNEPXRTEPDREPRTEWGGETNPC

SEQ ID NO: 185416 - protein, 152 aa, Triticum aestivum
  unsure (1)..(152): unsure at all Xaa locations
  Clone ID: PAT_TA_79834.pep
MASRTAGRGGRPLLGGSAGGGRRGKPSKAIMAALLLASVALLLLLALGALSLPAGSGRGAVLSLPRPRFRKXRVRVEAGXXRGKKGEPWTEVLXWEPXAFIXXNFLSKEXECQYLISLXAKPHMXKXSTVGXFLATGGSKNIKVXNKFKEFL

SEQ ID NO: 185417 - protein, 123 aa, Triticum aestivum
  unsure (1)..(123): unsure at all Xaa locations
  Clone ID: PAT_TA_79835.pep
ASDQPEPLFIRPSAWRYSNAYAQNRKPSLTEAEQDGNVWRVCFSNHSXXNELEQALQLLQPQWVISTTPPNFASELSYVRRRYLSHTTQGHAQSSICFRTTSRGKEDYEYFIRGIPSRGAEKP

SEQ ID NO: 185418 - protein, 83 aa, Triticum aestivum
  unsure (1)..(83): unsure at all Xaa locations
  Clone ID: PAT_TA_79836.pep
KKKEXRLKGXGAREPNRSSRHXXSXVPQXRVPVXAVAPXPGGDRRPXPPPRPGGPSLPVXXRPRGASSRRGRXPWXPXTKWGK

SEQ ID NO: 185419 - protein, 156 aa, Triticum aestivum
  unsure (1)..(156): unsure at all Xaa locations
  Clone ID: PAT_TA_79837.pep
XXNLXNXAPXDFFPVAPGQKGRPXRRPXPGGSPPQXTPIWRMPXTXKARRSGGQLHLPSTEGGTEXTIAXXAPSRWXXGXRPGEAPGRLXGGDGGGRGSRXEFPHXRPRREVTRSSXYGLGTYRRVNDRCCCGVEPEEMASRWAVRRVKNQLLPAC

SEQ ID NO: 185420 - protein, 119 aa, Triticum aestivum
  Clone ID: PAT_TA_79838.pep
MACIKSAQRAALTALAPEAPYLAAGTMSGAVDMQFSASANIEIFSLDFQSDSPDLPLLAAVPSPDRFNRLCWSRPGAADGDSFSLGLLAGGLSDGSVAVWNPLSMIQLRGGKREDSWQA

SEQ ID NO: 185421 - protein, 153 aa, Triticum aestivum
  unsure (1)..(153): unsure at all Xaa locations
  Clone ID: PAT_TA_79839.pep
MAEKEPMRVLVTGAAGQIGYALVPMIAXGVMLGADQPVILHMLDIEFAAEALKGVKMELIDAAFPLLKGVVATTDVVEACTGVNVAVMVGGFPXXEGMEXEDVXTKNVSIYKAQASALXXQCNPPISVLGCQTQANNWLPRFPLSLKKWTPKI

SEQ ID NO: 185422 - protein, 101 aa, Triticum aestivum
  unsure (1)..(101): unsure at all Xaa locations
  Clone ID: PAT_TA_79840.pep
MSGRKKTREPKEENVTLGPAVREGEHVFGVAHIFASFNDTFIHVTDLSGRETLVRITGGMKVKADRDESTPYAAMLASQGCXCKMLGALGFTGSAKLNSRC

SEQ ID NO: 185423 - protein, 119 aa, Triticum aestivum
  unsure (1)..(119): unsure at all Xaa locations
  Clone ID: PAT_TA_79841.pep
MADVEYRCFVGGLAWATDDQSLQNAFSKYGDVIDSKIITDRETGRSRGFGFVTFASDEAMRQAIEAMNGQDLXGRNITVNEAQSXAAPGGGGGGFXXXRRAAATAGQLKKAGLKLGGGC

SEQ ID NO: 185424 - protein, 65 aa, Triticum aestivum
  unsure (1)..(65): unsure at all Xaa locations
  Clone ID: PAT_TA_79842.pep
ASCRIRHEGSQFFICTVPCNWLDGKHVVFGEVVEGMDVVKNIEKXVGSRSGTCSKQVVIADCGQL

SEQ ID NO: 185425 - protein, 57 aa, Triticum aestivum
  unsure (1)..(57): unsure at all Xaa locations
  Clone ID: PAT_TA_79843.pep
IXNPSFANNPXCFLIXLFXVSQVMEMKKIACXVLIAASXTVALAXDXPXLXXMXSXS

SEQ ID NO: 185426 - protein, 163 aa, Triticum aestivum
  unsure (1)..(163): unsure at all Xaa locations
  Clone ID: PAT_TA_79844.pep
AFLVNFDKHQSPTVVFRNMSFQLAPKSISILSECRTVVFETAKVTAQYGSRTAKAVXSTNDIHRWKAFKEPIPEDISKAAYTGNQLFEHLSMTKDXQDYLWYIVSYXYRPSDDGSLCFLNVESTTCMQCLLSTTEYVREWCMGVNGGNIILNEYFKGGNTISI

SEQ ID NO: 185427 - protein, 165 aa, Triticum aestivum
  unsure (1)..(165): unsure at all Xaa locations
  Clone ID: PAT_TA_79845.pep
MAPSESQHLALFLAIVITAATLFPSAAAVPAKAPAPSASNDAVAKPLAWCMIPCLPILPPILCVPPIFCPPTPSAPPPPSPFKPHPKECLPSLMGLMPCKGFXSXXSTAPKPPRQGKCCDGRPGHSSKKFSQSAFLQRCLNGGTLKKNGNRIGGNSFGPLRLLTS

SEQ ID NO: 185428 - protein, 100 aa, Triticum aestivum
  unsure (1)..(100): unsure at all Xaa locations
  Clone ID: PAT_TA_79846.pep
PPHRTHETRQEAETLRTHARTQTRGWHAPAPRPXRAAAAXLLLLALVATGPPRGXPXRLAGIXXIVXGXSPAASGAQPXGXXTXFXWGRVAXTKXHIXXP

SEQ ID NO: 185429 - protein, 151 aa, Triticum aestivum
  Clone ID: PAT_TA_79847.pep
ASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEGGGQSKQHHQPVHNQPSSSTARRNALRAARGA

SEQ ID NO: 185430 - protein, 116 aa, Triticum aestivum
  unsure (1)..(116): unsure at all Xaa locations
  Clone ID: PAT_TA_79848.pep
ASSCSWTRGRDASIYAFQFTCVGNLILRIRHASAAGCPNDLLSFDWKNVFCTFYLHFSSSSVSTKRLPLLLYLLIARSRILSGHHNTISYLQNFHPDDDGPFGIPAKAWKLLCXAQ

SEQ ID NO: 185431 - protein, 148 aa, Triticum aestivum
  unsure (1)..(148): unsure at all Xaa locations
  Clone ID: PAT_TA_79849.pep
SVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAATATEPAPRRPAGKGEHXDXEGQSKQSTSTSFNPSVIITKPPQARGARA

SEQ ID NO: 185432 - protein, 181 aa, Triticum aestivum
  unsure (1)..(181): unsure at all Xaa locations
  Clone ID: PAT_TA_79850.pep
RERERELRLYVDDKLHESCPFEFPRVLKPLAFCCIGTNPPPTITGLQRQCPLFAEMGPIYIFMEPIGPERMARLASRGGDALPSFSSGAGLPWXASCDHIREMSEDSYTLDIEIGGSLHLLYHPXPYLTGRFCPDASTFWVQQVLNRRPAGIYWDGSKYCPVRTCKNQLGQLTLLEGPNGY

SEQ ID NO: 185433 - protein, 109 aa, Triticum aestivum
  unsure (1)..(109): unsure at all Xaa locations
  Clone ID: PAT_TA_79851.pep
SPLQIPTYVPRVLQPRPQSHKHSSSSSQPVRASTSAPSGFQQPWRRRPPSSWGSAWSSSSPWPTRCGDSCPTPTPAXPTPTPSHSKCPKNALKLAACAERPGRSGRVRA

SEQ ID NO: 185434 - protein, 103 aa, Triticum aestivum
  unsure (1)..(103): unsure at all Xaa locations
  Clone ID: PAT_TA_79852.pep
MWVEILCGLVAYKLIRAVFFSDDGLDQARXLDSSHSDLCFAVAXRLERLYXGRCFVGLRIPDPEAGARXHVERFRQQRGKSWGGIKKCLWLLKVEKGWTGFTK

SEQ ID NO: 185435 - protein, 192 aa, Triticum aestivum
  unsure (1)..(192): unsure at all Xaa locations
  Clone ID: PAT_TA_79853.pep
PNXGGXXPGSRGGPPGPILSLLGXRCRGGXFXPSFLPXXLSXGSFXALQXINHPTGGCPESANGVPARXAPARPPLVGGRGGQLFLRLPAPADCDRRSACSRTSLPPPPPFSSVPPALSSLSLCGCRAGNGPKSLEGGGRSQLRSRSAHGGRPRRRLWCWSAAAGAAISSIPSTTEAPWSGEERGVWWRWIG

SEQ ID NO: 185436 - protein, 128 aa, Triticum aestivum
  unsure (1)..(128): unsure at all Xaa locations
  Clone ID: PAT_TA_79854.pep
APPLLLPPAPTFHFRQSLPGIPPHQSPNPRPRXRRLSELAAXILSTPPWAASSRASAAAPTRPAGPSTIRSCARPGSGTPSWTTTTTTARRSLRRSRTPEGGVSGTTGRVXGXXXAEXEIXXFVXGKY

SEQ ID NO: 185437 - protein, 112 aa, Triticum aestivum
  unsure (1)..(112): unsure at all Xaa locations
  Clone ID: PAT_TA_79855.pep
MGKEKTHINIVVIGHVDSGKSTTTGHLIYKLGGIDKRVIXRFXKEAAEMNKRSFKYAWVLDKLKAERERGITIDIALWKFETTKXYYCTVXDAPGXPLTSSRNNDYLGTSQG

SEQ ID NO: 185438 - protein, 130 aa, Triticum aestivum
  unsure (1)..(130): unsure at all Xaa locations
  Clone ID: PAT_TA_79856.pep
MAASMITSPIVAPTXLPSLSRRGSSFAVVCNGGKKXKVDKPLGLGXXLTVDIDAXGRXXAKKGVXQFVXKVRGQSXTGKSQSKTPEKGLNXVNATPXGTTGXLIXGVNLXXLLRGGGSSKKTNGPGNKLF

SEQ ID NO: 185439 - protein, 136 aa, Triticum aestivum
  unsure (1)..(136): unsure at all Xaa locations
  Clone ID: PAT_TA_79857.pep
ISYSLFDGTCYSDNRSNSRANTCNKPRLLGGAHLLDKRLTRALLADPIIHDNSTDRTXFVPXTXHSNFCPINFXWXDKGLTWWLPGDGXNXGPIPGXGSLRKRLTXSKGXXQGXPKLPNPEXGEGVDNKXKKPGAL

SEQ ID NO: 185440 - protein, 173 aa, Triticum aestivum
  Clone ID: PAT_TA_79858.pep
GESEEAATSAIDGRHREPAVGLLYTSGARARADRRNGSARVPRPTRRQRAALLRRHRRRHRPRRRRPRPPRSEPALQPHPPRRLAEPLQRRLHRARRRRGGELRRRPARRGARPAVLHQAKGGQGAAGRLAWGEAKVLGSLLQRLGGPPKEPRFSTWGSTIPGPLERKKTMFL

SEQ ID NO: 185441 - protein, 145 aa, Triticum aestivum
  unsure (1)..(145): unsure at all Xaa locations
  Clone ID: PAT_TA_79859.pep
LQPVLPRRRPVXXXRQQARPPPSPPRPPPARPLPRPPWSLSRPRLAPLALWAPRPPARPQLLARSPWPPPSQRRPAPPPWSPQPRRGQTPRPRPPPARGPPPSSGPPRRPPASPPRAPPPSARPSGSGHQRWPLPSWMQENARSG

SEQ ID NO: 185442 - protein, 125 aa, Triticum aestivum
  unsure (1)..(125): unsure at all Xaa locations
  Clone ID: PAT_TA_79860.pep
FRRPARPPXXGCSPPCRDPGPSRRGSGRPPPRPLRSPPPPTPSPPLGSTAAAPPPAPPRRPPPEKRRGITGGGGAMPTPTPAQQRVAQLEEELKKERGDKDRVVQLEEELRSEREDKARAVEELR

SEQ ID NO: 185443 - protein, 62 aa, Triticum aestivum
  Clone ID: PAT_TA_79861.pep
GRVGFRRRRPGSGRTSRASPPSSSSSPSGTRSASSRRPPARPRPSRRRPSYGRTPRTSPRTW

SEQ ID NO: 185444 - protein, 92 aa, Triticum aestivum
  unsure (1)..(92): unsure at all Xaa locations
  Clone ID: PAT_TA_79862.pep
FFLGXPRNPKRPPGGFRTHQNRAYPPLXGGVADPLGIWKNLIPLALGFFWPPGDKKWXETPGFPPLADPGKSGKNAPRXYSPRAGTRLGGPP

SEQ ID NO: 185445 - protein, 77 aa, Triticum aestivum
  unsure (1)..(77): unsure at all Xaa locations
  Clone ID: PAT_TA_79863.pep
XXMKVLRRFFQTASTRSNNMNNIIVQLYMGSSTSGLSSGKLAFPDRGTLFEFFLLLCFPYTPLEVLGSKEKENNLEW

SEQ ID NO: 185446 - protein, 132 aa, Triticum aestivum
  Clone ID: PAT_TA_79864.pep
RGDGRPAGAGRAAACARPRRAGTRRSPAPRSPAAAAPSPCPPAPPPRRRTSAPPPPPRSLPQAAAFPVAVAARTRRARRASCPGPGGGSWWRGRRPGTQGRRRRPATAPARPRPSSSAPAPSPRPSIGWPRC

SEQ ID NO: 185447 - protein, 63 aa, Triticum aestivum
  Clone ID: PAT_TA_79865.pep
MLDHVGYNLIECSQFIYHSKTVPLTPNISIVSCSRQNIRDLGTEEVDGNYGHQRGIYLITYSI

SEQ ID NO: 185448 - protein, 89 aa, Triticum aestivum
  unsure (1)..(89): unsure at all Xaa locations
  Clone ID: PAT_TA_79866.pep
HEGARKRKPTPXXSGQPNPMPPPXPPSRSPPPPCPTPPHTPPRPPTPSPPPPPSSTTTSPVSPRASXXRAPRSPXXARRGPTXPLPXXS

SEQ ID NO: 185449 - protein, 163 aa, Triticum aestivum
  unsure (1)..(163): unsure at all Xaa locations
  Clone ID: PAT_TA_79867.pep
FAILRTQWSTSHLIFLFFRFLVYEYMENGSLKDHLHSSGTKALSWQTRLQIAMDVANALEYLHFFCNPPLCHRDIKSSNILLDENFVAKVADFGLAHASRTGAISFEAVNTDIRGTPGYMDPEYVVTQELTEKSDIYSYGVVLLELVTGRRAXXDKKNLVEWA

SEQ ID NO: 185450 - protein, 123 aa, Triticum aestivum
  unsure (1)..(123): unsure at all Xaa locations
  Clone ID: PAT_TA_79868.pep
MMGADALLRQEPWFVSLAILGALYTAXVVLRLLSNLALLLRRARDLRRRYGXWAVVTGPTSGIXQSMALELARLGLNLVLVGRDPAKLKXISETISKTRAVQTXTVVFDLALVATPQGDAVRR

SEQ ID NO: 185451 - protein, 142 aa, Triticum aestivum
  Clone ID: PAT_TA_79869.pep
QAELLFERNGVPIGRQAFSKWLYVVPWGFYKAVMHVKNKFRDPLILIGENGIDQSGSDTLPHALYDTFRIDYFDQYLHELKRAIADGARVTGYFAWSLLDNFEWRMGFTSKFGLVYVDRKTFTRYPKDSTRWFRKVIKSEEY

SEQ ID NO: 185452 - protein, 85 aa, Triticum aestivum
  unsure (1)..(85): unsure at all Xaa locations
  Clone ID: PAT_TA_79870.pep
XPDSMHINQGAKQVQRYKVLTTQQVVKQTPQSKRSNRQITDKATRADHRIAVASLGKAPGGRLNTHRPHHRPHPRPPHPHLRRLD

SEQ ID NO: 185453 - protein, 54 aa, Triticum aestivum
  Clone ID: PAT_TA_79871.pep
KLSKHMPISQNTTNILFRLSLVRALVIAQSLHRSFHQHTIIYTTNILLTSSLPG

SEQ ID NO: 185454 - protein, 137 aa, Triticum aestivum
  Clone ID: PAT_TA_79872.pep
MARTKQTARKSTGGKAPRKQLATTIAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 185455 - protein, 37 aa, Triticum aestivum
  unsure (1)..(37): unsure at all Xaa locations
  Clone ID: PAT_TA_79873.pep
ALTTSLSVEFLVVLIDHLCDIYLSYPWQXXILVPXXX

SEQ ID NO: 185456 - protein, 172 aa, Triticum aestivum
  Clone ID: PAT_TA_79874.pep
EQLLSYYKINKDSKIIINPRLRGGCAGHNWDYVISDLDPYQRVPLPGDLLLPEQAIIQPQMEVKYLARLLQVRCKKVLIYLCRKHFSGHSFGGNFSSQQIMFDTDGNVRIDAAPEEYSRPSALLDYNAVSVIFDRALGDAADKYPMDFHHLIAFLSAKGPNVDCQSKAVIAF

SEQ ID NO: 185457 - protein, 65 aa, Triticum aestivum
  Clone ID: PAT_TA_79875.pep
PSSPRPAGPPPYPASVGPPRFSAPRPRRRWRAGGARPPPSTLQSPPLSPPAPPSSPHWTLTVRAP

SEQ ID NO: 185458 - protein, 77 aa, Triticum aestivum
  Clone ID: PAT_TA_79876.pep
KGKDEALTRQSCSSTISELLQCLQSMMMKDSFRSYTRCLAIVARVHSLQHQYFLRDLVSLCHKEYRSVKLVDVFQKI

SEQ ID NO: 185459 - protein, 68 aa, Triticum aestivum
  unsure (1)..(68): unsure at all Xaa locations
  Clone ID: PAT_TA_79877.pep
MTYMYPNYIPIPAPNNVSSHRYGLFLYHEGXKKIDFEEQIRKLPSSAATSQREVSDQISLQPFPIHLI

SEQ ID NO: 185460 - protein, 73 aa, Triticum aestivum
  Clone ID: PAT_TA_79878.pep
IMENVECIFWSTSHKKASLWNLFIAWQVPCLATWQNYEIFRLVTWPNLCIPGDGKFMHIRCTKNMEKLCILFH

SEQ ID NO: 185461 - protein, 50 aa, Triticum aestivum
  Clone ID: PAT_TA_79879.pep
GHSALPEHTRSSATSACHQLLQLLHAINESVDCFLEIYPPQLNLGVFFVS

SEQ ID NO: 185462 - protein, 155 aa, Triticum aestivum
  unsure (1)..(155): unsure at all Xaa locations
  Clone ID: PAT_TA_79880.pep
HEGNSIKLIPTTPAAPPTAQGSEQSRRWTEPWRPDTVANVHSGTDSTNKTLLKSDALYTYILDTTVFPREHECMRDLRLITDRHPKGFMQSSSDEAQLLGMLVKMAGAKKTIEVGVFTGYSLLATALALPEDGKVLAIDTDRDCYXXGXPSSRGA

SEQ ID NO: 185463 - protein, 130 aa, Triticum aestivum
  unsure (1)..(130): unsure at all Xaa locations
  Clone ID: PAT_TA_79881.pep
XXECISLICRGKKKRKMRACQCTVVYQKKLVSGVILSSGACLPWAREARPTLDHWQRAPAAVVPADAFFFFSAATTPAARRRCEGKRTRSAPSARYRARDVASATSSVARASAHPHKNQGRMVIMFGRSL

SEQ ID NO: 185464 - protein, 175 aa, Triticum aestivum
  unsure (1)..(175): unsure at all Xaa locations
  Clone ID: PAT_TA_79882.pep
ARGPSVFWDEEIDTFGCLNKESSKRGEFFLFYSYHTVSGGAVLVALVAGEAALEFEKIDPVVTLHRVLGILRGIYGPKGVTVPDPIQSACTRWGSDPLCCGSYSHIRVGSSGTDYDILAESVSEDRLFFAGEATNRAYPATMHGALLSGLRXPEFSGLHKAEWIPIIKSMLCRKA

SEQ ID NO: 185465 - protein, 92 aa, Triticum aestivum
  Clone ID: PAT_TA_79883.pep
LPGVFHIFPFVASHGSTLLMVTPNHIRFRSLQAQVSFHSFLHHISTIIHDASGQLSTHQGFVYKDHSAKYKSVRKKGEFMAHSILVNLFTHM

SEQ ID NO: 185466 - protein, 145 aa, Triticum aestivum
  Clone ID: PAT_TA_79884.pep
MAVTFSDLHTADGLKALEAHLAGKTYISGDGITKDDVKVFAAVPVKPSAEFPNAARWYDTVAAAVASRFPGQSSGVSASSAPAAAAPAASKDEDDDDDMDLFGDETEEDKKAAAEREAAKPAKKKESGKSSVLMDIKPWDDETDM

SEQ ID NO: 185467 - protein, 105 aa, Triticum aestivum
  Clone ID: PAT_TA_79885.pep
NNGCNNDTANFDAEANQASTGTRGGVMTYDTSRCGNSWQKGHRGRNQILFWRSERSLEDQNGRPTVWRLHWPVPCTSETPPCVSSHPSDQRPTEPLPPPVQTRSQ

SEQ ID NO: 185468 - protein, 115 aa, Triticum aestivum
  Clone ID: PAT_TA_79886.pep
SGEAVAALKAAAADACRALVDNFGDIRSLKTVYDVEDYHIGMPFGVLIACIGCYQLWKLDPSTFLDVVLGYAFYRLSVLGSHIRRQGFSNDLFGRLKFVIVIIMAVKDSGKSRSH

SEQ ID NO: 185469 - protein, 154 aa, Triticum aestivum
  unsure (1)..(154): unsure at all Xaa locations
  Clone ID: PAT_TA_79887.pep
XKKKQRRIVHAHACMQAXXCHQXXAAPSSPXXPSSQQQQPRPNEQRQTTPRQSVVEVVGEEGDDERDWGGHGGGGRGAAGGGARGAAGGAGGTGGRLGGEHRGRRGGDNKSGEEHLLHLHRLGTYGRRGGGRPGEQGSGRFIPLRPSSERDRVY

SEQ ID NO: 185470 - protein, 88 aa, Triticum aestivum
  Clone ID: PAT_TA_79888.pep
MGSTEAPTPVQAPVCSIVNEGPPAPAACSIVNEAPAPATDSKPKKKICCACPDTKRLRDECIVEYGESACTKWIEAHKQCLRAEGFKV

SEQ ID NO: 185471 - protein, 133 aa, Triticum aestivum
  Clone ID: PAT_TA_79889.pep
PNDLHVPILRLLFQAPRRPLIHQRDHAATSARRHGRPQLVALLSMAAAAGFATSMLCFFRNQPMYLLSPTHPKSATTLVFAGTGEPFCYNRFGFCYYRCFVHLCYIHLHDIAVFPVVFCYNHVMILLEPKKKK

SEQ ID NO: 185472 - protein, 96 aa, Triticum aestivum
  unsure (1)..(96): unsure at all Xaa locations
  Clone ID: PAT_TA_79890.pep
MKRVGTNTAAVKATAGAGDRGEQHKATSKTQAQKVARQQALLAFLKAGFEDYKLYRDREDEEEVEEYRRAGKLHTYDPDKEPKKRXXRVAKXXXPL

SEQ ID NO: 185473 - protein, 87 aa, Triticum aestivum
  unsure (1)..(87): unsure at all Xaa locations
  Clone ID: PAT_TA_79891.pep
ARLKXXNMQFEELRAKQSLWTIPXXELRETLXXSIAEXLLPAYMSFVKRFGNLVENEKKPRKYLKYQPDELDQLLGQFFEGQQSQKK

SEQ ID NO: 185474 - protein, 62 aa, Triticum aestivum
  unsure (1)..(62): unsure at all Xaa locations
  Clone ID: PAT_TA_79892.pep
GXXFKSISSKXXIVEPPIMLXKLRGTDXXIRQSDPLLRSRVILCGCSXXQRPPRDVLAWASC

SEQ ID NO: 185475 - protein, 100 aa, Triticum aestivum
  unsure (1)..(100): unsure at all Xaa locations
  Clone ID: PAT_TA_79893.pep
HMDGTPARTRRRRRRRQGISPSARLMEDDYAAPHLPMDIMYKIPTHISDPASLARLASSSKFWRSLIKDPTFLDXXRRRHRDHGFTPXXLXXXXXXDKSP

SEQ ID NO: 185476 - protein, 61 aa, Triticum aestivum
  unsure (1)..(61): unsure at all Xaa locations
  Clone ID: PAT_TA_79894.pep
NXHLDQYXXXXGVPTKDMXXILGLQLHLLHIFNCXKKYKTQCTCDLQEWKSDMSLKRVQHV

SEQ ID NO: 185477 - protein, 102 aa, Triticum aestivum
  unsure (1)..(102): unsure at all Xaa locations
  Clone ID: PAT_TA_79895.pep
IXXTNAHVXSYGQQPLRPDVXNYLFHSLICVVAHCSXXSDLIKEVQQDSMLIIQITKNILIYFRYATSHHQYLVQKRVMYNLCGHPSVCLSFSCHHFSRSSL

SEQ ID NO: 185478 - protein, 59 aa, Triticum aestivum
  unsure (1)..(59): unsure at all Xaa locations
  Clone ID: PAT_TA_79896.pep
ESDPLQGPGDSDPCLPSPRARPAAHPRRPVDCHRRQLGRRGXXRHAAVLAHLPQQALPX

SEQ ID NO: 185479 - protein, 68 aa, Triticum aestivum
  Clone ID: PAT_TA_79897.pep
WYLVSLTDHSFKGVDAFLVVFHQPNRSFIQICLQHSIFIFTEKFCWHQNISFVIIFLMGPNYLFIATS

SEQ ID NO: 185480 - protein, 51 aa, Triticum aestivum
  unsure (1)..(51): unsure at all Xaa locations
  Clone ID: PAT_TA_79898.pep
TNDFLYFRXKLFQLIISNMLLCHLFIXFVSSIXXLFPQNCTTXXYIFXXPX

SEQ ID NO: 185481 - protein, 98 aa, Triticum aestivum
  unsure (1)..(98): unsure at all Xaa locations
  Clone ID: PAT_TA_79899.pep
SSXAXXRRPTASMSHAASTSTSXTPPSSFVSALTKALAEIDATGIKRSRNTRLAWRHGWGRIGTEDEADGKNGGGQAVEAEHHPAAAPRAEFGTRPRA

SEQ ID NO: 185482 - protein, 71 aa, Triticum aestivum
  unsure (1)..(71): unsure at all Xaa locations
  Clone ID: PAT_TA_79900.pep
XTXXTQHRYIXETDDTVXXRMYXARGXRLSIXXFQTERVYCSNLIASARPTGNYGIMHRRKREGKMPCKLM

SEQ ID NO: 185483 - protein, 82 aa, Triticum aestivum
  unsure (1)..(82): unsure at all Xaa locations
  Clone ID: PAT_TA_79901.pep
FFKHQKEVTAAAAKRVLYNSANRLITAVSANKPDHPRPQHKVSRAPIIHVSSPLLTXXKNXXPFXTIYSSSXSSSSTPXXXP

SEQ ID NO: 185484 - protein, 47 aa, Triticum aestivum
  unsure (1)..(47): unsure at all Xaa locations
  Clone ID: PAT_TA_79902.pep
MARMALLAVFAVLAALAVAEMASGAVTCGDVTSAIAPCMSYATGXXX

SEQ ID NO: 185485 - protein, 90 aa, Triticum aestivum
  unsure (1)..(90): unsure at all Xaa locations
  Clone ID: PAT_TA_79903.pep
SLCSVVGNXXXXVEDEGYHLNEFRQPVQAIHGGGASCSKEGPRRPWSWRPIGHGEGARRPRGARALAAEEDGCRPRTRRAPAAEEGPPRA

SEQ ID NO: 185486 - protein, 58 aa, Triticum aestivum
  unsure (1)..(58): unsure at all Xaa locations
  Clone ID: PAT_TA_79904.pep
HCMLXXFXVXMMSWSVCSLLVQLVXKNCCTSREENTASFAVSVRDVDSGRSTGXNVCS

SEQ ID NO: 185487 - protein, 49 aa, Triticum aestivum
  unsure (1)..(49): unsure at all Xaa locations
  Clone ID: PAT_TA_79905.pep
YVFNMSLLHXXVNSKYGADFIHNMQYMLLXHXXVDTEXSMPNXXXLMQT

SEQ ID NO: 185488 - protein, 39 aa, Triticum aestivum
  Clone ID: PAT_TA_79906.pep
TRPIIAKMYQGVGADMGGMGGEDAPAGGSGAGPKIEEVD

SEQ ID NO: 185489 - protein, 86 aa, Triticum aestivum
  unsure (1)..(86): unsure at all Xaa locations
  Clone ID: PAT_TA_79907.pep
LNKNLTTSLLSTGRQGWIKTATRVFQALRIAVNDELQTLEDALHSCFDCLAPDXRLAVISFHSLEDRIVKQTFLEXIRGDEADDDD

SEQ ID NO: 185490 - protein, 67 aa, Triticum aestivum
  Clone ID: PAT_TA_79908.pep
MTEPPFLPRERLFKQQQYFQSLSKHTHLKGRYDAITSVGIPLALAASSLFMIGRGVYNMSHGIGKKE

SEQ ID NO: 185491 - protein, 71 aa, Triticum aestivum
  unsure (1)..(71): unsure at all Xaa locations
  Clone ID: PAT_TA_79909.pep
XXXXGCAPPEPRCRSFSTRCFAFAFASLSEAXXSAPSPRRSWSCCCLMASHRRILSSFLARSALVTSAQRD

SEQ ID NO: 185492 - protein, 49 aa, Triticum aestivum
  unsure (1)..(49): unsure at all Xaa locations
  Clone ID: PAT_TA_79910.pep
EADXLVXXLPRIAGPEESETIEDKNMNEWKIKSSMHCTYMFLINLETET

SEQ ID NO: 185493 - protein, 78 aa, Triticum aestivum
  unsure (1)..(78): unsure at all Xaa locations
  Clone ID: PAT_TA_79911.pep
MATTAMXLSPSSFAGKAVKDLPSSALFGEARVTMRKTAXKXKPVSSGSPXYXSDRVLYXXXLSGDPPSYLXXXXPXXY

SEQ ID NO: 185494 - protein, 56 aa, Triticum aestivum
  unsure (1)..(56): unsure at all Xaa locations
  Clone ID: PAT_TA_79912.pep
NEWRSRPYEGPRPTGQFPKLSYFQLELVLKLFVTCLNRRICCLKHSVSIDQCMFSX

SEQ ID NO: 185495 - protein, 57 aa, Triticum aestivum
  unsure (1)..(57): unsure at all Xaa locations
  Clone ID: PAT_TA_79913.pep
VLSPLFFSLIIPLCASGLVXTARFCVQLDHPDAFCQVICMPAWICKLTYCSECLPRA

SEQ ID NO: 185496 - protein, 111 aa, Triticum aestivum
  unsure (1)..(111): unsure at all Xaa locations
  Clone ID: PAT_TA_79914.pep
ARGRCGKPWPPLRLPRSSSSSPSSAPPPGSSPAPXPPPPLAPPKPVMPAPTTPPKPVMPAPTTPPKPVMPAPTTPPKPVTPPPVKAPKPVTPPPATPPKPLPPPXATPTKV

SEQ ID NO: 185497 - protein, 83 aa, Triticum aestivum
  unsure (1)..(83): unsure at all Xaa locations
  Clone ID: PAT_TA_79915.pep
DMGSLERMGRELKCPICLSLLRSXVSVTCNXIFCNHCLTESMKSSSTCPVCKVPFRRREIXXAPHMXNLXGILKSXXXAXVVS

SEQ ID NO: 185498 - protein, 71 aa, Triticum aestivum
  unsure (1)..(71): unsure at all Xaa locations
  Clone ID: PAT_TA_79916.pep
MAASALHQTTSFLGTAPRRDDLVRSVGDFGXXITMRRTVKSAPQSIWYXXDRPKYXXXFSEQTPSYLTXXX

SEQ ID NO: 185499 - protein, 91 aa, Triticum aestivum
  unsure (1)..(91): unsure at all Xaa locations
  Clone ID: PAT_TA_79917.pep
XXTVTXXALLSLRWMEAQIRAXXXLWGKQGEQQLRWGEGTHRNIMTSTVRRSRFSSPPSLSIKITYAEMIQQNEEALAAILHIRETEKPNK

SEQ ID NO: 185500 - protein, 46 aa, Triticum aestivum
  unsure (1)..(46): unsure at all Xaa locations
  Clone ID: PAT_TA_79918.pep
VFKXXAQCCXLHPKNYQXLECDVCSEEERTCSTRCLPWFRVCFLVG

SEQ ID NO: 185501 - protein, 116 aa, Triticum aestivum
  unsure (1)..(116): unsure at all Xaa locations
  Clone ID: PAT_TA_79919.pep
PTHTPPHQPPSLPPPPXPPPSLPHHQPAPISSGPAPPVTFLPSPMSPLPQPPPSXEPALDLGRGDPLITFSPGFPWPRPVTSPTPXMAAAPCPVKAGLGGPSPAXXHRPTPAATXX

SEQ ID NO: 185502 - protein, 61 aa, Triticum aestivum
  unsure (1)..(61): unsure at all Xaa locations
  Clone ID: PAT_TA_79920.pep
TTSPFFLACIFLLLGSGVFSSHLSSLWRGGLSAAPFRLGVKDGGRXXGPGRRHGGRRGXXG

SEQ ID NO: 185503 - protein, 47 aa, Triticum aestivum
  unsure (1)..(47): unsure at all Xaa locations
  Clone ID: PAT_TA_79921.pep
ARAXXQQXXLPLQLREXVPDGVGAPRRRLLRRRGGHGAGRRQQTLAS

SEQ ID NO: 185504 - protein, 122 aa, Triticum aestivum
  unsure (1)..(122): unsure at all Xaa locations
  Clone ID: PAT_TA_79922.pep
LRNLDPDDNPIVQFNYFAHPDDLRRCVAGIEAIERVIRSRSFSRFAYPNFAFPAMLNVTAEFPANLMRVRGGSDPAALERFCRDTVMTIWHXHXGCQXXRVVDRDYRVXXIDALRVIDXXTA

SEQ ID NO: 185505 - protein, 109 aa, Triticum aestivum
  unsure (1)..(109): unsure at all Xaa locations
  Clone ID: PAT_TA_79923.pep
RAETAAPPPAALRCTYTSPLAISLGLPSPRKKPYQSIIQSSLKARKSGTYQQKGTAHSSYSALTGNAELSYSKTSGSTIQWPRQRKIKWYXTHDNXXDKEKDITRQXXX

SEQ ID NO: 185506 - protein, 52 aa, Triticum aestivum
  unsure (1)..(52): unsure at all Xaa locations
  Clone ID: PAT_TA_79924.pep
XXXXALGEPHEAAAGQGGDEHGEPGDRHGTAREPQRRKAVAHRTHSLAGPRA

SEQ ID NO: 185507 - protein, 70 aa, Triticum aestivum
  unsure (1)..(70): unsure at all Xaa locations
  Clone ID: PAT_TA_79925.pep
RSCHYKPPTIFVHHAGSGHPVQPSAAPRNQXXREQPWPARPPPAPARAAXXPTGSTAGTXAWTXXXRXXS

SEQ ID NO: 185508 - protein, 114 aa, Triticum aestivum
  unsure (1)..(114): unsure at all Xaa locations
  Clone ID: PAT_TA_79926.pep
HEASQSLITAQSLHGGTYIGPMNPWTAAAHAHLCVCPPQTAPWPGDPNNDGHPWPASTFVRLKLLNALGDPFGGRGGIHHVWRTTALVHLLAGPPPAATCTPSTALHLHPXXCC

SEQ ID NO: 185509 - protein, 26 aa, Triticum aestivum
  unsure (1)..(26): unsure at all Xaa locations
  Clone ID: PAT_TA_79927.pep
QLSFINHGQTAVDESMLIIIXXMLLL

SEQ ID NO: 185510 - protein, 75 aa, Triticum aestivum
  unsure (1)..(75): unsure at all Xaa locations
  Clone ID: PAT_TA_79928.pep
HEDRRRSHTAQTGRTYTQTLTREDRXMGPSPXAAVNTTRATCVLLILLLLADGRSTPVXGQALPAPEEAAXIXXD

SEQ ID NO: 185511 - protein, 71 aa, Triticum aestivum
  unsure (1)..(71): unsure at all Xaa locations
  Clone ID: PAT_TA_79929.pep
ARGCKLFTWGDGNKGQLXHADRETRLTPACVXSLRKLSFCQVACGYDFTXALSTSGQVYTMGSXAFXQXXN

SEQ ID NO: 185512 - protein, 87 aa, Triticum aestivum
  unsure (1)..(87): unsure at all Xaa locations
  Clone ID: PAT_TA_79930.pep
AXXRRRGSRRRRRXXXEGRXXAPEAPRSRHRRRLPXXXXTLDWCSACEQLASDRCARRSYNAASYSFNSSWMESAQLPKPAGIYGFR

SEQ ID NO: 185513 - protein, 91 aa, Triticum aestivum
  unsure (1)..(91): unsure at all Xaa locations
  Clone ID: PAT_TA_79931.pep
STQLSQWPAARPSSSPRSSSSPWPSRRWPMPRRPPRRRRPPTPPRPTRRPPTHPRRGPPMDRRLPPGLRASPXSRPTTTTTTXXXPECMPF

SEQ ID NO: 185514 - protein, 83 aa, Triticum aestivum
  unsure (1)..(83): unsure at all Xaa locations
  Clone ID: PAT_TA_79932.pep
GXXRAXXGEXXGRGFGRRPRAELRAALTLALPRRRXXETGSGVRRLLFRGXXTRDLGADWVARCCRRAQRAGRTPPPVERKRS

SEQ ID NO: 185515 - protein, 55 aa, Triticum aestivum
  unsure (1)..(55): unsure at all Xaa locations
  Clone ID: PAT_TA_79933.pep
YALGLLPAMERVGEAPHFLVVTYPAQGHINPARHLALRLLRATPGARVTVSXAVS

SEQ ID NO: 185516 - protein, 43 aa, Triticum aestivum
  unsure (1)..(43): unsure at all Xaa locations
  Clone ID: PAT_TA_79934.pep
MXPVSALXKYKLVFLGXXSVGKTSIITRFMYDKFDNTYXXTXX

SEQ ID NO: 185517 - protein, 79 aa, Triticum aestivum
  unsure (1)..(79): unsure at all Xaa locations
  Clone ID: PAT_TA_79935.pep
ARGGNGGGANVVAPGYTKGSGLGAEXIGTFVLVYTVFSATDAKRNARDSHVPILAPLPIGFAVFLVHLATIPITGTXXN

SEQ ID NO: 185518 - protein, 49 aa, Triticum aestivum; identical to SEQ ID NO: 147490
  Clone ID: PAT_TA_79936.pep

SEQ ID NO: 185519 - protein, 121 aa, Triticum aestivum
  Clone ID: PAT_TA_79937.pep
WRSGVAPSASQRQRAALGDDGGINTTVLGTPVQVLNANRGGRPPDVERRRGPQHRLVLLFIRAPREPRGRTGPGERVDQAVAARMGGYDSGREGGGFAGQRERRRCSRTGRQPRGAHSNWK

SEQ ID NO: 185520 - protein, 83 aa, Triticum aestivum
  Clone ID: PAT_TA_79938.pep
MKVKTKISKAAEFLRKAVRALRGRAGVLRARLLFLASFRHRTAMVGTVSRHLRALLPGRQRRCTTTARSTPRRRWRRRRTGRP

SEQ ID NO: 185521 - protein, 171 aa, Triticum aestivum
  Clone ID: PAT_TA_79939.pep
LFRPASWCLRPSNSLGEFAQVAIFSSETRRWTSVESEWPYKTVLLGGTACAYLNGTMHLTTHHGTIVTVDAEGKTWREIEDVMEDNREVVSIGHSQGSLHAWLIDNDKDPELCVWVLEDYASGKWTLKHTVEISELFGRQPDKDEACYSMLAIHPDYNLVYLTDNKKMTVS

SEQ ID NO: 185522 - protein, 172 aa, Triticum aestivum
  Clone ID: PAT_TA_79940.pep
TRLVSTTSIPTLRIVSPVPSSRWCRRAGPLASAGLGGAARRDRRRSRSRRGRRVLRICAYTAEAEHGRWEEDVADDFYSVLGVMPDATSEEIKKAYYSCMKTCHPDLSGGDPDVTNFSMFINEVYTVLSDPVQRAVYDEIHGYTATATNPFVDDSAVKNHVFVDEFTCIGCR

SEQ ID NO: 185523 - protein, 140 aa, Triticum aestivum
  unsure (1)..(140): unsure at all Xaa locations
  Clone ID: PAT_TA_79941.pep
KKNKITSRGRQILQTHPVKKEKKIFRRGGIREGQLELLGWEPGELEWELEFNKRRAKLLGGPPSNPKGKKKFGSSNPKGVKWGRKPGGNXCTHQXXPVSVICGXXKPQSQTXXSSPSSQNFRGKKXXKVGGTFKKLVWVX

SEQ ID NO: 185524 - protein, 146 aa, Triticum aestivum
  Clone ID: PAT_TA_79942.pep
MQNLLLPNAAAAAPWCAQPRRRPSRLSVRASASSPSAPRRETDPGKRVVITGMGLVSVFGNDVDAYYSRLFAGESGVGAIDRFDASGFPTRFAAQIRGFSSEGYVDGKLDRRLDDCHRYALVASKKALESACLVAGSSAMEKVDKE

SEQ ID NO: 185525 - protein, 176 aa, Triticum aestivum
  Clone ID: PAT_TA_79943.pep
TRENHADGSSGSGALPSVVQNSQSHLQNQDPSPVVHNSPLHLVIQNPSPVVQNSPSYSQTRNPQYIAQSSPSYSQTRNSQYMVQSSPSYSPTQNPRYMAQSSPSYSRNQSQSSNIQSTPFYFHDQNQSSNVHSNPSHFHYQNQSSTVHNSPSYSHNQNPSPNVQNGPSYSQNHNPS

SEQ ID NO: 185526 - protein, 116 aa, Triticum aestivum
  unsure (1)..(116): unsure at all Xaa locations
  Clone ID: PAT_TA_79944.pep
HGAPSAAAAAAARTCQXSLDAPMATAASCQRPAAPSAQCSAGNSAGRRRPPPAEKGRRVASTGRSTPGRPAAGGTCRPGPPSIHANSPYGPARPYVAGNKSLAGRQPDFNRPARSI

SEQ ID NO: 185527 - protein, 68 aa, Triticum aestivum
  Clone ID: PAT_TA_79945.pep
FFFFKEETNKKKTYIHTYIHTYIHTYALHIHTPTLMYHESSQVVECLRAPVVPVVGEVPPDELLEPHL

SEQ ID NO: 185528 - protein, 152 aa, Triticum aestivum
  unsure (1)..(152): unsure at all Xaa locations
  Clone ID: PAT_TA_79946.pep
LPFPVALTVAASIMSVAAESPSPSLSSLSEDEDFADILDAELELASAADSASPGEPPGSPSDEEEEEEEDLVVEXXAXXQGSNKRRRLEEHHQDQGTATRPEEDAIGSVKDAQIKICPPHPGFFGGLCFRCGKXKTKKMXRNRFWLHPXXXE

SEQ ID NO: 185529 - protein, 139 aa, Triticum aestivum
  Clone ID: PAT_TA_79947.pep
RGGDASCRRSLHKGRRRTSPSISMPKKIMQPRISDRGGTACIARVGGAQPALRPSAQPSGPSEAFLRGRAASVAAVERRDGARRRRAADRRGKRQAVSLRGSEINSSSEEKYGAPGPSVQRRRRMAGRRPRPPFGQGLV

SEQ ID NO: 185530 - protein, 32 aa, Triticum aestivum
  Clone ID: PAT_TA_79948.pep
QPPPPPPPQPPPPPPPPPPPPPQRNTANETLV

SEQ ID NO: 185531 - protein, 148 aa, Triticum aestivum
  unsure (1)..(148): unsure at all Xaa locations
  Clone ID: PAT_TA_79949.pep
MTRRRRRRRARPASPPAALEDDDLLRKIFLLLPPQPSTLPRLSVVCKQWRDVVTDPQFLRGFRDQHRKPPLLGLVMGHTGSPYFRSDLDPPDHIPHERFFPRDIRSMNMDIFDCRHGRVVFFAQRLGEVVLFDPXTGGRRCVVVPPVF

SEQ ID NO: 185532 - protein, 160 aa, Triticum aestivum
  unsure (1)..(160): unsure at all Xaa locations
  Clone ID: PAT_TA_79950.pep
KKLPGNCPSMAALLRFAARKVCSRASLERLPQVSFTATTSLAVVKELEQQRTLPWTILFHGRVSSLRWFSSSSESPDKILAAQVEDKKQELRRLLRRLDELRTEKCAIAAREKEKKFPRKRNTRKIRTPPPAFIGRPTVSAVSSXSNRGYPAYHELGNPC

SEQ ID NO: 185533 - protein, 177 aa, Triticum aestivum
  Clone ID: PAT_TA_79951.pep
ARGLSNGVSLPETGSRHHHGDADGSAATFSPSATGAARLAISYIVAQFSTGSTEERRKATSEARKLSKHSVFYRALFVEANAVPWLLCLLSCMDASVQDNAVASLLNLSKHPGGRTALVEAGGIGLVVDIVNVGSKAETQQNAVAILFYLSSNAEYAEEIGHDIVNVGSKAETQQNA

SEQ ID NO: 185534 - protein, 205 aa, Triticum aestivum
  unsure (1)..(205): unsure at all Xaa locations
  Clone ID: PAT_TA_79952.pep
YYTGKERAMLLPNCLFRMGGAAVLLSTRGRNARFRLAHVVRTLTGAKDSAYRCVYQEEDDRGNVGINLSKDLMVTAGDALTANITAMGPLVLPASEQLLFALSFVARKVVGSSRIKPYIPDFRTAFEHFYIHAGGRAVIDELQRSLRLSDEQVEASRMTLHRFGNTSSSSLWYELAYIXXXXRMRXXXXVWMIGIGSGFKCNSAX

SEQ ID NO: 185535 - protein, 198 aa, Triticum aestivum
  unsure (1)..(198): unsure at all Xaa locations
  Clone ID: PAT_TA_79953.pep
HEESSLARPPPPLPPPSARGSAGARLLARPRPAPAVRCHGEPASSSLASGWAPPTPFTGRDPDARKPAWLRQRAAQGDKYARLRESLGELKLNTVCVEAQCPNIGEXCWNGGGGAGGEGDGIATATIMLLGDTCTRGCRFCAVKTSNKPPPPDALEPLKTSIAIASWGVDYVVLTSVDRDDIPDXXSGXFAETXXXLX

SEQ ID NO: 185536 - protein, 156 aa, Triticum aestivum
  unsure (1)..(156): unsure at all Xaa locations
  Clone ID: PAT_TA_79954.pep
MATPDEHAEEEYAEKEYADFEERVKRTIYIDHLSPVVTGQVIRAALSQCANVVSVEFVENYTIPYDIPAAALVELDDESQARSAVDLMRDFPFIIGGMPRPVRASLARPEMFPDRPSPPGSXXEFLWLKQGDXEYDGMSKLXXLQRXXXXXMALIX

SEQ ID NO: 185537 - protein, 188 aa, Triticum aestivum
  unsure (1)..(188): unsure at all Xaa locations
  Clone ID: PAT_TA_79955.pep
MTGGGGEDVPAARRRPLTVLPLVALIFYDVSGGPFGIEDSVRAGGGALLPLLGFLILPVLWSLPEALITAELASAFPTNAGYVAWVSAAFGPAVAFLVGFSKWASGTLDNALYPVLFLDYLRSSGLALAPPLRSLAVLGLTAALTYLNFRGXXLVGLSAXXLTAFSLSPFXVALTALAIPXXXXXRXX

SEQ ID NO: 185538 - protein, 65 aa, Triticum aestivum
  unsure (1)..(65): unsure at all Xaa locations
  Clone ID: PAT_TA_79956.pep
DSLALLLFYCYEVSSAWLRFLDHRMFCKCPPLPRTFVVWSGLESPAALCFFSCVCNFKQVPXXFS

SEQ ID NO: 185539 - protein, 196 aa, Triticum aestivum
  unsure (1)..(196): unsure at all Xaa locations
  Clone ID: PAT_TA_79957.pep
HEAGGSKGSLRLWDIRTGLTTKEFNRSLGTILDLDFSADGKQFISPTDTTRSNVSENTIIVWDILREVPLSNQVYTEAFTCPCVRYHPYEASFVAQSNGNYIAIFSARPPFKLNRYRRFEGHGVWGFPIKCSFSLSGRELASGSSDGCIYFYDYKSSXFLRKIEAFKEACTYVAYHPVLHNVIASCGWTGEISVLE

SEQ ID NO: 185540 - protein, 82 aa, Triticum aestivum
  unsure (1)..(82): unsure at all Xaa locations
  Clone ID: PAT_TA_79958.pep
CSTRPWALGSTTLAPRSPGSWRTFARRAMCWLLRHXQXXPALHLLWLCSPXXTCPTSSCCLSALAAHRHATVVRPTATDFLR

SEQ ID NO: 185541 - protein, 154 aa, Triticum aestivum
  Clone ID: PAT_TA_79959.pep
SCRIRHEGNVRYHLVEQAKCNQRPQNPRELFNLRHAQLRNHVERVIGVLKKRFPILKCASQYPINSQAEIAIACCALHNFICSNEGGEQWLDQVESEIDPVKIIDVPSGDMKYTNDIHSLNELQALGSTKRDEIANAMWNDYQDYLRRTRRNIA

SEQ ID NO: 185542 - protein, 181 aa, Triticum aestivum
  unsure (1)..(181): unsure at all Xaa locations
  Clone ID: PAT_TA_79960.pep
MSGGGCSIRAIWILTPNDAVAFSRRFAVVEKRWRVAWEAEGAGKGAEMPLPADYEVAAAFANRRRREGTARGSGIRTSLSSVGSDSWVDDPITRHIISLQIDKEEGGGFMLCPVVLQKRGSYYVLVLPLVDPQSFRASESLLKRPDCGSSAKENGNLSSILLNLPCITGAFMVANVIXDII

SEQ ID NO: 185543 - protein, 145 aa, Triticum aestivum
  Clone ID: PAT_TA_79961.pep
GACESRQADPKTRSWPIPPSCSRSPPSSCSSRRRRPAPRPPPPRPCPSTSSRSCPASPSSATSPACWSTREWPAPSTPRRRSPCSPPTTPASPPPPSAASRTRSSATSSRSTSSSTSSTRRSSTRCGLGARARAPRSPRCCRETS

SEQ ID NO: 185544 - protein, 122 aa, Triticum aestivum; identical to SEQ ID NO: 132374
  Clone ID: PAT_TA_79962.pep

SEQ ID NO: 185545 - protein, 96 aa, Triticum aestivum
  unsure (1)..(96): unsure at all Xaa locations
  Clone ID: PAT_TA_79963.pep
DRXXXESAGRGGGXGELTRYRRQPCSYCRCAACMGGGGGPAREVAARRKGERFIAVDRCTGGQLEPTGGSEIREEEDSGDDDVASSAMFRAGIESI

SEQ ID NO: 185546 - protein, 207 aa, Triticum aestivum
  unsure (1)..(207): unsure at all Xaa locations
  Clone ID: PAT_TA_79964.pep
HEGRRHRPPPPPPRPNPIPVASAPTFSQSPHLLSRGRWIRPSRDRFLRADRVFRAGRERRVPHRRVGERGGGRGRARARSSDPSGPDGSGASHIGALVSAAAAVAELEPALLRAGDACSKEWKACVLSASDPDDLTPPRPSSFPVAPPLEPPAGALPSPEEPPTPPPEAICGPVVRRWIYRLDXXAAGVEVQGEECLMXXXHNSHAX

SEQ ID NO: 185547 - protein, 151 aa, Triticum aestivum
  Clone ID: PAT_TA_79965.pep
THHHVIPACRGMEELNVEGVQQVEELNVKGVQQEEELNVKGVHQVAVVPNTVDSLENLTDSKPLVSVGFTESSPDGHNRHLSEDLSSLTINNIRVNGEEICHNQSKGNGHNRNFSEDIGSLTINECRANKVEENCHNQPEVKEQQQISRHN

SEQ ID NO: 185548 - protein, 102 aa, Triticum aestivum
  unsure (1)..(102): unsure at all Xaa locations
  Clone ID: PAT_TA_79966.pep
VNTKAPERMMSQQKSLKXIQFISHXLGSXDGDGKGDGGVRRRVDEKGEEDVTRFTTASPSXXPTVELGGGVATGRRSGRDGGGGVAPWLGERRDEGFDSPRA

SEQ ID NO: 185549 - protein, 110 aa, Triticum aestivum
  Clone ID: PAT_TA_79967.pep
HAGKIPKKHELSDVEYKLKVQAELSKNLKELEKLQQEEANARPNAIQLRLMSIERAIDGVIGGAAKLGFFGMLIAVTFGDERVEARVAIKENQMVMSCGRSFDHTCSNIV

SEQ ID NO: 185550 - protein, 83 aa, Triticum aestivum
  unsure (1)..(83): unsure at all Xaa locations
  Clone ID: PAT_TA_79968.pep
NIATNVVRQQRCLLLCFTYSVIAHSVRYVQDLATFSQASSRCCWNAVVWAVLXXSARPRIXAVPSPPDRPRSGEVXXXPGRNX

SEQ ID NO: 185551 - protein, 152 aa, Triticum aestivum
  Clone ID: PAT_TA_79969.pep
LQRSDPWDPAVAHGGAAPVSLRPQARRGKRPPPYCSSSIPRARRIHDDLLSPIPFFALVGVCEVRHGQPREFDSAAPCAPALPPPTRGGLAPSHHLRTAAAVTHLPQSHRAAPPATPPQPHVRSSAGVRHPSSFTSSCSDGSPLPSPGFGSR

SEQ ID NO: 185552 - protein, 113 aa, Triticum aestivum
  unsure (1)..(113): unsure at all Xaa locations
  Clone ID: PAT_TA_79970.pep
FPPPHVVKNRPQRGXKKTPKRGKWGPGPPPRXFFFFFFFSXXRGPKFSKNGGTRKATIGLTHPPGAHKKTEHERGVYFIKSARAREQTAGGEKTLGGGELRGMGLPEFLGGYC

SEQ ID NO: 185553 - protein, 92 aa, Triticum aestivum
  unsure (1)..(92): unsure at all Xaa locations
  Clone ID: PAT_TA_79971.pep
KHSHGYIYRQNMCLSGEYIIHRVQVHTLTLVFKDLAVNRVQLGNSSAKVQFSKETKCPYIVHSYNTLACPTRRLDAASYDYGPLDNQAXQHA

SEQ ID NO: 185554 - protein, 109 aa, Triticum aestivum
  unsure (1)..(109): unsure at all Xaa locations
  Clone ID: PAT_TA_79972.pep
XXXHVLIXXVXXXYQLISPIEIYFFMGYIXQRYIKYNLLFTIXXVXXIXAQTQNLREXDKDKWCVLKTYFXXFTSKFIMSFNEIVRARWFQNIWKKTFEQXGYIFCNIN

SEQ ID NO: 185555 - protein, 200 aa, Triticum aestivum
  unsure (1)..(200): unsure at all Xaa locations
  Clone ID: PAT_TA_79973.pep
PRSFLASRLPSRNPTPSSPLCRRRRRQSSSPHTAPARPSRRCAGSNPTMPPCDATASGRLPSPSVSSSPGTSCSEWARAGEVKARSRQAAVTRWGARRRRRSTSPVSPIPFRWWREGICRLAEQGSRRRRRPREKPSRAAGDDDDQGRRGTALRHPXXTRPQPRQASAPYRAPVDGRSQVPSRGGARRSAPSRLVALWAT

SEQ ID NO: 185556 - protein, 167 aa, Triticum aestivum
  Clone ID: PAT_TA_79974.pep
MEAARIASFLLLLGVVWSRAQPGAEAAGTTVFTLRNNCTFTIWPATLSGNSAVAVGGGGFELAPGANVSFPGPTGWSGRLWARTGCVAAASGASLACATGDCGGAVRCTLGGAPPVTLAEFTLGGADGKDFYDVSLVDGYNVGIGVAATGARVNSSTCGYAGCVGDV

SEQ ID NO: 185557 - protein, 76 aa, Triticum aestivum
  Clone ID: PAT_TA_79975.pep
KLDHVEFPPVGLLSNVKRLLLHENVGKGKVLCSLATYLIHSAIFLFLGHMFFYYLWIDIMFFFHYFLGENPQLVNF

SEQ ID NO: 185558 - protein, 184 aa, Triticum aestivum
  Clone ID: PAT_TA_79976.pep
ESMKKGGATGGATPGSSPGIAGVALSSGRRRVGGRFWALADEGAGDSDDDDGDLLVGPSGVPSPSPSDVICEAFRLGYPEDEVALLVYRAIPSDDPARMGLRAEDKIEIVRRVVHRRTATTAIRPWKGPLPKVIFRATAMIRSWSLLTPMVAREHLVTGSIRWEMVARDIFNRFGWRSCNRIGN

SEQ ID NO: 185559 - protein, 123 aa, Triticum aestivum
  Clone ID: PAT_TA_79977.pep
PSTDHGPSSSSAPPMELARSTYGRSRCYAGLDAHSASIRPSVRPMHTRSFHLRIHTYVHHRALPILTRSSVSRPRPASPSRYITPSPTHHSSLTSQRTSAKYIHWPPTHPHTTLHPHSTPLQE

SEQ ID NO: 185560 - protein, 89 aa, Triticum aestivum
  Clone ID: PAT_TA_79978.pep
WLGSFLCDRKTTLRYPSLKVVYCLPEDFIISDDGSNTPASHDHKFTISRAISLGRTCMARLIASKQEVPLFLVCMIYFLAPEGKWVVLE

SEQ ID NO: 185561 - protein, 207 aa, Triticum aestivum
  unsure (1)..(207): unsure at all Xaa locations
  Clone ID: PAT_TA_79979.pep
HHCSSKKNTQPSIQIPSSLLPIHPSSPSHPTPPPPPXPPRRPPHRRSPASPSPSPLHPSPAPSLPVPDQPAXSRRPGYSSSAEKTESPLLLLPNPPAPPAHFFMSPLPPXAPPRRPPPPADLGLGDAAALAAVGWLVADRQSLNDHRLEVRGLGAGSPRRKQRAEIHRWPAAAAQFVVRIHGAGRAAPFPASSSLRAPAKSWIHKWE

SEQ ID NO: 185562 - protein, 93 aa, Triticum aestivum
  Clone ID: PAT_TA_79980.pep
TKPADCLPILRNYTGDKPRHMLGTTTQAAVVEEEVVAADRGAAAFKEIYALATVHELYSGSPPRYNNLLSPIVHSRGDEPAGSHEHSSFYAKV

SEQ ID NO: 185563 - protein, 57 aa, Triticum aestivum
  Clone ID: PAT_TA_79981.pep
ECIDDIPYLKLCSFWHRLENETCHGTSSEIAMTKSLIKFGMVKKVDIVLKKETCDGH

SEQ ID NO: 185564 - protein, 56 aa, Triticum aestivum
  Clone ID: PAT_TA_79982.pep
DRLNDLLVIRSLMHLLGSYIMYIRSLVVLVSEPCMHVRMLIYVCLCITMFLSKICE

SEQ ID NO: 185565 - protein, 169 aa, Triticum aestivum
  unsure (1)..(169): unsure at all Xaa locations
  Clone ID: PAT_TA_79983.pep
TLATAAAGXXAAAAGXXXGAAGASSATAGASGSAGGAASSFTSSGAAGSASATASLVSVSTTAGASVSLGASASGSAAAAGSGSLASSVSAAAGATSLVSSTSTGAAGALTSASAGAGASSVFATSSAATGVSTVGASSVSAAVGFWTSAVAIAVVDARKCPEWQRLAS

SEQ ID NO: 185566 - protein, 211 aa, Triticum aestivum
  Clone ID: PAT_TA_79984.pep
TRAVPPAKRPALPPSSDDKKLDFAVIKYRNQKLSEQLEVHKSEYHALEGKFDDLKQKQKSHHETQDLVNKSWQHLVRDLKAISVCKSGSQNSSCSAVPSNESTDGACIRKDKDFLSRLVETGATESSGCHLENHVHSSTTDVLQNILFSSNDSWHANEKLPLDHFTALPEDERIRELRSTASEISLELTDAVRALGDLHLKHRQLTEKHHE

SEQ ID NO: 185567 - protein, 99 aa, Triticum aestivum
  Clone ID: PAT_TA_79985.pep
PSKMLGENKNVRSKLVKLKGAKKHWQCSVLQLLLSPLEVRLPFYRICSGGTHPHPPRSSYLSPALVAPDKNAWMSVPVEVLTWKLEVDPNICSIVHKSS

SEQ ID NO: 185568 - protein, 170 aa, Triticum aestivum
  unsure (1)..(170): unsure at all Xaa locations
  Clone ID: PAT_TA_79986.pep
MTVDRKDAEAAAAAAAPFEIPALQPGRTCGAEESTRSHVLVKPIGSSNLPCNEYALLARQNPKGDAQPVASILRKKRPRRSRDGPNSVSETIRRWKEVNQQLEHDPQGAKRARKPPAKGSKKGCMQGKGGPEXXQCGFRGVRQRTWGKWVAEIREPNRVSXXWLGTFXLL

SEQ ID NO: 185569 - protein, 126 aa, Triticum aestivum
  unsure (1)..(126): unsure at all Xaa locations
  Clone ID: PAT_TA_79987.pep
AALGYHGIEVWHYSFSRFNLICCTNTWAKFVQKLFVFVNLTKIWHQKSYSGPIVDKTWWGISKFRYIWDPSFPIPKTQPNPSSPPPPHNGSRCPXPPHHRPPRSVPAPGASLRRXXPRAAAGTXXX

SEQ ID NO: 185570 - protein, 198 aa, Triticum aestivum
  unsure (1)..(198): unsure at all Xaa locations
  Clone ID: PAT_TA_79988.pep
ARGSISPHLPRPPNPHANPPPPPWPPRRAPPASPPCCSSRSSPGPPRPASPRRTTTSSPAARRPRPSSPXPRFVPDSGCASXPSAPRPPPSRPPPPLRPRPRRPPLSTPPRASSPATPPTTSPCAAAGATSCASTSTPSAPPSPPRASTSAPGASSSSTTSPPRPPSSRTSCSPSTPTSSSSPSSPXPDPPPSSTPSS

SEQ ID NO: 185571 - protein, 146 aa, Triticum aestivum
  unsure (1)..(146): unsure at all Xaa locations
  Clone ID: PAT_TA_79989.pep
KVVGSSAPAGGSSRGGWISRCRRDRLREASKPEQQEQGARGDSWFTPPPPSSIFPCPHSRLLFISWVTASAGRSEEWKAHATCGTEQQEQGSVAGAPQGVEGXXRQLYKFEXXXALLREDASSGCXXLQAIPGEQVXXWDXXVXXX

SEQ ID NO: 185572 - protein, 162 aa, Triticum aestivum
  Clone ID: PAT_TA_79990.pep
HEARGLAAKSRQGRQIGQNVLNFFKAVDKDCTNISREEFLDFKTSLEHSLKEVKAAVEKSAKEQKMFIEASTTANSELMQRALHRLEVLSQDIKAVVDAGVKSQEASTDTAEKIFNLMNEMAATLKEAPPQRPVIFLAGWRSLLSGQRRLTTCVSLSLTMQQ

SEQ ID NO: 185573 - protein, 69 aa, Triticum aestivum
  Clone ID: PAT_TA_79991.pep
QFSCSEENLFLFEESSFLGLLTPCCSVLVRAAGRPLDPGGFGDATSKSWAPERQGGKAVPPQDEGLHAS

SEQ ID NO: 185574 - protein, 49 aa, Triticum aestivum
  Clone ID: PAT_TA_79992.pep
TPSGFGYIVTLPFSRSLDRKCGLPHPTRLRNSQPGMRHFFISYIYIILV

SEQ ID NO: 185575 - protein, 192 aa, Triticum aestivum
  unsure (1)..(192): unsure at all Xaa locations
  Clone ID: PAT_TA_79993.pep
RYIVMGLPQVPAIKEEEPPKLSTCVVSPPCFGGSDNSDLGRLPTGGSSNRAFPYPSISDLKRKAALDSLIGFDGNFGASHAVDGPAGSQGLKPDPRNPSFRSCPKLRPVQMPARRVIGFESSFAGFKGDSDTMVADKMNSSLVINTCHSSIEQHGPQARKXVLSXXTNELHGHXSGDALNIGSADAKMQHSD

SEQ ID NO: 185576 - protein, 46 aa, Triticum aestivum
  Clone ID: PAT_TA_79994.pep
SIHGPIVASNKGNQSIHGEVLQMLVVISSQHLVVQLVVVPGRRPRA

SEQ ID NO: 185577 - protein, 93 aa, Triticum aestivum
  Clone ID: PAT_TA_79995.pep
QHESINGGRIRFTEIRSDPFGLESSPAKQNQLSSFSITTKQNYWFEKDSRTRYLGYIHLADEETASKHGMALGQSEFAFILQKYKNKNKKASC

SEQ ID NO: 185578 - protein, 49 aa, Triticum aestivum
  Clone ID: PAT_TA_79996.pep
CLFLPSSVGLWNYATLFYRQWKLHNYGNQSFLSIDVWLLSMLLCVKKKK

SEQ ID NO: 185579 - protein, 178 aa, Triticum aestivum
  unsure (1)..(178): unsure at all Xaa locations
  Clone ID: PAT_TA_79997.pep
MAMVAAIHHLPGDLQVPPPPLGRTLTSPPSPSRRSXLPSQTLEPSAHGLRRPRAYRAPRAQPPRPRASSTSTPSTTCTNSXPGAPASTGSTPSYSSGTTASAVDPPPPLLLSXAEPPLCSPTPRTMLPYDXTTSTMTLLLFQQSFQMVEPRIQTTPPTTTTIPXVPTTTWRLPTTRSS

SEQ ID NO: 185580 - protein, 203 aa, Triticum aestivum
  Clone ID: PAT_TA_79998.pep
ARGSSSSSSSRVAGAAAGSGQNQACAACKYQRRKCNPDCPLAPYFPADQQRRFLNAHRLFGVGHIQATLRETPPDLHTDAMRALIFQAEARAYDPVGGCCRIILDYERQLGLAQAELAALLRHLDLCRHQAAAMAQDALVDDPGMLLLAPGPNPADVQDGVAALDALYAGHEISNGQANHHDHDHYLVGATDQLQPQKHQPYD

SEQ ID NO: 185581 - protein, 124 aa, Triticum aestivum
  Clone ID: PAT_TA_79999.pep
PSRGGGRWRRPAPSRRRRGNRRGRGCGGARTARPGRAPRPSRPRPTCRRRPSGPCRGPSHPPNRTCRGPPRSPNRACLGPARSSTAPPPPRKTTTTWLEGVDHARGAASERGGEAKREEECLLP

SEQ ID NO: 185582 - protein, 45 aa, Triticum aestivum
  unsure (1)..(45): unsure at all Xaa locations
  Clone ID: PAT_TA_80000.pep
MAAVQQYTVALFLAVALVAGPAVXYAXYAPGAXXXPXXPXXXPKA

SEQ ID NO: 185583 - protein, 134 aa, Triticum aestivum
  unsure (1)..(134): unsure at all Xaa locations
  Clone ID: PAT_TA_80001.pep
ARGPFVPPLPHPPGDSPNNGGGRPQRLRAPSPGEHPPQPGKARPPPPXRPTSSPPPSGSPNLSGRIRPGPSPRPRPAPSAPPAAPAASPPTTSPRISEAPASRPRSPPPSSGFPRRRGPRFVRRAISMLGGTWC

SEQ ID NO: 185584 - protein, 118 aa, Triticum aestivum
  unsure (1)..(118): unsure at all Xaa locations
  Clone ID: PAT_TA_80002.pep
XXXVXXXAGHPVRPVPEHDGEARGARAAAERLEEAGVEARHAEVEPRGAHEQAGDVVAVHRALRSIGALPEQKQKRPAAMIAQEGSKADGREGEGEGKKWTWGKWVRGARRGREGPSC

SEQ ID NO: 185585 - protein, 82 aa, Triticum aestivum
  unsure (1)..(82): unsure at all Xaa locations
  Clone ID: PAT_TA_80003.pep
KQIXPLWRHYFQNTQGLIFVVDSNDRDRVVEARDELHRMLNEDELRDAVLLVFANKQDLPNAMNAAEITDKLGLHSLRQRHW

SEQ ID NO: 185586 - protein, 197 aa, Triticum aestivum
  unsure (1)..(197): unsure at all Xaa locations
  Clone ID: PAT_TA_80004.pep
HEALEKGALCVGVTNTVGSTLSRKTHCGIHINAGCEIGVASTKAYTSQIVVMAMIALAIGSDQLSTQPRRESIITGLSSLPSHVSEVLKLDAEMKELASSLIDSESLLVFGXXYNYATALEGALKVKEVALMHSESMLAGEMKHGPLALVDENLPIIVIATRDSCFSKQKSVIQQLLSXXXRLIIMCSXXDISXVGP

SEQ ID NO: 185587 - protein, 183 aa, Triticum aestivum
  unsure (1)..(183): unsure at all Xaa locations
  Clone ID: PAT_TA_80005.pep
ARGASEGRLSNCIAMCALSSSVEKPPAAAAIALGLLISELSKDPWKGRVITFDATHQLHKVRGASLVEKLRTLAAVRAQKGANLQAVFNKILNVAVAGALSKDMMVKRVFVLSDMEFDGWVGGEAWVSEHAAIKKKFAAEGFAVPEVVFWNVGTSXXSVPVVAAXXGVALVSGYSKNLVRLFL

SEQ ID NO: 185588 - protein, 204 aa, Triticum aestivum
  unsure (1)..(204): unsure at all Xaa locations
  Clone ID: PAT_TA_80006.pep
DIDDVVTFVKWLDVELSRLVDERAVLKHFDWPEQKADALREAAFGYRDLKKVEAEAASFCDDPRQPCASALKKMQALFEKLEHGVYSLSRVRDGAMNRYRGFQIPWEWMQDTGIVSQIKIQSVKLARKYLRXVSSELEATXXGPDEEELMLQGVRFAFRVHQFAGGFDGDTMRAFQEIKEKANALQSQRDQQHLQQQKLAAGRS

SEQ ID NO: 185589 - protein, 76 aa, Triticum aestivum
  Clone ID: PAT_TA_80007.pep
HEAKDDFPEYYDGKTGRYIGKQSRKFQTWSVAGYLVAKMLLDDPSNLRAVSLEDDGHIREPVLKRSNSCPGLHMSH

SEQ ID NO: 185590 - protein, 165 aa, Triticum aestivum
  unsure (1)..(165): unsure at all Xaa locations
  Clone ID: PAT_TA_80008.pep
MATLPQRFKLLATRCAAGAPSPSRSPAPSYATSPGYRLRRRRGSRLRRFLCRRVGGGLPEPAGRREEDKKPLVGRGSRTLRDLFVASPEAGRTRRGCSCDADSDDDEXXXGPAGSGGASGAASGGGARRFRPAGGGLRSLLMRRXWRPVLVAIPESEGKIELGAI

SEQ ID NO: 185591 - protein, 74 aa, Triticum aestivum
  unsure (1)..(74): unsure at all Xaa locations
  Clone ID: PAT_TA_80009.pep
GTHIXXTHQVXLXYRKELTVHSRIRTRAYMLHKYARTHSVRXRDIHTPPTELTHASNFILLFTNPTSNDPSINE

SEQ ID NO: 185592 - protein, 174 aa, Triticum aestivum
  unsure (1)..(174): unsure at all Xaa locations
  Clone ID: PAT_TA_80010.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLXXRGGMQIFVKTLTGKTITLXXESSDX

SEQ ID NO: 185593 - protein, 147 aa, Triticum aestivum
  unsure (1)..(147): unsure at all Xaa locations
  Clone ID: PAT_TA_80011.pep
MRGGRSGGGGLRNPCLTMHQPWASLLVHGIKRVEGRSWPSPVTGRLWIHAASKVPDPDTVAAMEDFYREIYAVDGVHHIDFPQHYPVSRLLGCVEVVGCVRSEELVCWEDVPQSVRLEGLTDFCWLCENPQKLVVPFEMRGYXXVXX

SEQ ID NO: 185594 - protein, 71 aa, Triticum aestivum
  Clone ID: PAT_TA_80012.pep
NQSINSSYHIFWICLWHTARQRQTMTNRRSGTSGTQRSSDGRTTGGKYSSSPIDEVFEILVYQFKEFPVKN

SEQ ID NO: 185595 - protein, 123 aa, Triticum aestivum
  Clone ID: PAT_TA_80013.pep
HEALEEVNYINAHATSTLAGDLAEVKALKQVFKDPSQIKLNATKSMIGHSLGAAGALEAIATIKAITTGWLHPTINQFNPEPAVDQFDTVPNVKQQHEVNVGISNSFGFGGQNSVVVFAPFKP

SEQ ID NO: 185596 - protein, 202 aa, Triticum aestivum
  Clone ID: PAT_TA_80014.pep
KKSCIVVDVSRGVSVSPPQLPLVECAEPNYGALTAPLTSPNSHLIIEAGPHNLFWRVGSDSWVRCSTRHGHIKQIVVFKGRVFGMDSDRRIFKVHLTPQISIQELPVIESSMISKRNLSNAWLVACGDMLLLVGCRGSIVVSRVTFEVFRLDLSFEPALWFKVEKLEHWAIFISTDKRSQALSCMNPEIWGGRSNCIYCYNH

SEQ ID NO: 185597 - protein, 49 aa, Triticum aestivum
  unsure (1)..(49): unsure at all Xaa locations
  Clone ID: PAT_TA_80015.pep
MDWAAVAYTAAALLCAAAXTDITLGHXYRHLLHYAEPIXXXXXXXXIXM

SEQ ID NO: 185598 - protein, 83 aa, Triticum aestivum
  unsure (1)..(83): unsure at all Xaa locations
  Clone ID: PAT_TA_80016.pep
LGQXXXGGQXXPPGKHAHVRXQNPFFSRPRGFQRQVPPRPGXXGLPVPLPRGGPLFPPLNLKGGWFVGSGVIGGGQFPPPRPL

SEQ ID NO: 185599 - protein, 211 aa, Triticum aestivum
  unsure (1)..(211): unsure at all Xaa locations
  Clone ID: PAT_TA_80017.pep
SAHKKELEKGKNEVEDRRNLYLSKEGEILPGTPAAEGVSDVDMNKRSWLAKRKAEMLVSPKFHVSRTRLIIYNLPKTLTINDVKKLCREAVISRATKQNPVIRKVNILNNEKKGQGAAQKHSRGVAFVDFQEHEHALVALXVLNNNPGTFGTERRPIVEFALEDVEKMRLQKXRNERNGRAKXXAQERXALXXQSTTDGPRPKKKXPFXXR

SEQ ID NO: 185600 - protein, 133 aa, Triticum aestivum
  Clone ID: PAT_TA_80018.pep
REKRENEDRDRDRKHRRRSLHRHHHRDVEPEETPLTREEEEDAEEVERRRQKKEEDMEAEQQRLDDEMERRRRRVKEWQEKKRREQQQEDGASGGAAAIEADGGGKSGKKWTLDGEDLLEEAIADLYLLDLFG

SEQ ID NO: 185601 - protein, 193 aa, Triticum aestivum
  unsure (1)..(193): unsure at all Xaa locations
  Clone ID: PAT_TA_80019.pep
GLDHRRWAGPARGGGHEFLADDVLRLGASKIRIGLDVAGGAANFAARMRERGVTVVTSVLDGPGKPMNEFVASRGLFPLLLSPAHRFPFYDGVFDLVHVGTAALDEAGAPAMGQAATPEALEFFMFDVDRVLRAGGLLWIDSYLCXXEERRRVVAKLIERFGYKKLKWVAXXXXGGAATSTYLSAVLRKPARS

SEQ ID NO: 185602 - protein, 86 aa, Triticum aestivum
  Clone ID: PAT_TA_80020.pep
HEAQDVKASDLLLLNEEGTELPIDNLCDCVVENKDGTEFPVYHSRTCHVANEEITELPIVLAKASSLIFECISFTFCYPVYLASES

SEQ ID NO: 185603 - protein, 112 aa, Triticum aestivum
  unsure (1)..(112): unsure at all Xaa locations
  Clone ID: PAT_TA_80021.pep
XPDGGDGAGAGXXARRGASALXVRRAGEAQVGSAEGTSASSDGARGYPEQDAGQSLVAPXEATARPGTAYRQGTLSFRTRESPVVLCAWVCKHFRAACTTICVQIVCFALVE

SEQ ID NO: 185604 - protein, 178 aa, Triticum aestivum
  unsure (1)..(178): unsure at all Xaa locations
  Clone ID: PAT_TA_80022.pep
MVNAFFATLARGLDDLSGAGGLSSLPALLRAAALLRGLHSQLMVLVGQLHLPPGGRWLDEYMDETARLWDACLAVKLGLAAVERYCAAASCAAAALDDWLQDPSPLSTRQVMRAISASRREAMAAEEENRALSESRIAPLSLQLDERRAADAXLSGFNGFRGLLYALHNASSLLLLIL

SEQ ID NO: 185605 - protein, 99 aa, Triticum aestivum
  unsure (1)..(99): unsure at all Xaa locations
  Clone ID: PAT_TA_80023.pep
MVCNLAEGTPPSRSPPSILLHGLRTTHQLLTASPPVDVVVAKDGSGDHDTISAAVAAAPPGGSRYIIHIKXXLYQEKVEVLQRSNVMLIGDGAARTEII

SEQ ID NO: 185606 - protein, 177 aa, Triticum aestivum
  Clone ID: PAT_TA_80024.pep
MAAASAAAAACRRAVSSTLRGPPIESLAATAARAAAPTGDQFVDLLDANFNRPAPPPPPKTRTENNSPTFATSGDPCLDFFFHVVPGTPAGTVSSLLANAWAAEPTTALRLACNLRGVRGTGKADREGFYAAALWMHGSHPATLALNARPVAEFGYLKDLPEILHRIIHGGVSTRKP

SEQ ID NO: 185607 - protein, 52 aa, Triticum aestivum
  Clone ID: PAT_TA_80025.pep
SMLQDRLAANGFSVFQRQLVGFNSIPINCRRDANQSDCALHGLLLMLGADVM

SEQ ID NO: 185608 - protein, 92 aa, Triticum aestivum
  unsure (1)..(92): unsure at all Xaa locations
  Clone ID: PAT_TA_80026.pep
GFPPPPXGTSFPPRAPKPPKSPXRSQPPAPRSSPPPPEKKKKXGPPPFWPAKETGCQNPXELGXPVIPKNSPPKTGPRSPVLKGGGGGGAKL

SEQ ID NO: 185609 - protein, 191 aa, Triticum aestivum
  unsure (1)..(191): unsure at all Xaa locations
  Clone ID: PAT_TA_80027.pep
TRVPFLRLEGRKRGACLEPHAPSSFLSKKLVCFGDAPRRCLVFLFTPLLRADRLIRRSGRRLWTGGGEVCVWHGVLSGGVARFPSARSGDLRDGSGGRMLAAETRINIYLDAGKSAGGDRPSVLLRERSTTRPSPTPLLLYSFLSPXXWSLPSSIYYVNLVEIFFFAKLSVXQRFSSLSIIPFDNLYLQFD

SEQ ID NO: 185610 - protein, 150 aa, Triticum aestivum
  Clone ID: PAT_TA_80028.pep
SSPRAATLPPTHRRPRRAPHPPPTSPSLPSPSLPTLCPLPPASIPQIQSTQPRRPRTPYCPPWPPPPPPRSGSPPQPTTPPWGRVRGGCPSTPSPSAPAAPQSPPSPPPPRLRLLLRGLNELIDRACGVVWQLHDEPGAGRRRGAGGGVV

SEQ ID NO: 185611 - protein, 94 aa, Triticum aestivum
  unsure (1)..(94): unsure at all Xaa locations
  Clone ID: PAT_TA_80029.pep
MPSSAIPTALPRKENILLSWPAPGPGYVALTVDGSFQAADSSAAAGMVLRDHQGQIIFAAYRVLFHCNDALXXELHALMXXMALAIQHSDLPVV

SEQ ID NO: 185612 - protein, 153 aa, Triticum aestivum
  Clone ID: PAT_TA_80030.pep
HFPSPPLPPLHLLASPSGFIIRINTRSRNPDARSRSISLPSLVSSPSNRTPPARSRSTRQSFAMGKAKGRKGGGAVGGRTMKKNAFTESLRKTKLFEDGRLPNQCPCPKVTSAHQATSRRHQLMLHRLKARQFHRRRMWPLPMGDFTLVIHQY

SEQ ID NO: 185613 - protein, 191 aa, Triticum aestivum
  unsure (1)..(191): unsure at all Xaa locations
  Clone ID: PAT_TA_80031.pep
METGIGSVDGPKGAPSGAVACPATFPASSPTFVGSPEATLGRHLAQRLVQVGVGDVFAVPGDFNLTLLDYLVAEPGLRLVGCCNELNAGYAADGYARAKGVGACAVTFTVGGLSVLNAIAGAYSENLPLICIVGGPNSNDYGTNRVLHHTIGLPDFSXXLRCFTPVTCYQAVVNNLDDAHXXXDKAIXXXL

SEQ ID NO: 185614 - protein, 193 aa, Triticum aestivum
  unsure (1)..(193): unsure at all Xaa locations
  Clone ID: PAT_TA_80032.pep
HEEPELRLGAAGLLRRRPLPPRLLRPPFPRPPRNPSXXYVSAPPAFSADGRFLLVCSGRSVSVFSTSTGMLVSELEGHEGDVTAVVIVPPQSNAAAAAKLATHCWTAGLDGFLIYWDFATAELVRKVKVDAPVHSMVIPNISKKLKVTEVYFPFAFVSVEALSNKAIQDKAKGKPVTKELLGQLRIYDLWKGF

SEQ ID NO: 185615 - protein, 74 aa, Triticum aestivum
  Clone ID: PAT_TA_80033.pep
CQITQAVTEINWVFVYNLCKWSHYFNVTKWHETCCYIFQSTHLCRCCVFSVACLPEYAYHCLMKLLFALTTYPP

SEQ ID NO: 185616 - protein, 202 aa, Triticum aestivum
  unsure (1)..(202): unsure at all Xaa locations
  Clone ID: PAT_TA_80034.pep
TRHTAASEGSYLSALKGSHSAAWKQQQETXPSPTSGIGGGGGGYVDAGGEVEEKACPCGAGICLVLTSSTPRNPGRKFYRCPTRDNGGCNFFEWCDAPSPGAANARSSTSFQSDASIVNMPCSCGAGTCLILTTKAGVNVGRQFYRCPAQGGSSCGFFKWCDDQQQPRTAAPLQGGSSPYQAGATPTNQSMSKSSSGCFKCG

SEQ ID NO: 185617 - protein, 172 aa, Triticum aestivum
  Clone ID: PAT_TA_80035.pep
MVNRYLPFFQGVVLNQATPTHHPIPGNGNVAVNFDDEPPLLEELDIDTGLIWRKAVSILHPLRSVDPSLHAEADLSGPALILLSLAFFQLLAGKLHFGIVLGWATAASVFLYFISSMLLSPGRGGRGDLSLYRCASLLGYSIMSMTIFSAVSLFLPRGGGLIFAVGMGFVPR

SEQ ID NO: 185618 - protein, 86 aa, Triticum aestivum
  Clone ID: PAT_TA_80036.pep
HGWEEVFDKAAGQEAAAERRRVAGMGLEECVAEMEALRARTDRWDAPSSDEICRLGLAPASRSDSSSSSAASSSDRDSKQQLIEQP

SEQ ID NO: 185619 - protein, 81 aa, Triticum aestivum
  Clone ID: PAT_TA_80037.pep
YIVLYHIIAGSFGHAVCTRSGPSLALLAAVGVRRRPRRPEPLEDGPLPQVLAQAERVEEPVRRDAAEVPLEPVAQVGHAQR

SEQ ID NO: 185620 - protein, 201 aa, Triticum aestivum
  unsure (1)..(201): unsure at all Xaa locations
  Clone ID: PAT_TA_80038.pep
ARGWLAANKLVLLAFDLGPLKPSLPLLPFLLCAGLPIKLREGPQPTSHSASPGPPVADFLLPCGRSVLFLTGLALLFPHTGSLPLYVVHYLYCAQIFLTLDLVFSSVGLVAAAVLGSAMERQFRAPLVVASVNDFWGRQWNLMAVDLLRASAYKPVRARWGRDAGVLAAFLMSGVLHELLYWYMTLEPPTGEMLLFFTLXA

SEQ ID NO: 185621 - protein, 133 aa, Triticum aestivum
  unsure (1)..(133): unsure at all Xaa locations
  Clone ID: PAT_TA_80039.pep
LYSSMVYTYADYLQLTIHSRLPSDTLPGILLKKRKLQSLKTFTIKCITEMFTERDLSPINQHSPNPTKRRQQRAYAKFIQISNIPRPSLTINLLVCALKTVSHCNGTLIYNQRSSSGSCLCSXXXGCAALVTE

SEQ ID NO: 185622 - protein, 129 aa, Triticum aestivum
  unsure (1)..(129): unsure at all Xaa locations
  Clone ID: PAT_TA_80040.pep
RTPSPTSRCSRRRPATSGTWIRVQLPTSPAPPDMATGKLIMRSSSSGDLYPFLHNNGGSMALSVSSSGELWHLRLGHPSHVSLSTLMNNLLDSCNKSQGSSVCESCKIGKQPRLPFPHSTSFTTEPFQX

SEQ ID NO: 185623 - protein, 103 aa, Triticum aestivum
  unsure (1)..(103): unsure at all Xaa locations
  Clone ID: PAT_TA_80041.pep
SILRMKKEKTREHNNFCVILFVYDVATLEYNLWAREQTFKFGAVLYLIRFSNQHGINFNFVLHQISRATLYPNLHLMNLNYKNCDSCTVFCWVQHKAENRVPX

SEQ ID NO: 185624 - protein, 206 aa, Triticum aestivum
  unsure (1)..(206): unsure at all Xaa locations
  Clone ID: PAT_TA_80042.pep
SRPPVSAHLLRLRRRRTNRGSSDSSDQERRAGRKSTYAGGDEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGX

SEQ ID NO: 185625 - protein, 140 aa, Triticum aestivum
  Clone ID: PAT_TA_80043.pep
CVSQVAMDARMPPGPRPPRRVAIRPPGPSNAATSAVDARCQGPRARPHGAPHPLRRFGAPRLRLRWRHVRHPDASASIPLETGPEDLSRLDPPRAPAPTPPHPAARRSPQCRRCSSSCREEEDDASASSRSSDRVDPSSI

SEQ ID NO: 185626 - protein, 47 aa, Triticum aestivum
  Clone ID: PAT_TA_80044.pep
MEGYDREFWQFGDQLRLQTASFSGLSLGDSIWSPADAPAPATLFSPG

SEQ ID NO: 185627 - protein, 204 aa, Triticum aestivum
  unsure (1)..(204): unsure at all Xaa locations
  Clone ID: PAT_TA_80045.pep
MSEPWRLVGPITATAAARWKELHGERSWDGLLRPLDLDLRRTLIWYGEMAQATYDAFNYEKHSPHAGLSRFGRKRFFERVMLPGHAAAYRITRFLYATSSAPAAPAAAFVRSRHPRRRCKESNWIGYAAVATDAGIAALGRRDVVVAWRGTIQALEWINDLEFAMVHPKGILGDATGADAMVHRXGWFSIYTXTDPAXTHNNDS

SEQ ID NO: 185628 - protein, 67 aa, Triticum aestivum
  unsure (1)..(67): unsure at all Xaa locations
  Clone ID: PAT_TA_80046.pep
RTVGEDMHAWGWAGHSLLLCLFTNNNTTSNPVPLXXCQISRIIILHCFRQKKKKKTRLVSNSARGLV

SEQ ID NO: 185629 - protein, 91 aa, Triticum aestivum
  Clone ID: PAT_TA_80047.pep
FQKNKTRVGPGITPLHSLVRQFPTQLLAWHADAVDDRRLRDVFLCRRPSRRQAQSCTQPGTTSRRHHSSRCRRLGTQSGPPRPTQRTAARA

SEQ ID NO: 185630 - protein, 79 aa, Triticum aestivum
  Clone ID: PAT_TA_80048.pep
VSAFDKDQRYKEGKFILERSDPHASPFVLILLRSPLLLDRIASYSALLQDRIASYSALLQDRIASYSCSLSFYIILTSS

SEQ ID NO: 185631 - protein, 107 aa, Triticum aestivum
  unsure (1)..(107): unsure at all Xaa locations
  Clone ID: PAT_TA_80049.pep
XXXXXRRXXXRHHNVALRPNGRRRRQIMAGAGNLQPPHXGRAAGNRNAAAVAVVGERKQSRLLLALPLHGHADAGGVLHEHHHRSHLACLLRRALIKSKCQSLYTSX

SEQ ID NO: 185632 - protein, 137 aa, Triticum aestivum
  Clone ID: PAT_TA_80050.pep
WRTKACSGRRRGWLPCPSREPGGAHPEASFPPGFGPAPQYIQIQETAVLPTQVEVGDAKVQTEANSVLGKRSAAETARAIEENDVNSKIEKEKNKKLRGEENVTENEKGGKKEESEATGPGAAGELTGAKACARQEG

SEQ ID NO: 185633 - protein, 152 aa, Triticum aestivum
  unsure (1)..(152): unsure at all Xaa locations
  Clone ID: PAT_TA_80051.pep
HEALSLLVPLPVSGIKAPSPFAQLLRAPLPWAHGSIAEAESNTPPPRGQPNQRQPPSSPPPPARWIPLPSSAAPGGPVHSIQVRMVASIAGAAAAAASSAHAPAGRRAKREPVHMHAGIRRSRSEPHXXCSRRGGAXXAXXTTNRSIGVFPX

SEQ ID NO: 185634 - protein, 77 aa, Triticum aestivum
  Clone ID: PAT_TA_80052.pep
YIVHNFQNSNTRGFQLRFQLVFSHVASSSPSVCGSPSPYRVLTVRKYKDQLFFPSGERKREIQRSNNERLIVRIYVQ

SEQ ID NO: 185635 - protein, 127 aa, Triticum aestivum
  Clone ID: PAT_TA_80053.pep
TRLDPQFWRQSPAPTEPPSYHRQASSATAAIRQLPRPPRPPDSFSGRGHPPPPTAQPSGRRCGPSPAYSLPTASSHAIASNSRRGRRDARIPTLARYIIHIRLKSLSDPTRRPCPCTASIHQWWPRI

SEQ ID NO: 185636 - protein, 180 aa, Triticum aestivum
  unsure (1)..(180): unsure at all Xaa locations
  Clone ID: PAT_TA_80054.pep
MAAATGGGGGSREEGLTLLGFWTSPFALRARFALNLKGVPYEYVEEDLFGERGKSPLLLASNPAHGGKVPVLIHGGRPVAESLVILEYIDEAFPERLPRLLPPPDDPRGRAAARFWAACVDQKLLPTWTPLYAGSTAEERAGAARXXVAVLXXFEGELGDRDFFGGDGVGLVDVALGGFL

SEQ ID NO: 185637 - protein, 49 aa, Triticum aestivum
  Clone ID: PAT_TA_80055.pep
GPKKPHVTPKGGPKKKTPPPKTPFFFPGEPPNPGGVFRGRENFPGNPPP

SEQ ID NO: 185638 - protein, 208 aa, Triticum aestivum
  unsure (1)..(208): unsure at all Xaa locations
  Clone ID: PAT_TA_80056.pep
ARGLVPNVKKVDSAAISLQEEDDFLEVVSSMSRLRHPNIVPLTGYCVEHAQRLLVYEYIGNATLHDMLHFSDEMSRRLTWNIRVRIALGTARALEYLHEVCLPSVVHRNFKSANILLDEEHNAHLSDCGLAALTPNTERQVSTEVVGSFGYSAPEFSMSGIYTVKSDVYSFGVVMLELLTGRKPLDSSRXXSEQSLXRWATPQLHDIX

SEQ ID NO: 185639 - protein, 209 aa, Triticum aestivum
  unsure (1)..(209): unsure at all Xaa locations
  Clone ID: PAT_TA_80057.pep
FRSDRGKASTSSRRLVGVSAADVFFQEKFEDGWESRWVKSEWKKDENMAGEWNHTSGKWHGDAEDKGIQTSEDYRFYAISAEYPEFSNKDKTLVLQFTVKHEQKLDCGGGYVKLLGGDVDQKKFGGDTPYSIMFGPDICGYSTKKVHTILTKDGKNHLIKKDVPCETDQLSHVYTLIIRPDATYSILIDNEEKXTGSIYEHWDILPPRK

SEQ ID NO: 185640 - protein, 80 aa, Triticum aestivum
  Clone ID: PAT_TA_80058.pep
VLNILCFNPLGVNFCDAASKVGNRYSITIMICTGISPRCINHNHSVFIWQAGATQNFRFSCQDGWIEPGDPLSGIIVQLS

SEQ ID NO: 185641 - protein, 174 aa, Triticum aestivum
  unsure (1)..(174): unsure at all Xaa locations
  Clone ID: PAT_TA_80059.pep
MRPSRGDLAVLCRCFLLLLLPFLSHGKDMPLGSTLSPGGNSAAWSSPNSTFSLAFAPSPTAPSLSVAAVTYAGGISVWSAGAGAPVDSGGSLRLSSTGDLQLVNGSGAVLWSSGTAGQGVSAAALQESGNLVLKNSTGGALWQSFDHPTDTVVMSQNFAXGMNLXSGPYVFAVD

SEQ ID NO: 185642 - protein, 122 aa, Triticum aestivum; identical to SEQ ID NO: 179533
  Clone ID: PAT_TA_80060.pep

SEQ ID NO: 185643 - protein, 68 aa, Triticum aestivum
  unsure (1)..(68): unsure at all Xaa locations
  Clone ID: PAT_TA_80061.pep
KKLLKAKTLNFYTINACSQAFHNIPWVPPXXKXRDRHRPTNXGGSLYPLPQSXXXAXXSLRAAHQRNS

SEQ ID NO: 185644 - protein, 186 aa, Triticum aestivum
  unsure (1)..(186): unsure at all Xaa locations
  Clone ID: PAT_TA_80062.pep
MEGELTKKMERKLRKKQKKLLKKMGKEKPQSLVKEIISVERERRDLHASLTPTFSVWKEIDSQTTWTIATKDPATATTRDDENQLAEYFNLMLQDMEDLGHRMLSMLYFLNKSNDPICSYKATELCNTAAKLNMQISKGFSMYHEPEQEPEPGQINLSTLFSKYYRFPNNYENTLAKLDXXXXXCC

SEQ ID NO: 185645 - protein, 199 aa, Triticum aestivum
  unsure (1)..(199): unsure at all Xaa locations
  Clone ID: PAT_TA_80063.pep
TRELRPRPDHGYPGRTYKFYDGPYVLYRFAHGLSYTKFRYESSAGNGTAVTLAAGGHCKQLSYKAGAVDTAPSCPAIDVASHACKETVDFNVSVVNCGDVDGSHTVLVYTVPPPEVAGAPIKQVVAFQXVFVKAGRAATVGFSLKVCEAFGIVEKXAYTVVPSGVSTVLLENGDTSSPSSVSFPVKISFSTSFPRFFCF

SEQ ID NO: 185646 - protein, 102 aa, Triticum aestivum
  unsure (1)..(102): unsure at all Xaa locations
  Clone ID: PAT_TA_80064.pep
XXXXQMXSDLSEKXXXLDCRQIXXLAERXKEVSKIQXXQWMRLSFQGIMVFFWYYTLYCHDLQDPLTRGDVKMVKHARPEMPVTVSSSRTVAAVTRLKVTAV

SEQ ID NO: 185647 - protein, 102 aa, Triticum aestivum
  Clone ID: PAT_TA_80065.pep
FEDLANNVENLEFMKTKNSGSLTTANKTETGQQPLCQVLRFHGIISLRISKSFLADCTLFVKKYRVTCDKCITISFMSVFDLLNSQAEGMCKKETKINHSPI

SEQ ID NO: 185648 - protein, 207 aa, Triticum aestivum
  unsure (1)..(207): unsure at all Xaa locations
  Clone ID: PAT_TA_80066.pep
LAFTAALSPLPLAKGLEASPRAMAPRAQKQLFPADAVSSDHDLHSTASSISNAKRSVVVRPRALLSVVLAEVGLPEVKYKTYAARGGCFAATAYFWPSPSGSSAAGPHMRLNGEPVVDAQEAIQNAATLCLENLQDSMDIEFDCPRVKKMKTDKRYLLNSIAGKDREIKDLETKLEKRKMQVNGLGKXXXXFAQDVRRSAGRIDXXP

SEQ ID NO: 185649 - protein, 53 aa, Triticum aestivum
  Clone ID: PAT_TA_80067.pep
LSSSVPLNIKPHKEMQEHKFNGYLLPNYSCHILQERQHGGPSRTLFWNHDIKC

SEQ ID NO: 185650 - protein, 62 aa, Triticum aestivum
  unsure (1)..(62): unsure at all Xaa locations
  Clone ID: PAT_TA_80068.pep
EALFVFVSIVKLDSFSRQEEXVPCSFKFQNLCEEIIHWGWFVKKKKKKKQKKNKXKKKKTRD

SEQ ID NO: 185651 - protein, 177 aa, Triticum aestivum
  unsure (1)..(177): unsure at all Xaa locations
  Clone ID: PAT_TA_80069.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGXXDYLGNPSLVHAQSILAIWACXXVLMGXXXXYRVA

SEQ ID NO: 185652 - protein, 134 aa, Triticum aestivum
  Clone ID: PAT_TA_80070.pep
AAPVGSRRRTAARAPASPARRARAARRPSTAWTGPRSPQGTGTPPGTAGRRSERSAAAGAATSRRGGPRPRAPTWQIHPATPRTRPSPYPQPPPPVPLRQSGAPPAAAPRPRRARRRGRASRRPQRRRGGGRPS

SEQ ID NO: 185653 - protein, 72 aa, Triticum aestivum
  unsure (1)..(72): unsure at all Xaa locations
  Clone ID: PAT_TA_80071.pep
TRMCPMSNQFFEESAEHSVSGSHENGHHXXXMLIDXXNENDIFGEAXXSTATSATSVPTADLMSIDQLLEXV

SEQ ID NO: 185654 - protein, 96 aa, Triticum aestivum
  unsure (1)..(96): unsure at all Xaa locations
  Clone ID: PAT_TA_80072.pep
MWLRXKGLSAYYQGKSQSFACMAEVRCLEDLQKKEKPRGHKMKPCKSYAALGGVAMARKPPGSSCANLGLMDAGNGFMAPRNIPVNDDCYHQLGSV

SEQ ID NO: 185655 - protein, 73 aa, Triticum aestivum
  Clone ID: PAT_TA_80073.pep
APHRRPVVHLRLVRPAKDAAKDLVSSSSNSSSTQQARLRHDNRHRLAAYWWTPHLVFVACCGCVIHLLFGISI

SEQ ID NO: 185656 - protein, 63 aa, Triticum aestivum
  unsure (1)..(63): unsure at all Xaa locations
  Clone ID: PAT_TA_80074.pep
CFXXXXXXXXXXXGIFCICCCTTYDFSCGNNLYRPTPSYRVHGMLGLRTHALTSLRQVARRYN

SEQ ID NO: 185657 - protein, 167 aa, Triticum aestivum
  unsure (1)..(167): unsure at all Xaa locations
  Clone ID: PAT_TA_80075.pep
MCVQRGRKPPGILDGLYGIQIARRLPQAQSEGEAVRTSFTDSPTCEHQNGGRTVTQQHQRLLIRRLWQQRPSCLKPIHCGITCDKHAGETFANVVTSLPFIVLGLQTPRKNLNAAIYANSLVGVGIASGLYHSSXXXXRKILRWADYTMIATTTLVSHALCSNYLHS

SEQ ID NO: 185658 - protein, 95 aa, Triticum aestivum
  unsure (1)..(95): unsure at all Xaa locations
  Clone ID: PAT_TA_80076.pep
XXXXXPGLGPGXTQXXVKNNRVLVTTGEPRRKKKKXPKXXRREPRRAKLRRKLXPPENPXXKKIPPVSREGGLPVPVKKLPPPEPKKPKPIQVQV

SEQ ID NO: 185659 - protein, 97 aa, Triticum aestivum
  unsure (1)..(97): unsure at all Xaa locations
  Clone ID: PAT_TA_80077.pep
MAREDRKRRQPDGDEAADEGERRGRRDKXPKEEKPAPPLPSEIRNKEKRSEVYAKLKREKKAQKRXXGRERGQAAQRAAELGEEVPXXXXPRTIETX

SEQ ID NO: 185660 - protein, 172 aa, Triticum aestivum
  unsure (1)..(172): unsure at all Xaa locations
  Clone ID: PAT_TA_80078.pep
MAPTAAEXXQQHTKKAVGLAARDASGHLAPLAITRRSTGDDDVQIKILYCGICHSDLHSIKNDWKDATYPVIPGHXXAGEVTEAGKNVTRFKAGDRVGVGCMVNSCQSCESCDXXFENHCPGMIFTYNRVDRDGTFTYGGYSSMXVVHEXXVVRFPDAMPLDXXAPLLCAGX

SEQ ID NO: 185661 - protein, 102 aa, Triticum aestivum
  Clone ID: PAT_TA_80079.pep
MVSTSGTVAVVVVILSVLVAPASCRRALVAANNGSGRETEAADQCVHGCLGEMLACQQASAGCATVTAATSSPLQTTSQRQRSVPCGYGGCEDEYLGCIDVC

SEQ ID NO: 185662 - protein, 157 aa, Triticum aestivum
  unsure (1)..(157): unsure at all Xaa locations
  Clone ID: PAT_TA_80080.pep
RERGRADTHRAARPRRSSNQHPLGAAAELGAFAGAAMEREATVAFYPPAPAPPQQRPTPAQPLSARAPPSGVVGRGGGGGWAGRQYRGVRMRKWGKWVAEIREPNKRSRIWLGSYATAVAAARAYDTAVFYLRGRSARXNFPDHLLAPAVPGDLTIR

SEQ ID NO: 185663 - protein, 153 aa, Triticum aestivum
  unsure (1)..(153): unsure at all Xaa locations
  Clone ID: PAT_TA_80081.pep
MGDVSTIQRPPGTAAKQGDQVGELVSAGWTNDTHNMYISSMEASFMQQLRGQQQQHHHAAPDRNITHVGLVGHGLKPYQEXASDNLGSEKNVPRPRDVGARSLPEDPWARRFKPRDSAMNRRGDXXGASDGESGTDTVQGMAPKHGREVISCX

SEQ ID NO: 185664 - protein, 168 aa, Triticum aestivum
  unsure (1)..(168): unsure at all Xaa locations
  Clone ID: PAT_TA_80082.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPXHRYCLLGQLSXXVGWNYADTIXXLXXKXXES

SEQ ID NO: 185665 - protein, 157 aa, Triticum aestivum
  unsure (1)..(157): unsure at all Xaa locations
  Clone ID: PAT_TA_80083.pep
MASNQNQASYAAGETKARTEEKTGQMVGTTKDKAGQATETTKQKAGEAKDKTAQTAQAAKDRAAESKDQTGSYLGEKTEAAKQKASETAQYAQERSSDAAQYTKDSAVAGKDKTGSVLQQAGQTVVSXVVGAXXAVANTXXMGGDTTTXXTTTTRNH

SEQ ID NO: 185666 - protein, 160 aa, Triticum aestivum
  Clone ID: PAT_TA_80084.pep
ARGLVPNSARGSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARARAR

SEQ ID NO: 185667 - protein, 194 aa, Triticum aestivum
  unsure (1)..(194): unsure at all Xaa locations
  Clone ID: PAT_TA_80085.pep
DISDNADVQDGWKLEELSSLPQMMYLNLVKLERTAHFHTNVVLEDKKHLKELVLEWTTHGEGPYSEDVCNAEKVFELLVPPCNLETLYIFGFFGQRYPTWFGTTCLSSVTHLFLKNLQSCVDLPPVGQLPNLKFLRIDGAHVVTXXGPEFVGYRVGEPISNEFIAFPKLEWFFVXXMPNWXXWSXXXXVENVVD

SEQ ID NO: 185668 - protein, 123 aa, Triticum aestivum
  unsure (1)..(123): unsure at all Xaa locations
  Clone ID: PAT_TA_80086.pep
SFFLPQRPILLHYAHNQGPARRCWRHPQPSFSEEMLEAPPLSCAGVRGWIFKVFCNMVVVFATQPLFXXLFLQHGRCFRIVSAISKFLQHGSCFCNAAVVSRIASATRPLFRELFLQRDHCFK

SEQ ID NO: 185669 - protein, 100 aa, Triticum aestivum
  Clone ID: PAT_TA_80087.pep
FFFFAMTYHFVHVIGQNSDDNSYWHWNANHSTTIITQLASKLQPETYKRRIPFRPVQLDPCPSIIRLLVGKRLPHAVQMGFLGLGPVGGAVPPWSRLLPP

SEQ ID NO: 185670 - protein, 197 aa, Triticum aestivum
  Clone ID: PAT_TA_80088.pep
MNLPVIACVLLLLLDLNVSPVEPSRPQGLAKGRHTPGKGNHHGHSGHSGDDGHQHDHSDDYNGYSFYVFGDSFADNGNLVKMNPRSELNRQWRYPYGLSGRFSNSLVQSDLIAYMLGQKKSPPAHRLTRKVGKAGLNFAAGGSGVFDAPDTQTLARQIHTFHKLVKDGDIDQDRLASKSVALVAVSGNDYARLPADT

SEQ ID NO: 185671 - protein, 65 aa, Triticum aestivum
  unsure (1)..(65): unsure at all Xaa locations
  Clone ID: PAT_TA_80089.pep
RPPKRPEAHGKTNPWSSSTXXXGSKILKGPGPKPFPGGNLNQRNPLKKNTPLKIGEWAPPGKTKR

SEQ ID NO: 185672 - protein, 192 aa, Triticum aestivum
  unsure (1)..(192): unsure at all Xaa locations
  Clone ID: PAT_TA_80090.pep
MAAAAAAVTVTATRLHPPLVLHSAARPQPTLRLRLLLPTPPPLRLRHRFPLLAVASAGESRAEEAAEKSDKARQLQRRVLVGIAIGVGAGGVVVAGGWVFTAAMTAVVLAGAREYFGLVRGTASGGSTPPPRYVSRVCSAICALMPILTLCYGRMDVPLTLSAFIIAISLVLQRGNPRFAXLTSSVFGLFYX

SEQ ID NO: 185673 - protein, 155 aa, Triticum aestivum
  Clone ID: PAT_TA_80091.pep
HEAPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARARAR

SEQ ID NO: 185674 - protein, 157 aa, Triticum aestivum
  unsure (1)..(157): unsure at all Xaa locations
  Clone ID: PAT_TA_80092.pep
ARGITPATTNSPPRPRSAPSPPPPTXPASRSGCRAATDPRIRPPRRHRSWIRPPRCPPLLLTSLPLCPHEGMPSPCAPRSAAIGGPPTHLPFLSSSPSFSLTPYVSPCGRSSPPKSPEHRTPRIWPGDEAEPSRPDPLQQPGSSPPPPRAQLMHPHP

SEQ ID NO: 185675 - protein, 86 aa, Triticum aestivum
  Clone ID: PAT_TA_80093.pep
KTSIETYVYVCCQPTVETESRDTIHIMSNNFRSKFNNRSSILDWCLSSEVSLSRFLSVSLLFTAICTVMAIYRITRFKPCEASTLL

SEQ ID NO: 185676 - protein, 147 aa, Triticum aestivum
  unsure (1)..(147): unsure at all Xaa locations
  Clone ID: PAT_TA_80094.pep
FIAVSSSPRARAPWPKPLIHVRAHVLLVAPSRATHARALGPRMRLRSSSPATAAVAALRCRGRTLLYLLLLAALLLPRYASQRARAPRPRSPSADAALPCLLLFCCRYCSFLLLPLPGTALLLLPVVATTASVAWLLLXLLAIAGCC

SEQ ID NO: 185677 - protein, 135 aa, Triticum aestivum
  unsure (1)..(135): unsure at all Xaa locations
  Clone ID: PAT_TA_80095.pep
PNPPPPGGNPPPTHPSNFHSTTLGRSAFXFTHFFFGAWLPFGTHXXFKGANSFFXPFRAPGFIFFPPPGFSPTGPPQEFLGQAFRALGWPPPPFFFSPXFFWGGQGPNNKGFSPNPFFXGXKXXFNRXXLDSFLF

SEQ ID NO: 185678 - protein, 69 aa, Triticum aestivum
  Clone ID: PAT_TA_80096.pep
FFFFIMSHTAIILYTALSRSRVRYSTTLSQIESRIIYGLLHLLASVAIRCFCCGLIWPLISPADHATEQ

SEQ ID NO: 185679 - protein, 56 aa, Triticum aestivum
  Clone ID: PAT_TA_80097.pep
TIAKSSVLIYHLPNYHFRAPMFVTSVSKPSASVCLVGINILFWCLKCVCFGSVLPL

SEQ ID NO: 185680 - protein, 91 aa, Triticum aestivum
  Clone ID: PAT_TA_80098.pep
MLSFVAMALCHIRHNQNLTFKGSFVFQRCLNDLSGPASERWTVSELLFAVFLFVCATYNLVYGSDFYFIYIYLQAITFIIVGTGFCGTSNS

SEQ ID NO: 185681 - protein, 145 aa, Triticum aestivum
  unsure (1)..(145): unsure at all Xaa locations
  Clone ID: PAT_TA_80099.pep
TLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXXSTLHLVLRLRX

SEQ ID NO: 185682 - protein, 210 aa, Triticum aestivum
  unsure (1)..(210): unsure at all Xaa locations
  Clone ID: PAT_TA_80100.pep
TREPQRPIPNSSRSPHPLPLVFSRAAALLHRRPATRTAATPSLPEARAGALGLVFSRGQPPRRRPPGPPPRPASSSCSRSPTTSPWMAAAXSASSSSRGGRPQPLPPAAPFDLAAGRARSSATAPRRRSPAPLPPCFVRRDVRPPCRHVAAPPASTSLPPLAAAAPCXSSASSPAPSXSSAPIPCCISVGTIAVLWSSCLSRPLLLLSSL

SEQ ID NO: 185683 - protein, 174 aa, Triticum aestivum
  unsure (1)..(174): unsure at all Xaa locations
  Clone ID: PAT_TA_80101.pep
MWPTSLGTPETDKLICLGLMVPSGCRLPKAFRITADGYPTRGXGATPEQLRRHIGGRWNPDGRHAFWDSKDFWXVVAECRREARWLGLTPAATAPPLPPAVEVPAEQAAERWRAARRRGPAAAPTAPPLPPAVEIPAEXXVLREEDDLDDTPGYLIALRASXXAAVXXXXRXXX

SEQ ID NO: 185684 - protein, 100 aa, Triticum aestivum
  unsure (1)..(100): unsure at all Xaa locations
  Clone ID: PAT_TA_80102.pep
MARGLKKHLKRLNAPSHWMLDKLGGAFAPKPSSGPHKARECLPLILILRNRLKYALTYREVQSILMQRHXKALTGCLTSLVELLPPSHHLVLTRPGSAFL

SEQ ID NO: 185685 - protein, 134 aa, Triticum aestivum
  Clone ID: PAT_TA_80103.pep
HRIPIAFAPPHLSVPAGTSVPGAQMAPDTDSTETRKRRNEDAVQMDPCKRQAIQSLEVDNQVCQHMTEGDLNEYTHLKVENQQLHEECLELEVAGKELLLKEQQLRLQIQQAEAQYKSLLNEYISATPVRTRMQ

SEQ ID NO: 185686 - protein, 204 aa, Triticum aestivum
  unsure (1)..(204): unsure at all Xaa locations
  Clone ID: PAT_TA_80104.pep
TRVIQGSDSVASWQANLLFEPTAFEDTGVLVHRGIYEAAKGIYEQLMPEIVEHLRAHKDGARLRFTGHSLGGSLALLVSLMLVARGVVGPESLLPVVTFGAPSVFCGGQRVLEALGVGEDHVRAVAMHRDIVPRAFSCRYPGHAVAVLKRLNGALRTHPCLNSQKVLYTPMGTTYILQPDGKASPHHPFLXXXAALXXXXXPGR

SEQ ID NO: 185687 - protein, 149 aa, Triticum aestivum
  unsure (1)..(149): unsure at all Xaa locations
  Clone ID: PAT_TA_80105.pep
MQDAATQLDQLDSAAAYIKQLRARIEDLKRRKQAALSGNTVGCSSSVSAGDYKSQTAALPVIEVRHQDGTLDVALASEAGRPFRLHEVMAVLEQEGAEVVSASFSVVGDKIFYTLHSQALCPRIGXXAXRVAQXLRGLAAAATVSALLT

SEQ ID NO: 185688 - protein, 134 aa, Triticum aestivum
  Clone ID: PAT_TA_80106.pep
TRLPPPYVLLSPLSIDVRNRHNSYLMGEPAEGASLGPARAPLDPRTDLVETEESDPVAEVTASSSLESKEEKVEQGNTRKKIRRSTNADMTKYQRCSRPGVVGLKADKAKRIIRKGKPDLFCSVVPENQFLTMA

SEQ ID NO: 185689 - protein, 177 aa, Triticum aestivum
  unsure (1)..(177): unsure at all Xaa locations
  Clone ID: PAT_TA_80107.pep
TRANRTKKKKRKIPPVRPQPTDPRPPWFPRAAAIGPGSRTPPPSSRDPHTPPTTLRFPRVAVEPXDPHAPPPDLESPRSAIPGIPALGEASDPHAPPPTQLLHXPPPRSSHPPRPGHPPTAPSPSPPQPPPPRHAIGPSDPRHTNSPEWCCPKRSSLHHCNPPSLHERCCITKTHCH

SEQ ID NO: 185690 - protein, 167 aa, Triticum aestivum
  unsure (1)..(167): unsure at all Xaa locations
  Clone ID: PAT_TA_80108.pep
MPPPRALIPALLPPMRMTQTCPHGRRPRGSLNCCTTGTARGRRSASLPSAPXLRLLPPPAAPAPSPASDAGLRALGLLSFVHLDLSPSPSSGGMRSDLVTALIANYLPTLEWSYARGAGFEISRGTFAAALCLPAPRSTASVHHEPPSGVDPAAVASAASXSWXRTS

SEQ ID NO: 185691 - protein, 177 aa, Triticum aestivum
  unsure (1)..(177): unsure at all Xaa locations
  Clone ID: PAT_TA_80109.pep
TWAAGRXERRRRPGARPSPXXRQRRRTXXARRGPDPPARRRHSPAASWKAWSAPXRVEQRSPHGDLLPPGXHRRTATSQAACRSPRRRPAPVACPTPTSSAFPPPGTPGTSGTLGGSARRRRPGTGSTAATSPPWRPRRRHASAPRPRTPTVAVQARTSRSSPASRTSAARRRTGRR

SEQ ID NO: 185692 - protein, 143 aa, Triticum aestivum
  unsure (1)..(143): unsure at all Xaa locations
  Clone ID: PAT_TA_80110.pep
MDAVGELAAAGMHHHHHHHHRCKVCGKGFSCGRSLGGHMRSHISLGEALPEADDELMRRSSANGGRTSANGAVGYGLRENPKKTRRLSDFADEEEDQGGDGGEQXACRECGKLFSSWRSLFGHMKXHAPGAARDHDEYDEADD

SEQ ID NO: 185693 - protein, 106 aa, Triticum aestivum
  unsure (1)..(106): unsure at all Xaa locations
  Clone ID: PAT_TA_80111.pep
ARHLPRHPSPAPPSCPQPLTRPPPXPPAGFPSRALARPLPPPPAXGPSAAAPARPLARPRTLLPPIRRPPPPASLPETARLAAVDPPVVVXXSAGHPHXXRPSPPI

SEQ ID NO: 185694 - protein, 212 aa, Triticum aestivum
  unsure (1)..(212): unsure at all Xaa locations
  Clone ID: PAT_TA_80112.pep
NNGAPSPLPPLPGHRRPAPPLPPATLFADVHXVSPCPSPAARTLTPRWLPRSTVGSPSTSPAYDPRPSELYDPRPRFPPRGLPRSSLLSDALSPSAAPPLRFLPPPYGLPRSSPSSYKAAPMLPSTPAPRLTPSSSLPVNPFXPRPPSSGTGTGRCTAAASTRPSSSPSSPRSPRPTPSPSPTCXPPASSARASPPSAXXXXSSAPXPPAPS

SEQ ID NO: 185695 - protein, 78 aa, Triticum aestivum
  Clone ID: PAT_TA_80113.pep
FFFFKESAKHLHLLSLPHPCHDINFHDSPNANLHLHNHSSQCETRAAVVSSNTLRITFGGNIRSYLQFPTGYPILLME

SEQ ID NO: 185696 - protein, 42 aa, Triticum aestivum
  Clone ID: PAT_TA_80114.pep
GQIRLRVPSQVNPLSLGFLMLVSANCFNFILVRLRIEVVGKP

SEQ ID NO: 185697 - protein, 146 aa, Triticum aestivum
  Clone ID: PAT_TA_80115.pep
EDAEDNNKKKKKKKKRVKLRAFRPEEMQAPNFTLGMSFSSVVELRRAIQNYIIQERVEIKYAKNDLQRVRAHCVEGCPWYLFAAPDSRTKNFVVKTYVGTHTCSKEWDIKQFTAKFLAAYYIETFRADDKMTLSNFGRLVRKDYAL

SEQ ID NO: 185698 - protein, 57 aa, Triticum aestivum
  unsure (1)..(57): unsure at all Xaa locations
  Clone ID: PAT_TA_80116.pep
LKTPPFKLIXXKIVPSRNQGXGFPEFSLKKVFFRSCPLTLKPPNQFLTYPGKTCNGS

SEQ ID NO: 185699 - protein, 73 aa, Triticum aestivum
  Clone ID: PAT_TA_80117.pep
HEAQVHSWRRLSGRGGCWCCIEFNAKLAGGDGLYGDGDGQPSQSSMHAPTWLARKSSVKEKKRVKRLLACCRC

SEQ ID NO: 185700 - protein, 153 aa, Triticum aestivum
  Clone ID: PAT_TA_80118.pep
ARGRGAPPPPAARRPRPPNRDISPPSPPDWSLVAPCLPLLLLAVSLAACWAGRADDHGVHSVLSVPLLSALLGVAVALVFLAGYLRRKRADIAHVPPSAAAAAPDLPKQARPAGQNKKGRGHARVHHHHASAADKVSSFLFSSYQAFHTLKVL

SEQ ID NO: 185701 - protein, 102 aa, Triticum aestivum
  unsure (1)..(102): unsure at all Xaa locations
  Clone ID: PAT_TA_80119.pep
HEDVPLFLLLLAVAFLASPVVGLPPGGCYETATKVSRRCSGEFIKALFSDDLHGVSRKCCDELTCVREQSCFSVLLWYCPPXXWAHCYGGKAAAGVPLQGSP

SEQ ID NO: 185702 - protein, 155 aa, Triticum aestivum
  unsure (1)..(155): unsure at all Xaa locations
  Clone ID: PAT_TA_80120.pep
RXXLRDSRPCRCSXRLRLPVTNRVHILLCCLELFAKIGNPHIHGFNLGEKGGQRRLNTLGILSHGGDDQLGLGGRKWRLRRRRCGPLRTQRTPLGISSEFCGSKFRTLRGGILPPNQEDLGADERGFKALDTSCEALASLTDQQVGFERGSGRTG

SEQ ID NO: 185703 - protein, 105 aa, Triticum aestivum
  Clone ID: PAT_TA_80121.pep
LDWILEQFSTQIPSLTRCGSDRQHSASYGASKVRRLVVAENGDWPRMLLWERRQHGLMGERGAGGARLMAERRGVLMGGRRCGLMFCADRFSFACRVKEARDPHL

SEQ ID NO: 185704 - protein, 159 aa, Triticum aestivum
  Clone ID: PAT_TA_80122.pep
MARAAVVIFFFVLAVAAASAAQAPAESPKAPAASAPANAPEVAKKAASAPASRKSGPGAAPASKSSQAAFSSPGARAWASTGEASSPLVPMAVVFPIADGPGAAPASKSSQAAFSSPGARASASTGEAASPPAPVSYRRRARCRASQQELLFTGCRLPA

SEQ ID NO: 185705 - protein, 114 aa, Triticum aestivum
  unsure (1)..(114): unsure at all Xaa locations
  Clone ID: PAT_TA_80123.pep
MRWKLGTAAYKRVPSRDAAMDPDLETPDPTAEKTPDGGGGGXXAGPSWRRSLPHVCVATVTSFLFGYHTGVVNEPLESISADLGFAGNTLAXXLVVSICXXGAFVGCLFSGSVX

SEQ ID NO: 185706 - protein, 123 aa, Triticum aestivum
  unsure (1)..(123): unsure at all Xaa locations
  Clone ID: PAT_TA_80124.pep
PNNAAVYXXXEDSDKTVFLNEVKSIKNIVLPDWMILGHFNLICHVSDNSNANINLRMMXRFRNMIEDLELQEIALNGRRFTWSKERERESSVHFKIDRVNLGSRATCNISCLWPQLSFRITAQ

SEQ ID NO: 185707 - protein, 126 aa, Triticum aestivum
  Clone ID: PAT_TA_80125.pep
IRSFHQRPPVGKGDDVLDSASSSFQSDASTHPLPRHRRRRRMPVLRASPPLPPRPLHVLADDGSRNRPRRPRHLHLFHDLAKPPRESCSRCCSAAGELRVMMNICLLLRVMPWYLSLVLIDASHFC

SEQ ID NO: 185708 - protein, 202 aa, Triticum aestivum
  unsure (1)..(202): unsure at all Xaa locations
  Clone ID: PAT_TA_80126.pep
PPTPSLRPPRPPPPPPPPTPAPLPSPPLPPLRPSQAPQSLHRPKTPSPPLPPPPPPTLAPSSPPRPLPPSRPPXPPTLPPPTPSPISSPPPTLPAPATAPATSPPAPAPVATAPTLPPPMAAPALSPPXSPPRRNFRRPLRPSRRRPSSSPPRLPRRARSPRPRSTCPPPRPPCPPRRRRPPAAASPPVPARPPPTCRATRR

SEQ ID NO: 185709 - protein, 163 aa, Triticum aestivum
  Clone ID: PAT_TA_80127.pep
WRARRRRACPRCSTRTTSSERSSSASASPPASSAPPASARAGSATPPTARSSAVSASSTRPGSSASTSRTGSVRAARASSRRCLCPRISPPSSAAQASAWTPHAAPQASAPTPTRTGGPTWWAAGTAASSPARRGRITRTVDLKSYLKCTARYAPAPSSQHYT

SEQ ID NO: 185710 - protein, 174 aa, Triticum aestivum
  unsure (1)..(174): unsure at all Xaa locations
  Clone ID: PAT_TA_80128.pep
MGKWIRSLVGLKAPSASAAPGKGRKWSRLWRGASRDGAGGCETSSTTSSATALGSVVARAPPADFRVIRQEWAAVRIQAAFRALLARRALKALRGIVRLQALVRGRLVRRQLAVTLSRMEALLRVQERAMERRARCSADAQSQDAPGHRDGRADPLRETXXRWCXXXXSVNQVK

SEQ ID NO: 185711 - protein, 125 aa, Triticum aestivum
  unsure (1)..(125): unsure at all Xaa locations
  Clone ID: PAT_TA_80129.pep
XLKIKVQNTIIKLIKLQKPISLSAQRNWGPIQVCKRTRLTQQVDRTHTKSELQQLIGPSPQQIHVIIRWINTSPLYSPQQNIAWQSNDGTDTYLHRIPEILDASAIPCEIQELGELGWKEGREKV

SEQ ID NO: 185712 - protein, 193 aa, Triticum aestivum
  unsure (1)..(193): unsure at all Xaa locations
  Clone ID: PAT_TA_80130.pep
MATFRVADASEYLAITGWGIDDVKLAKKAWVFVGQQCKKFSISPVNYEFEVHAMSAEKLPFILPAVFTIGPKITATGAEASDKRDLEAQLLLYAKLIAPLHRSRSHVHELVKGIIEGETRVLAADLTMEEIFKGTKTFKEKVFNRVQLELNQFGLVIYNANVKQLVDVPGHEYFSYLGQXXQXXAAXXXXXDV

SEQ ID NO: 185713 - protein, 78 aa, Triticum aestivum
  unsure (1)..(78): unsure at all Xaa locations
  Clone ID: PAT_TA_80131.pep
FLFFPFLFLSSCCFPFFGCYAWHPTLLFLHICYKDTCSSSRPLLLFLFLFLLPLLRLFCFPLFLXPQXRLPSPXGPHP

SEQ ID NO: 185714 - protein, 107 aa, Triticum aestivum
  Clone ID: PAT_TA_80132.pep
MFFFFVGGVEQGAGRVLKEAAGRCVRCGGAADLVETEKVLKLFFVPAWRWPGKDPAYLCRDCGLLAPGSHGAGGGELLPRAGAGQCGACSRAVDPQFRFCPFCGSAL

SEQ ID NO: 185715 - protein, 183 aa, Triticum aestivum
  unsure (1)..(183): unsure at all Xaa locations
  Clone ID: PAT_TA_80133.pep
MTDGGDPGVCDECVEACWLACCCAFFPGRHRRQGAHXVACALVAFAVLAVGVTLLARHHVYRPPLGVTVEDAALARLALADRNATATALAYDVSLAVALHNHHWLRRALHTAPLDAELLFAGARFARVELAXXGXXGPGGXSEAYRAVAAADRAGVALGSAGVAEFVREXXXXVFRLXXQVVG

SEQ ID NO: 185716 - protein, 171 aa, Triticum aestivum
  unsure (1)..(171): unsure at all Xaa locations
  Clone ID: PAT_TA_80134.pep
MDMARYVAFHQQWIAGQQAGLRELAEAAANAAAERATDAELRAVVERCMRGYQEYAASRRAMARENGAAFVAPPWCTAFENSVLWLGGCRPSLAIRLLYSISGEGLEEDIEEFVSGRGRGLAXXMGLIGITATQLQQINDLHRCTLRDEGYLTERLASLQENIADRPLLPI

SEQ ID NO: 185717 - protein, 69 aa, Triticum aestivum
  unsure (1)..(69): unsure at all Xaa locations
  Clone ID: PAT_TA_80135.pep
VVRITISDDPSLLFLGMRVLYPCGWIYYSDALAQHLERCCSSCNASFSVAQPSGMPMTQKKQLHTDPXX

SEQ ID NO: 185718 - protein, 138 aa, Triticum aestivum
  unsure (1)..(138): unsure at all Xaa locations
  Clone ID: PAT_TA_80136.pep
ARGDAKAALPPTSTQEQQKQEEGGGGDGSYGVLLYYKYADVPDAPALAAFYESRCRALALVGRVRVGPDGVNATLGGRMAALEKHIEEMSSNSLFDGTDFKLASCEDPIDEXVARECGFTSLSVRLVXSWLRXVPTHR

SEQ ID NO: 185719 - protein, 170 aa, Triticum aestivum
  unsure (1)..(170): unsure at all Xaa locations
  Clone ID: PAT_TA_80137.pep
MATSSSSSWLRVLLLAAAVTVVAARHHHPGFEKIFEVQEADRVEMLPGQTEQVGFRHFSGYVTVNETHGRALFYWLYEATHDVAKKPLVLWLNGGPGCSSVGYGAMMELGPFLIXXGKPEIALNPHSWNKEANMLFLESPAGVGFSYTNTTADLGQFGDNLTXHDAYXXL

SEQ ID NO: 185720 - protein, 81 aa, Triticum aestivum
  Clone ID: PAT_TA_80138.pep
YTCFLSTIHTETTDLHLMLHVRRNVACSAPFFCFLPLFTDNCSHYLYLNLLSVRVTRHSPIHSINSFFLTSIFRSTTTKAN

SEQ ID NO: 185721 - protein, 151 aa, Triticum aestivum
  unsure (1)..(151): unsure at all Xaa locations
  Clone ID: PAT_TA_80139.pep
FGTRLTLPEGSPPPFSLTGNDMNVTFYLRCPFNASPSHMVACLEEADGVHHTYAFKDGDYLLPYEFNSLCQDVVGMPVLRSSLGGSRWIHRVFRALRRGFELRWTRALEGRCRDCENXGGLCGHLGDAPYQFTCFTAPAAPAPAPALPLSL

SEQ ID NO: 185722 - protein, 101 aa, Triticum aestivum
  unsure (1)..(101): unsure at all Xaa locations
  Clone ID: PAT_TA_80140.pep
LVNCLFCRKVRKCTIIVKTSTMWLTRREKGMKEIRQGLSVKERSNXXEQTKRXXGSSWEERRKEEGQSKKRQNXXXXQKSLAQPIPIXXXIXXXXLXPPXX

SEQ ID NO: 185723 - protein, 159 aa, Triticum aestivum
  Clone ID: PAT_TA_80141.pep
RSSAGGKRRVPCVGVEEHWLGSPDWWRTTCPSVGMEEHRRRSSIGGGRRVPQRGRGGAPTREAGLVWTRDLRQRQRQWITQSNLICERGGGKGDTGRELRLQTRAWLGDTADSCVPLSLAERPLLYMLGQAEEAAQATKRSRFCMRVRGRCHTRNQTRP

SEQ ID NO: 185724 - protein, 81 aa, Triticum aestivum
  Clone ID: PAT_TA_80142.pep
QYPTTQKHSIPSRRKVASKECGEQKEWNTLVTRILSPFNLSGRSLYFPYISLLQAAMASKETEEKLQTAANSLHLKVTSAQ

SEQ ID NO: 185725 - protein, 64 aa, Triticum aestivum
  Clone ID: PAT_TA_80143.pep
EERISPTRAGAARPRAARGSPISGTRWSRSSRSHRTPARTAAAALAATVISSFDHRTIGVFICC

SEQ ID NO: 185726 - protein, 210 aa, Triticum aestivum
  unsure (1)..(210): unsure at all Xaa locations
  Clone ID: PAT_TA_80144.pep
HEENAESRNSYQRAHPSLPSSAASKFHDYCTKNVDSRYSYQGAHPSLSTSVASKSIWASKSTRDVLNIDGRKGVSLVDERSKRPGCADNVSQQPAKRQLVADKPELTSSMFPCMEKYSFGWSVNDTVGPRMLDFXTKIAGHATQISKNEXNNNLGGMPVPVVEARSRTVSMFAGAKSTLKNDHSKMPHSTKFSVGNSGMSERECSCSTYY

SEQ ID NO: 185727 - protein, 210 aa, Triticum aestivum
  unsure (1)..(210): unsure at all Xaa locations
  Clone ID: PAT_TA_80145.pep
MSLLHVRLAAAAIAVVALVAGGDAYQLTKPGTVISYDRRSLMVDGQRDIFFSGSIHYPRSPFHEWPDLIARAKEGGLNVIESYVFWNVHEPEMGVYNFEGRYDMIKFFKLIQEHEMYAMVRIGPFVQAEWNHGGLPYWLREVPDIIFRTDNEPFKKLMQKFVTLVVNKLXXXKLFASQXXPIILAQIENEYQHXEAAFKENGTRYIEWAA

SEQ ID NO: 185728 - protein, 174 aa, Triticum aestivum
  unsure (1)..(174): unsure at all Xaa locations
  Clone ID: PAT_TA_80146.pep
MDVTPVATRLRRSTPEHDAYTVRVADRRLVALATGNPADARRWIYTTRWLHQALLRSDRLIVGLGVQWTPVRGRGEGPQAPPPATLQLCAGHRCLVFHLAQVDAEAVPAVLYRFLADPRVVFVGYGSSYDRRMLWDHYGLDVASSCDLRALTGMGNAXVELMAQRFLGYXXISK

SEQ ID NO: 185729 - protein, 68 aa, Triticum aestivum
  Clone ID: PAT_TA_80147.pep
MPQPGRPLAPPDVPSLHQHQDSAAPLHLALQPHAGRRRKAPPPPTRTGLRSGGGEGRGWCRRRARSGG

SEQ ID NO: 185730 - protein, 198 aa, Triticum aestivum
  unsure (1)..(198): unsure at all Xaa locations
  Clone ID: PAT_TA_80148.pep
TRLLDPPEEVSAEYDEPLRIELLQLATLLLKYLQNDLVHHRKELIKFGWNHLKREDNSSKQWAFVNVCHFLEAYQAPEKIILQVFIALLRTCQPENKLLVKQALDILMPALPRRLPPGDTRMPIWIRYTKKILVEEGHSIPNMIHIFQLIVRHAELFYSCRAHFVPQMVNSLSRLGLPYNTTAXXRRLAIELAGLVVA

SEQ ID NO: 185731 - protein, 97 aa, Triticum aestivum
  unsure (1)..(97): unsure at all Xaa locations
  Clone ID: PAT_TA_80149.pep
XXXXAXXXRAXXVSCCXXXXRGXXTNGMEGSAGRAEEGVPPAPRXSRSASAARARLRDDGXGGVEETRWSARRESRRRRRRRSTRAAMALQASRPRA

SEQ ID NO: 185732 - protein, 204 aa, Triticum aestivum
  unsure (1)..(204): unsure at all Xaa locations
  Clone ID: PAT_TA_80150.pep
RDYYDSWYYGQAFCSFDDQHGYLSHPEGVQDPDVETTLGHIPHNTRKLARPSSDEYDRMFFNSSFIGSAADDVFPRQHTETRHTSKRRPEKRKGAKSRKGRTKRRRGLEPASGFQGIESRSTHYRQEFLMEECAQSVVCATFRGQKKKRRGKQHNVISARSSEHPTTDFTGPKTLAQIKEXNCVSKSRFXHSAARMPHGXXFLK

SEQ ID NO: 185733 - protein, 114 aa, Triticum aestivum
  unsure (1)..(114): unsure at all Xaa locations
  Clone ID: PAT_TA_80151.pep
MKNAWQANSGMSTISREPVLSKTTERGENDRLEYAVSSMQGYRANMEDAHAAVGDLDVSTATSFFGVYDGHGGPAVSMFCAKHFHLXXQKHPHFNDSLRIAVESAFFRMDQMMM

SEQ ID NO: 185734 - protein, 131 aa, Triticum aestivum
  Clone ID: PAT_TA_80152.pep
ARSAGASRPLSRRRRLSRRTPRSPPARPPAPPSSPGHRPGRAARSSPRRRRPLPRMARHPAPLASRRPGRPAVRRPARLRHAGRAPRSSQRRRSIRQLGRRASSIGRWKYPALPHQPRQQQPAPAPKWWCA

SEQ ID NO: 185735 - protein, 175 aa, Triticum aestivum
  unsure (1)..(175): unsure at all Xaa locations
  Clone ID: PAT_TA_80153.pep
MAGATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQXILAIWACXXVLMGAVXXYX

SEQ ID NO: 185736 - protein, 195 aa, Triticum aestivum
  Clone ID: PAT_TA_80154.pep
MQAYNRSKTRREEQEEKHMTQMEELVHQCDMEVMKMAMLKHEQTFRQQVHDLHRLYRVQKQLMGDQSGRPSVPPCHQVQRRREHPRRPELSLQLPVDDDEYAVVSGGTGRLATPPSMESEDELELTLAVGGGGGNGGSSRSQRRRRESATDCSGRRSPQTPSSSTDSDDALRTVPHHQATACDLRGDGAAMAGAL

SEQ ID NO: 185737 - protein, 184 aa, Triticum aestivum
  Clone ID: PAT_TA_80155.pep
MPPPGSRGRGRHGRPSLPAEQRQDHFARDGAPQTRATGRPLWGVSGSGRAGHACGSADHGLSRPGRSEGRSRRRLGSAPCQEHGPAQLRREPSVSHLNKLLSTTTFMESSTLGSPILARTPTDWPMTFYIRIDRRGSFHTYPDVGGPFRKLQEVHNAIDRYLEDRRHPTMFKEQDFSNGHCYTY

SEQ ID NO: 185738 - protein, 153 aa, Triticum aestivum
  unsure (1)..(153): unsure at all Xaa locations
  Clone ID: PAT_TA_80156.pep
XRXXXXXXLQPVXXRRRPVLLARQQARPPPSPPRPPPARPLPRPPWSLSRPRLAPLALWAPRPPARPQLLARSPWPPPSQRRPAPPPWSPQPRRGQTPRPRPPPARGPPPSSGPPRRPPASPPRAPPPSARPSGSGHQRWPLPSWMQENARSG

SEQ ID NO: 185739 - protein, 158 aa, Triticum aestivum
  unsure (1)..(158): unsure at all Xaa locations
  Clone ID: PAT_TA_80157.pep
LHHSYSEDXXSLTVYSFNLSTFIISKFAFVVMHNDEMCLKKQRPIPTLLRPCQDESISNSFSILGHQSVCGVKFRASKRENAHVSPSCSNPGIYTTTSSRDRCDQRYLYRYKAHKSNVVMTGQKEIHDVGRLSQDSGLMWTGKPIYYKPPLDLPIFLA

SEQ ID NO: 185740 - protein, 132 aa, Triticum aestivum
  unsure (1)..(132): unsure at all Xaa locations
  Clone ID: PAT_TA_80158.pep
XXLIWXXSAAQDPSSGHPIFXXFSRFHADEIAYFFQRIATQLFLHLPGRPPAPRCQSDQPGGSQHHLPSLSRLSPRLCFVFFIWFGYFCLFLLFGFADAVGVVPPPVVFFCVRAVCFFVFGLPXLFYCFFFF

SEQ ID NO: 185741 - protein, 78 aa, Triticum aestivum
  Clone ID: PAT_TA_80159.pep
ELWETELFSHVPRHSFLHEFSFLQHLIFNAVWPSQLGKFWQMNLSVGWDQILPPGVARFGFLQYLMFICQTLSVSYNK

SEQ ID NO: 185742 - protein, 79 aa, Triticum aestivum
  unsure (1)..(79): unsure at all Xaa locations
  Clone ID: PAT_TA_80160.pep
APGKGWAPRPPXXXRPLVGAWPDGLXXXXIRGVIXWGSLFFWGGRRWFLGVRSRXTLGVFVWWGEYKIKGGWAGGGFFF

SEQ ID NO: 185743 - protein, 205 aa, Triticum aestivum
  Clone ID: PAT_TA_80161.pep
LADLLALHAVLDFLDQERLDALRQGRTGDGSIVTTMLQGTGAGARGRGVGFVRVSGGDTSRITFSSGAPGGGARRNSTLVKVVTSQAFSVLVLQVSDLILPPGIVAPAPGPQIPRARHMSLPPTPAPAPMQQVPSPGMPEPEPEVPDTTPPPSTVIPIPSVHGGVAAKIPEAAAGRGAVGSWWSGAGAALGIMACLLGRLYDSFC

SEQ ID NO: 185744 - protein, 187 aa, Triticum aestivum
  unsure (1)..(187): unsure at all Xaa locations
  Clone ID: PAT_TA_80162.pep
TRAALPPPVPEALLDALHRTAAALVPPSAPHLHRHFRWLIADASAPSPSSGDPAARYLLPAPLGNENWKDLVVAVRDGVLIPRPETEAVVEGSSRRVLAYPALRAAVIYCTAVLPDVPAAVGPHPPPPFAGLRARSMATFTRTMRSSSMATASSSSITLXALINQVLAEAGSAXXVAFDEIDLSACC

SEQ ID NO: 185745 - protein, 156 aa, Triticum aestivum
  unsure (1)..(156): unsure at all Xaa locations
  Clone ID: PAT_TA_80163.pep
MDAMSCLAPPPAAASFLSASSSLGPAYYTDAALARALNFSAMPDYEYDYSPAASSPSNSASASALSSSSLLADFPCSAGGSNWFASTSAPPTGSLSCDSVLVASDAAPRPPSTPVGAATNKRRAGLGPNTAGAGRAGKRRARASXXAXXTYIXTDP

SEQ ID NO: 185746 - protein, 101 aa, Triticum aestivum
  unsure (1)..(101): unsure at all Xaa locations
  Clone ID: PAT_TA_80164.pep
MVQEPSNSSSHHLQQQLAKYGGGTGTGNGNGAATGVARASRKNKPKKIPQRGLGVAQLEKLRIEEQXXXGGGPSAATPSSHALNGXXXMPXXHXXPAPSSA

SEQ ID NO: 185747 - protein, 151 aa, Triticum aestivum
  Clone ID: PAT_TA_80165.pep
HEVQKRHHTRLFPENHRARDLTDRSGNILPGTVVDTKICHPTEFDFYLCSHAGIRGTSRPTHYHVLLDENRFSADALQTLTYNLCYTYARCTRSVSIVPPAYYAHLAAFRARYYMQDEFSDGGSSSATARLAPTRQLPKIRDSVKEFMFYC

SEQ ID NO: 185748 - protein, 198 aa, Triticum aestivum
  unsure (1)..(198): unsure at all Xaa locations
  Clone ID: PAT_TA_80166.pep
DDMDAEWAHGSFPLEEYIKALDRAKGELYYNHSLGMQYSKITEQIYVGSCIQTQKDVKMLSETVGITAVLNFQSESERINWGINSEAINDSCRQNNILMINYPIREVDSMDLRKKLPFCVGLLLRLIRKNYRIYVTCTTGYDRSPACVIAYLHWVQDTPLHIAHKFITGLHSCXPDRAAIVWATWDLIALVENGRHDG

SEQ ID NO: 185749 - protein, 176 aa, Triticum aestivum
  unsure (1)..(176): unsure at all Xaa locations
  Clone ID: PAT_TA_80167.pep
ARGSSEREIPNPHQTLTQTLTLIETTRRGEERSGSGDGRREDALVHAVARRLGGFPLHHVPGGAGGLHRQVEGGGEEGQGQAGGQGGQGQGGEGQAGGQGQGEEGQGEGGQAGGRGQGKGGQAGGXGQGEGGQGEGGQAGGRGQVKGGQGQGVEDPHQGGGAHQVRGAAGELPRRG

SEQ ID NO: 185750 - protein, 184 aa, Triticum aestivum
  unsure (1)..(184): unsure at all Xaa locations
  Clone ID: PAT_TA_80168.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIXXLMTTVHAIT

SEQ ID NO: 185751 - protein, 84 aa, Triticum aestivum
  Clone ID: PAT_TA_80169.pep
TRILFLACSHPENRTTMTTIAEWPEWILEVLIYNHEKGSKKYVDGVSIGEIEDLVHNFLIIMLEHSMRQKDGWMGYQAGRVLKF

SEQ ID NO: 185752 - protein, 82 aa, Triticum aestivum
  unsure (1)..(82): unsure at all Xaa locations
  Clone ID: PAT_TA_80170.pep
SVVQVYLLXXALLSGIHHWNLVTFTAYSQQDXKNMIVYEFMHNESITLADVKFALWNQQHAIVYTHMXXXAAKXCPCGCIXX

SEQ ID NO: 185753 - protein, 213 aa, Triticum aestivum
  unsure (1)..(213): unsure at all Xaa locations
  Clone ID: PAT_TA_80171.pep
LXXXDAAGAEEQRRRAXXHAEGXRRRRASRVAVEELSGARGHGXXPDPRQGRRREATAPGGADAVMGRCRCSNRRFCRTSHTEPERLRRPIDGNGAGEGRGGREEARRGLSPPYPARLGAWRARRRGRSSTPVNAHGGGGSCRAASLVRSREREKWREKKREWARFRVTAGRSRTARAPMAGEGWWRGARAGLMGMDFGSGGAVAAAELISSC

SEQ ID NO: 185754 - protein, 55 aa, Triticum aestivum
  Clone ID: PAT_TA_80172.pep
PFSSQKSFGEENLAWHNPKNHFLASQKKTMSKKTSSQAAPPSVPVAGARCSLVRF

SEQ ID NO: 185755 - protein, 195 aa, Triticum aestivum
  unsure (1)..(195): unsure at all Xaa locations
  Clone ID: PAT_TA_80173.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQXXEVAAAATEEAKKSNNVQXKLEKRQQGRTLDSHIEEQFSGXXXLACISSRXXXX

SEQ ID NO: 185756 - protein, 135 aa, Triticum aestivum
  Clone ID: PAT_TA_80174.pep
MAPSPVAPAAPRDGGHLSPISLFSHPTGQVRGRARKDDRHLSLLPRPAAPHHSLTLPDARLEGGSRLNRLHAQWGAGSGLLSLLDRALTVEEQYCRQPAQVQRKGMEAEGFGIEGISTGGHETCVTAPSPFCGSG

SEQ ID NO: 185757 - protein, 165 aa, Triticum aestivum
  unsure (1)..(165): unsure at all Xaa locations
  Clone ID: PAT_TA_80175.pep
VEARRTVQAWAAASARSAASRRARPMGGRPSRPATCRRPRRRRSRRCSPRRRASSRRPGPGVSPVALWWRRRRRRPGPRTAAPPGRRTAVVSAAGSAGPRAPSRRSRRPRPSRRPRPRWPGPSGPRRRSRPGAGREGPRPVASPGAPGGTGTXAXXXPXXXXARP

SEQ ID NO: 185758 - protein, 74 aa, Triticum aestivum
  unsure (1)..(74): unsure at all Xaa locations
  Clone ID: PAT_TA_80176.pep
ARGLVPNSARGRERERELVSSFFFFFFFFFFFFFFFFFGFRGGLFRFFGNLPVPFPKFNSWWDLFGITCLXADR

SEQ ID NO: 185759 - protein, 174 aa, Triticum aestivum
  unsure (1)..(174): unsure at all Xaa locations
  Clone ID: PAT_TA_80177.pep
MKSAMDRPLLLAAIVALIIIVPAAQADDGGCGSGKAGTNHRSANSLKIAAFFSILICGALGCGLPVMGRRVPWLNADADAFFLIKALAAGVILSTGFIHILPDAFEDLTSDCLPVSGPWKEFPFAGLGAMVGAIGALIFDTVATAYITRVQLIXXTAHAVACSGSVVGNPAGAR

SEQ ID NO: 185760 - protein, 176 aa, Triticum aestivum
  Clone ID: PAT_TA_80178.pep
RTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 185761 - protein, 180 aa, Triticum aestivum
  unsure (1)..(180): unsure at all Xaa locations
  Clone ID: PAT_TA_80179.pep
MLSSSTAPSLRLHHHQPARPHRRRPPAPAAYSQFQSPAAASRRHLPAGAAVRARGSTIRAIDAAQPFDYESRAAGLLEERQRLKIAIVGFGNFGQFLARTFARQGHTLLAHSRSDHSSLAASLGAAYFQDPHDLCECHPDVVLLATSILSAXXVLRSLPLHRLRRSTXXVDVLSVXEFPK

SEQ ID NO: 185762 - protein, 74 aa, Triticum aestivum
  Clone ID: PAT_TA_80180.pep
VPRRLGSPASAPAGSASKPPPPPAPLRSRSTGTPTSYTRAPRPAHPRPRRPPPRPPTPPSPPPPASASSGRRRG

SEQ ID NO: 185763 - protein, 198 aa, Triticum aestivum
  Clone ID: PAT_TA_80181.pep
SSAPKPTQQQQHQSVTSSGSRQSGSNGEQEIAARAGRGGGSGAAAVRPHAGRGGRPGVLPVPVQPGQRGLQPADLPRRQPGGAAAAATVAQRVLVRQRLRAAGGRRRAQRQRRPWRRAREQPRQRARGQPREAPPRAPAPRRGRGPVRHGVLPAPHGHRQRLHLPGHVLPPAVHEQGQALHQAHPGLRHLVRRRLLTT

SEQ ID NO: 185764 - protein, 100 aa, Triticum aestivum
  unsure (1)..(100): unsure at all Xaa locations
  Clone ID: PAT_TA_80182.pep
XXXHRAQVXLQLTRIXAVVVDRGLLLVCELDLSLXXXXKXVQAIXXVHKNXXXXMNKNRHNKIHXIHTQNAASGGRAWGGQHATLSSVTGGRARSWTDDL

SEQ ID NO: 185765 - protein, 210 aa, Triticum aestivum
  unsure (1)..(210): unsure at all Xaa locations
  Clone ID: PAT_TA_80183.pep
ARGPIEWEEHYVGTEVDPRTQSFLTWESLESVRRNKVGLKGPMATPIGKGHRSLNLTLRKELGLYANVRPCNSLPGYKTRYDDVNLVTIRENTEGEYSGLEHQVVKGVVESLKIITRQASLRVAEYAFHYAKANGRERVSAIHKANIMRKTDGLFLQCCREVAAKYPEIKYXXVVIDNCCMELVKDPGTYDVLVMPNLYGDIISDLSAGL

SEQ ID NO: 185766 - protein, 44 aa, Triticum aestivum
  Clone ID: PAT_TA_80184.pep
CDNFYFVNIYVDIRSNEPSQSLLVKTFGWITPWRSQVRYKMITY

SEQ ID NO: 185767 - protein, 162 aa, Triticum aestivum
  unsure (1)..(162): unsure at all Xaa locations
  Clone ID: PAT_TA_80185.pep
EINRAFAGRRRRRGADASQEGGSVRLRCAVSTAAAFASTLLRVAACVRKHGQVTTSRWRRRQQQHARCDGRGLPAGILGLRARWLGTRAPGAQEVYALEHAGGNVHREVPEQPGQYRAPPYWTDPATPSSPPLTGLCRFPQQHCLQXXHFPGSAYXXXXXXA

SEQ ID NO: 185768 - protein, 73 aa, Triticum aestivum
  Clone ID: PAT_TA_80186.pep
ARGLVPNSARGMQFTQMITPGHMHETRLMQFTQMITPGHMHEPSAVTRCDHLSKLQSVLRRLNLRVFRQRQLV

SEQ ID NO: 185769 - protein, 51 aa, Triticum aestivum
  Clone ID: PAT_TA_80187.pep
LTTLVTPPVKRRSLFLDLRDTHAYTGEEAEAEAKLLFVLYPRLLLPANNSP

SEQ ID NO: 185770 - protein, 136 aa, Triticum aestivum
  Clone ID: PAT_TA_80188.pep
TYEYENNAREQRQKNWSQFVIFLTRSSLAMEKRIGFVRSSRCPLSNSHLKIGMVPQDFHHRTCNSAAISPVGPPLSCQIRGDEIRLPCEVGGGEMRGRLPCEVGGGEIARPSPVRSAAAISCALGGPRRQSAAAFT

SEQ ID NO: 185771 - protein, 165 aa, Triticum aestivum
  unsure (1)..(165): unsure at all Xaa locations
  Clone ID: PAT_TA_80189.pep
MCCSECGCYDAFCDCCCPCVSYDARETILCCAACLAVLAAVVLFAVLLAAYGFIRRPEVAVVDASLTRLALATSPATAFAYNLSLTLTVRNKNWAMSVRNTQPLEADYSFDGQRFERVRLADEGSTHPAGKTQVYHLVCGSDSAYIGLGYAXMGXXXXENKTGMS

SEQ ID NO: 185772 - protein, 177 aa, Triticum aestivum
  unsure (1)..(177): unsure at all Xaa locations
  Clone ID: PAT_TA_80190.pep
MAGATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACXXVLMGXVXXYRVA

SEQ ID NO: 185773 - protein, 181 aa, Triticum aestivum
  unsure (1)..(181): unsure at all Xaa locations
  Clone ID: PAT_TA_80191.pep
LVPNSARGSSLFALLSLSLLLLRLLLRLRLAAFRDAALTLHLLARLRIRPVTLRLPGPHATTLRVWCPASPSGKPPLLLLHGFGGDAKWTWARNLAALSRSFHLYVPDLVFFGSHSRSSSPLRSVAFQARCAADAMRLLGVSRYDVAGISYGGFVAYRMAXVXXRDSVARVVIMTXGVAXT

SEQ ID NO: 185774 - protein, 72 aa, Triticum aestivum
  Clone ID: PAT_TA_80192.pep
FFFLNVQSIYPLHSILSYFYFYDSLITQTESDRLCSVVVVNIYAINSMQKEEERFYIMVIGACHPWRGGASC

SEQ ID NO: 185775 - protein, 133 aa, Triticum aestivum
  unsure (1)..(133): unsure at all Xaa locations
  Clone ID: PAT_TA_80193.pep
GPKXXXFFLGETRENSPFPLGKIKPFPRGRDLFQTHTPPPFFRWDPKTPPSFFFTGKLLPLPLLFYFXPPPTPFKGTGPGRGWGFWGRGGGAFLRGRGTPPPGTPGGIFSWGGFLXAXNLALNWXWGASFPXA

SEQ ID NO: 185776 - protein, 99 aa, Triticum aestivum
  unsure (1)..(99): unsure at all Xaa locations
  Clone ID: PAT_TA_80194.pep
MAMAASWWALLMAVVAAAAAGCGEAAPTAAAEAAHDVLQSHGLPRGLLPAGIAAFTHDPATGRFEAVLESPCTARXXXGLRYNVTVAGQITXXXIAELS

SEQ ID NO: 185777 - protein, 121 aa, Triticum aestivum
  Clone ID: PAT_TA_80195.pep
PYLLLSSEPPPPVLLLSSAPPPPVLHLSSALPLPVFLLSSASPPPVLLLSSAPPPSAARAAASLSSLTSSGGEEAGAALPEERAVAPSIGESQAERAVATGWRVDGRRPGGVRRCHRPRRG

SEQ ID NO: 185778 - protein, 129 aa, Triticum aestivum
  Clone ID: PAT_TA_80196.pep
RKSTGGKAPRKQLATTIAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 185779 - protein, 100 aa, Triticum aestivum
  unsure (1)..(100): unsure at all Xaa locations
  Clone ID: PAT_TA_80197.pep
XXLRHLRRQSREGTSWRTTASGCRPPCCRARVDRPRPRPRARYHNCQFSRGSRRRTATEPAWTRYVGYEVQRKEEFLVAIDKRNRPVDQRQVGRGIWSRG

SEQ ID NO: 185780 - protein, 205 aa, Triticum aestivum
  unsure (1)..(205): unsure at all Xaa locations
  Clone ID: PAT_TA_80198.pep
GNNTLHGGHRGFNQVFWSVRERATGAFPYITFYYRSGDGEEGFPGALDVLVTYKIDGDYSYSVTMYARPVDKPTPVNLAQHTYWNLRGHGRGTILDHSVQIFASAVTPVGGDLIPTGAVTPVAGTPFDFRAPTAPGARIAEVEGGYDINYVLDGRDADGQGVRKVAVVSEATSGRVMELWGDQPGVQFYTGNFLXXDXXQGGAVY

SEQ ID NO: 185781 - protein, 83 aa, Triticum aestivum
  unsure (1)..(83): unsure at all Xaa locations
  Clone ID: PAT_TA_80199.pep
MADVEYRCFVGGLAWATDDQSLQNAFSKYGDVIDSKIITDRETGRSRGFGFVTFASDEAMRQAIEAMNGQDLDXXNITVNXXQ

SEQ ID NO: 185782 - protein, 187 aa, Triticum aestivum
  unsure (1)..(187): unsure at all Xaa locations
  Clone ID: PAT_TA_80200.pep
ARGRSSDQSLVEEDGRTLVEVESDPGQEEGGGDDKAAESEHKEDTDGSGAGSVNHNVVDTLQGEDSAVGAGGDQSAWATQRDQSHREKDRRQEDAGDGNSTDGEEQHEWRTCNVKAGADYIPCLDNEKAVKKLRPENFRRYEHRERHCPDEGPTCLVALPXXYRRPVEWXXSRDRIWLXXVPHTKLV

SEQ ID NO: 185783 - protein, 208 aa, Triticum aestivum
  unsure (1)..(208): unsure at all Xaa locations
  Clone ID: PAT_TA_80201.pep
ARGEEEEEEEEEDDEELRMTVQVSFLCDQISDLVLELLKMVPDEEPENQMLSLVKRLNRLQWITDSINNFVSEIAVRVSREQMIERARKEKEEQKRFLQQGQEVRSSDKKQEQERTLEEREINGQAVVAGGRLVTMATDRGLEAKDIEAEAVISXXGEYXXEAFARFRKDXGVSPXCQQLRRPDFVESHALYTLYTGIRASRRCPPXX

SEQ ID NO: 185784 - protein, 196 aa, Triticum aestivum
  unsure (1)..(196): unsure at all Xaa locations
  Clone ID: PAT_TA_80202.pep
LEDCLTLLCYCPMGWKCDNCSKVVELPRTNGSENGEPMIASTNVNRAVEGDQTELSDGKTCPSERSNDLNSLSVHCTSPNRQTHGSDAHHQVILSEDRISEEITSGMSYDEKNSASCSTTNKKSKSHEVVXXATPSSFPTDKQTDLLSAQDSQDTSDQNQGSGKQVKLDDHSAQQVEENRIEQKHEXXWFSNTIDC

SEQ ID NO: 185785 - protein, 67 aa, Triticum aestivum
  Clone ID: PAT_TA_80203.pep
IHCAVARSTHHIKFTLLVQEKTVPTVITYNTTSQKLFLRCLGSIPRNTLLSIQHWADPDEKLHTKFR

SEQ ID NO: 185786 - protein, 78 aa, Triticum aestivum
  unsure (1)..(78): unsure at all Xaa locations
  Clone ID: PAT_TA_80204.pep
XXXXXXXXXXXXXXRTSQIREFHFSQSFTHMTSMATEFIHMYVCRDFTGYTYYWISRSRWSYLAFGYRIINSASSVCC

SEQ ID NO: 185787 - protein, 140 aa, Triticum aestivum
  unsure (1)..(140): unsure at all Xaa locations
  Clone ID: PAT_TA_80205.pep
LIFTPKGGPEPLKKFFFWGAGLRNPLFAVFLGKSPPLFFFGGENYNFFLEIFELESPPLKKKTFGGAPLFLNFFWGADKNPKPGFXGFSLGKFFQGLFFLKGPPPFGVKRPFPLGGKKKKKKGGGGFFWGXXKPPGGXLX

SEQ ID NO: 185788 - protein, 102 aa, Triticum aestivum
  Clone ID: PAT_TA_80206.pep
FASCTIGATGSSSSTNAGGAPPLRDSQVGLRAIHDAQGLLTGRSDRQREFRRCFFRAAPGRVMVQVFSWEAEDVRHCHGSKETQVEERHRGKIGYLALRPSF

SEQ ID NO: 185789 - protein, 193 aa, Triticum aestivum
  unsure (1)..(193): unsure at all Xaa locations
  Clone ID: PAT_TA_80207.pep
MAFPKPSLVLCSVLTLLSLNRGPSHVSAKVYMVVMEDDPVVSYKASRKGVMRGEEAQKYKEMATTKHDVFLESFLTVGSYKKLYSYTHLLNGFAVHANSEKAAKILSGAKGVRLVQEDIKMAKMTTYTPKYIGASGVWPLLGGAENSGDGIVIGMIDTGIDPKNPSFASFSNQSKQXXXNFXXMCRSXXXXXD

SEQ ID NO: 185790 - protein, 108 aa, Triticum aestivum
  unsure (1)..(108): unsure at all Xaa locations
  Clone ID: PAT_TA_80208.pep
MPRRLVNAVLFAVLGVVVALFLCYSVRCYRRRRRAVLPSHGARADRLQAGGSSAYGSGVGEELLTFPGGEGLTVAAILEAPGEVVAKXXHSTLYRAGLXAGXXVALLR

SEQ ID NO: 185791 - protein, 63 aa, Triticum aestivum
  Clone ID: PAT_TA_80209.pep
FFFLSQLWLLSSPANRIIDLQPTGVSLFIATDGGREQRLATREHKNQRSKLRPFTYWANAEKT

SEQ ID NO: 185792 - protein, 207 aa, Triticum aestivum
  unsure (1)..(207): unsure at all Xaa locations
  Clone ID: PAT_TA_80210.pep
KLTLLXLEFTWSAEDDPIRKVILDEMKKIKSGKELVEEVRKIEKNINAGSTISSLLELSVAEISMDTCEVPTPSHFVEQDSKCLEQEIPQIEEDELEDKEQDGQELQFPSDQVEDSSSITPEEVQEAAVDEDEEHEIHLPIVIPERDVSGLLNPLDDMMPCDFFATTLHYMIPSLKIDLKTHLLGYDDIYPVSGIALICDDHNYSSC

SEQ ID NO: 185793 - protein, 149 aa, Triticum aestivum
  unsure (1)..(149): unsure at all Xaa locations
  Clone ID: PAT_TA_80211.pep
MNDADVGKQIQQMVRFIQQEAQEKASEISVAAEEDFNIEKLQLVESEKRKIRQEYERKQKQVDIRRKIEYSMELNAARIKVLQAQEDIVGEMKENASKTLVRVTKDTNVYRKILKSLIVQSLLRLRESSVVLRCXXXDRVHVEPVXXXX

SEQ ID NO: 185794 - protein, 96 aa, Triticum aestivum
  Clone ID: PAT_TA_80212.pep
LNQLASWWSEKPAELAGQKNKGSILPGYHADIVVWKPEAQFHLDDTHAVYHKHRNISAYLGKELSGKVLSTFVRGNLVFAEGKHAGAACGATILAK

SEQ ID NO: 185795 - protein, 194 aa, Triticum aestivum
  Clone ID: PAT_TA_80213.pep
MKIIRVLTAVAALLSTSASYALQDCPSIWNDAKLRTNTTGAIRLTMLHTQHRCSPVRRQRGLPPSWHQHHSTALHRERRLLFRRRPPPPNISTPVTSTSAAGVDHGFMAQVAIGTPPTTQTVLIDTAASFSWVQCAPCARNGCYNQDGPLFDTRTSSTYAAVPCSTQPCVSVDATMARTNCSSSGDKTCLYRVE

SEQ ID NO: 185796 - protein, 75 aa, Triticum aestivum
  Clone ID: PAT_TA_80214.pep
SRSPINPNLKEDGGAEEVNGGSGRSCCDPIDPGTEGQGIRLQSPGRNTFDRGIRLHHTLDQSDPGTRSQTPTQGE

SEQ ID NO: 185797 - protein, 40 aa, Triticum aestivum
  Clone ID: PAT_TA_80215.pep
VYDCNALKYVIGAAMKEYFATLNYIWLCGRYSKVHLCDCV

SEQ ID NO: 185798 - protein, 64 aa, Triticum aestivum
  unsure (1)..(64): unsure at all Xaa locations
  Clone ID: PAT_TA_80216.pep
SACWTWNTXTXMRGLXQFGSVPXTXGLHCFTLSPMMRXYXGNRDXCXXGXQXRXYPXXVDXXLS

SEQ ID NO: 185799 - protein, 123 aa, Triticum aestivum
  unsure (1)..(123): unsure at all Xaa locations
  Clone ID: PAT_TA_80217.pep
MAXKEPMRVLVTGAAGQIGYALVPMIARGVXLGADQPVILHMLDIEFAAEALKGVKMXLIDAAFPLLKGXFVXTTDVVEACTGXLNVAVMVGGFPRKREWQGKGCYDEKNVKSNKSLKAILLL

SEQ ID NO: 185800 - protein, 86 aa, Triticum aestivum
  unsure (1)..(86): unsure at all Xaa locations
  Clone ID: PAT_TA_80218.pep
MYTARKXIQKDKGVEPSEFEDTVAXAFFDLENGNQELKSDLKDLYINTAIXLDXVGNXKAXVXHVXPYRLRKPLQGMSSRQGSSKK

SEQ ID NO: 185801 - protein, 66 aa, Triticum aestivum
  unsure (1)..(66): unsure at all Xaa locations
  Clone ID: PAT_TA_80219.pep
PISPSPAXLNTTSTANSIGMAXGAXTQARCWSAMVGRXAPRSLRCRRYPCGQVXSALSPCISYEXG

SEQ ID NO: 185802 - protein, 120 aa, Triticum aestivum
  unsure (1)..(120): unsure at all Xaa locations
  Clone ID: PAT_TA_80220.pep
MAQTMASMTGLSQGVRLPGPAGRRASRFIVRASSAEAEAAGRRAVLGLMASGVVGSAFAQVVHAGTVAAIKVGXPPPLSGGLXPGTDNSDEARDFDLPLKEXRFXLQAACQPAGGRCSGA

SEQ ID NO: 185803 - protein, 106 aa, Triticum aestivum
  unsure (1)..(106): unsure at all Xaa locations
  Clone ID: PAT_TA_80221.pep
ITAATMRSKFKDEHPFEKRKAEAERIRQKYXPDRIPVICEKVREIPTSQPDKEENTPARSQPGQRCTSIRKGASKVPRFLWNEGSFRPNGRGLEVCPKISGFGGVP

SEQ ID NO: 185804 - protein, 87 aa, Triticum aestivum
  unsure (1)..(87): unsure at all Xaa locations
  Clone ID: PAT_TA_80222.pep
MSCCGGNCGCGTACKCGNGCGGCNMYPEAEAAGATLLVSAXATHKASSGGMEMAAENGGCGCTQLQVAAQAAGWLLAASWLRINPNQ

SEQ ID NO: 185805 - protein, 148 aa, Triticum aestivum
  unsure (1)..(148): unsure at all Xaa locations
  Clone ID: PAT_TA_80223.pep
MAPTVMASSATSVAPFQGLKSTAGLPVSRRSNGASLGSVSNGGRIRCMQVWPIEGIKKFETLSYLPPLXSTEALLKQVDYLIRSKWVPCLEFNKVGFIFXXEHNASPWGTNEXGRYWTMWKAGYVRAATDAHNKGDTEGGGQKGVTPR

SEQ ID NO: 185806 - protein, 152 aa, Triticum aestivum
  unsure (1)..(152): unsure at all Xaa locations
  Clone ID: PAT_TA_80224.pep
AXXWXEXEXEDRGQGKGLGVSLLGDGNIXXYFWEEDXGGGGXGPRRLLSCXPSFFALRKAGPTGDXLGFPKTTFAXCPQHRRVETPVTVILPSSKSAAIASIPWRLGDCFERLPLLGCCPSAPPSSPSSASSWRPAIKLSPRGKERGRWKGK

SEQ ID NO: 185807 - protein, 147 aa, Triticum aestivum
  unsure (1)..(147): unsure at all Xaa locations
  Clone ID: PAT_TA_80225.pep
MSEDVQALVVDNGSGMCKAGFAGDDAPRAVFPSIIGRPKQKSIMVGMGNKDAYVGDEAQSKRGILTLKYPIEHGIVTNWDDMEKIWHHTFYNELRVAPKEHPILLTEAPLNPKANKEKMTQIMFETFSIPXAMFVPIQXVLSLYXSG

SEQ ID NO: 185808 - protein, 121 aa, Triticum aestivum
  Clone ID: PAT_TA_80226.pep
MSCNCGSGCSCGSDCKCGKMYPDLTEQGSAAAQVAAVVVLGVAPENKAGQFEVAAGQSGEGCNCGDNCKVANPGKLLKLHNSVRYVFLVLRSITLNKRSVLILNWESQKGFFLVLFLPPPP

SEQ ID NO: 185809 - protein, 111 aa, Triticum aestivum
  unsure (1)..(111): unsure at all Xaa locations
  Clone ID: PAT_TA_80227.pep
ASFSYASLCHSGHFLASTTAMATADVXNPTAALTERGARGGDARRRRGGCQDRGGPRAGGGRSPRRLPPSRLRRPKEEAPARRPKTXXXKEGRTXQXXAXKGXXRXQRTNP

SEQ ID NO: 185810 - protein, 130 aa, Triticum aestivum
  unsure (1)..(130): unsure at all Xaa locations
  Clone ID: PAT_TA_80228.pep
PIPFSTLRPPPRPGRRGGAPSIXPPLHHPLHLHHPPLPAPHHHLEPPRHPSPSPAPPATTITTAPPPPPRDSTPSPSLSAAFLPLTSRWLPAVSLAFLNLLLLLPSSNLAISSASAPLAGCFLPLFQPCS

SEQ ID NO: 185811 - protein, 158 aa, Triticum aestivum
  unsure (1)..(158): unsure at all Xaa locations
  Clone ID: PAT_TA_80229.pep
XKGEILSKSGXTXNXXGSLGXXGRRXRGGKAXXAPGWRWXMARNQLRRXRRPTPASGARXEGGRLHXHGXGPAAAHGARVLRGHGARARRHLAHVRVARPRQRPTPARPATAPXSSRRRRXDPSXASSRSGRRLSLLRARAGESMGGRETEEFGRWMS

SEQ ID NO: 185812 - protein, 99 aa, Triticum aestivum
  unsure (1)..(99): unsure at all Xaa locations
  Clone ID: PAT_TA_80230.pep
AKXFNFAXSRKDFRRPSGKVGRWPFCPRESRXGARRPLRPREGRSVLAVAGPAHREECADDQYSAERAERRDEPREVVGDECAVDHGSSGARMRGARRT

SEQ ID NO: 185813 - protein, 130 aa, Triticum aestivum
  Clone ID: PAT_TA_80231.pep
TASPSTPFHRSQIPSPHNPKSELALTYHPFDMEKSRQLRGPSPADDSYRHHQPSAEKFACSRIPWVMLDRFAHRTKGDGDGVVSDAVADGTLSEISATCTGKPIAISLRVAEPPEVSRLYLHWPNGLRPG

SEQ ID NO: 185814 - protein, 133 aa, Triticum aestivum
  unsure (1)..(133): unsure at all Xaa locations
  Clone ID: PAT_TA_80232.pep
GHPFLSAATPSITTIVVPRLDLLLPSAATLSSTPSSFFADDEATDQGPRRPCLLFPSSXSSLLCFSRFTLIFLYLSWVLLSVTGEXAMGXLKVXSSXPTXPXVLPNXVGLRKNXXXGCXGASNPNXAXNXRXV

SEQ ID NO: 185815 - protein, 152 aa, Triticum aestivum
  unsure (1)..(152): unsure at all Xaa locations
  Clone ID: PAT_TA_80233.pep
VLTASSQSLASFPRRHPPRKGGCLAAAATAGAAPAASAATAAAGARCSPTWRPPPAPPPWSCPPPPTRGAPAGSXXPGRPAAATAPPAIAAPRAGAPAXXAIEPGAQXGRAAXRPITNDXXXTKQSKQHXPPXQPPTXXFHHQRPHARRAPL

SEQ ID NO: 185816 - protein, 70 aa, Triticum aestivum
  unsure (1)..(70): unsure at all Xaa locations
  Clone ID: PAT_TA_80234.pep
VSQPCTDFSCSCSTKMHGXCSXLTRNRFQXXVLLKAKKKSNSNNPSFKXXXXEEPXXALVWGFKPXXPPV

SEQ ID NO: 185817 - protein, 108 aa, Triticum aestivum
  unsure (1)..(108): unsure at all Xaa locations
  Clone ID: PAT_TA_80235.pep
RERERTTEQEXKREAKLEMAXTMASMTGLSQGVRLPGPAGXRASRFIVRASSXXAEAAGRRXVLWPHXAXXVVXSXVRSXVVAXPXTRXGPIKVWXXPXXXSSRWVSP

SEQ ID NO: 185818 - protein, 134 aa, Triticum aestivum
  unsure (1)..(134): unsure at all Xaa locations
  Clone ID: PAT_TA_80236.pep
VKDVNAHAFIKAYAAYLKRTGKLEVPKWVDLVKTGTFKELAPYDPDWYYVRAASVARHIYIRKNVGVGALNKVHGGTINRGSRPSHHVDASGSVNRKVXQSLEKIGVLXKGQRRVVVKITQDGQRDLDXIANPR

SEQ ID NO: 185819 - protein, 130 aa, Triticum aestivum
  unsure (1)..(130): unsure at all Xaa locations
  Clone ID: PAT_TA_80237.pep
WKTTLHNTATARACLPPLRHHRSRSFPMAWLLHRRHRTSKSRDLGTVDTYGTASKLRIVEQLCVSRWGRLQALLAAYSAPQRSNXSAIRXCXLVYXKRGXVGYNLIWGXNXXGLXDXPRKTKWTTXEXRI

SEQ ID NO: 185820 - protein, 104 aa, Triticum aestivum
  Clone ID: PAT_TA_80238.pep
ATLQCITHTVPLFKKLRCTDHSTPCSYDEDGFCSFCALKEHIEESVRRSGAVLVPARFKDNLSKLSSDFRPGQQEDAHEFLRCLLDNLHKCTLDPKSKGEALIF

SEQ ID NO: 185821 - protein, 55 aa, Triticum aestivum
  Clone ID: PAT_TA_80239.pep
LSEVGVEKRKCRRLFQGVMSDLGDALVGARSAVAAGAVTSAVARLAVAGGHFEDG

SEQ ID NO: 185822 - protein, 75 aa, Triticum aestivum; identical to SEQ ID NO: 106874
  Clone ID: PAT_TA_80240.pep

SEQ ID NO: 185823 - protein, 73 aa, Triticum aestivum
  Clone ID: PAT_TA_80241.pep
ALAQLPLIQEQQKLLMDMQQQLSSSHSLSQQQMMPQQSTKIPSQVASLPPPMQPRYYTPRKLPQESKLCLQTT

SEQ ID NO: 185824 - protein, 97 aa, Triticum aestivum
  unsure (1)..(97): unsure at all Xaa locations
  Clone ID: PAT_TA_80242.pep
AASDLTTDPLPPPASRVPPLSPHLPRLTAHPAGGRSGAPPTRRSRAGXQGSGDGLRLARRLLPRRHAHRCSSSSKLMCLANLEFDYINPFDSSSPNQ

SEQ ID NO: 185825 - protein, 121 aa, Triticum aestivum
  unsure (1)..(121): unsure at all Xaa locations
  Clone ID: PAT_TA_80243.pep
XAAXXADPXWXELGTXPPXXXLRXVXXXDLRGXLVTXKTYXVDILYNIMRPCIYIATDSIHIRACFLEXCWYMNMDIHIXLGTNKKDKWRRKTQSNVRVDKTAMALYIWPVVSELFXPCRT

SEQ ID NO: 185826 - protein, 42 aa, Triticum aestivum
  unsure (1)..(42): unsure at all Xaa locations
  Clone ID: PAT_TA_80244.pep
MGNXSXMLXQYDIXEVXEHCXYLFSQXEIVXLYXRFCQLXRK

SEQ ID NO: 185827 - protein, 109 aa, Triticum aestivum
  unsure (1)..(109): unsure at all Xaa locations
  Clone ID: PAT_TA_80245.pep
MSDTDEHHFESKADSGASKTYPQQAGAIRKGGHIVIKXRPCKVVEVSXTPKTGKHXQRKSVNFVXAIDIFNXKEARIFPSSQLVNPQCLNRPKIIKLDLDTGLGYVNPS

SEQ ID NO: 185828 - protein, 120 aa, Triticum aestivum
  unsure (1)..(120): unsure at all Xaa locations
  Clone ID: PAT_TA_80246.pep
MPPVRNPILPGFNPDPSIVRVGEDYYIATSTFEWYPGVQIHHSKDLANWELVVRPLNRKSQLDMRGDPXDSCGIWAPCLSHEGDKFWLXVYTDVKXRDGSFKGLRTIYIVTAPERLKGPM

SEQ ID NO: 185829 - protein, 108 aa, Triticum aestivum
  unsure (1)..(108): unsure at all Xaa locations
  Clone ID: PAT_TA_80247.pep
AFXCXGXGXEFLWEEGRRELXHRASRPARXGTSXVEXRRXDRGELEEEEEAEVPRRREHQGQPARAXRRHGDGGSRGRGGGQRRSSRSGLGPRPGWGGVGLLRTEGKP

SEQ ID NO: 185830 - protein, 64 aa, Triticum aestivum
  unsure (1)..(64): unsure at all Xaa locations
  Clone ID: PAT_TA_80248.pep
MSKQGGKAKPLKQAKVAEKDYDENDLAYLQKKKDEQKALKELKAXAGQKGALGGSGLKERVGKK

SEQ ID NO: 185831 - protein, 143 aa, Triticum aestivum
  unsure (1)..(143): unsure at all Xaa locations
  Clone ID: PAT_TA_80249.pep
RAELMDHRKQQQQRSPSPRSGGSSGKHGGKGGXKAGGGGXKEADQGGVHLQTPCGVKEPTPAGFPXPSVQXSSTGRQWPNPPKLNNRTNGLPNERXERAQRSSTLXPXREPRXGPTLDXGRPRAPPAIGREXXSSPGXGXANG

SEQ ID NO: 185832 - protein, 90 aa, Triticum aestivum
  unsure (1)..(90): unsure at all Xaa locations
  Clone ID: PAT_TA_80250.pep
MAASMITSPIVAPTSLPSLSRRGSSFAVVCSGGKKIKVDKPLGLGGGLTVDIDANGRKVGKKGVYQFVDKYGXANVDGLQPNLHAGREWS

SEQ ID NO: 185833 - protein, 151 aa, Triticum aestivum
  unsure (1)..(151): unsure at all Xaa locations
  Clone ID: PAT_TA_80251.pep
MAPTVMASSATSVAPFQGLKSTAGLPVSRRSNGASLGSVSNGGRIRCMQVWPIEGIKKFETLSYLPPLSTEALLKQVDYLIRSXKWVLCLEFKQRVWVHLPLSNKRNPPGVTNDWPGYWDNVGNCLCSGLQPDANTRSNEVGKKVKERNYP

SEQ ID NO: 185834 - protein, 58 aa, Triticum aestivum
  Clone ID: PAT_TA_80252.pep
TEEELACSSLLCLSEGGQSPPAASLISTTAHLLCFFVCVLSLQTSHAKKALVPNSARG

SEQ ID NO: 185835 - protein, 144 aa, Triticum aestivum
  unsure (1)..(144): unsure at all Xaa locations
  Clone ID: PAT_TA_80253.pep
MAPAVMASSATTVAPFQGLKSTAGLPVSRRSGSAGLSSVSNGGRIRCMQVWPIEGIKKFETLSYLPPLSTEALLKQVDYLIRSKWVPCLEFXSKVGFVFREHNSSPGYYDGRYWTMWKLPMFGCTDATQVLNEVEEVKKEYPDA

SEQ ID NO: 185836 - protein, 119 aa, Triticum aestivum
  unsure (1)..(119): unsure at all Xaa locations
  Clone ID: PAT_TA_80254.pep
MAAAFSSTVGAPASTPTNFLGKKLKKQVTSAVNYHGKSSKANRFTVMAAENIDEKRNTDKWKGLAYDISDEQQDITRGKGIVXDSLFQAPTGEGTHEXAVLNSYEYVXXGLXKYDFHNN

SEQ ID NO: 185837 - protein, 147 aa, Triticum aestivum
  Clone ID: PAT_TA_80255.pep
PRAGSSDVALPPPAHRPPRPSVQHSEPRPSVQRSQPRPSVHRAEPHPSQPGSSSRHEPPPSQPGSSSWNEPPPSQPGSSSWHEPPPSQPGSSSWNEPPPSQPGSSSWNEPPPSQPGSSYWASSHLLHSQGALTGIKKMELGGNLSQP

SEQ ID NO: 185838 - protein, 142 aa, Triticum aestivum
  unsure (1)..(142): unsure at all Xaa locations
  Clone ID: PAT_TA_80256.pep
MQPLLGLALLALLLLASPAPALCRHRAPAAATTETLDVEASLSRARAAVSTDASPLHQXSLSATDTNVLPVEEHPSXRSGRLALRLHSRDFLPEEAGAAREXRSLVLARLRRDSGRAARAXARASLGAEGVSRAELXAGNAN

SEQ ID NO: 185839 - protein, 130 aa, Triticum aestivum
  unsure (1)..(130): unsure at all Xaa locations
  Clone ID: PAT_TA_80257.pep
MAGGAATGLRGLWRRYAPHNMMIMVQLCYTLMYFVTEAAFNRGLNPYVYVTYRHLLVAVLLWPFAYYXKKKLRPKMTWMLFLEIFVLSLLGVSLTLNMYFASLKXTSPTFVTSKXNNVGSITFVIAIPLR

SEQ ID NO: 185840 - protein, 100 aa, Triticum aestivum
  unsure (1)..(100): unsure at all Xaa locations
  Clone ID: PAT_TA_80258.pep
MAETEYRCFVGGLAWAXXDHNLQQAFSQYXEILDAKIINXRETGRSRXFGFVTFGKXXXRXXQAIXXXNGKXLDGRXITVNEAQXSRRSGXGGRRRLTRS

SEQ ID NO: 185841 - protein, 106 aa, Triticum aestivum
  unsure (1)..(106): unsure at all Xaa locations
  Clone ID: PAT_TA_80259.pep
ALSLSLSLSLSLSLSLSLSLSISXSHXQSIRXRXSTXQAXSEIRXNXHRXEXTXLAILRLXRRPFGAXGIXRXXPAVXDGXQGXEAXGTGXVXGETDYAERXXWXS

SEQ ID NO: 185842 - protein, 127 aa, Triticum aestivum
  Clone ID: PAT_TA_80260.pep
MAASMITSPIVAPTSVPSLSRRGSSFAVVCSGGKKIKVDKPLGLGGGLTVDIDANGRKVGKKGVYQFVDKYGANVDGYSPIYTPEEWSESGDRYAGGTTGLLIWAVTLAGLLGGGVLLVYNTNALAG

SEQ ID NO: 185843 - protein, 149 aa, Triticum aestivum
  unsure (1)..(149): unsure at all Xaa locations
  Clone ID: PAT_TA_80261.pep
AWRLLRRVCVREMLSPAGLXNVHGLRRREFRATLAHLHSMASAGKPVDVGAQMFLTTMNVITGTLWGGNIGTESERTAVGKEFRELVAEITEMLGAPNVSXDFFPALAPFDLQGIRXKSXRSRDRFDXIFXQDHXRXRVXGGTGAGRLN

SEQ ID NO: 185844 - protein, 128 aa, Triticum aestivum
  unsure (1)..(128): unsure at all Xaa locations
  Clone ID: PAT_TA_80262.pep
PSITAICGGFCGRAVGFVALGRSPIXSCARRRRCPSPGEAALRRRXCPRQPPPPCRRRRPHPPPPRRRRRGWWVPARGSGGRISSGEGRRRGRATRAAARAAAVRARRGPAPTPTPQRRHTRSAAAAV

SEQ ID NO: 185845 - protein, 103 aa, Triticum aestivum
  unsure (1)..(103): unsure at all Xaa locations
  Clone ID: PAT_TA_80263.pep
XQNYTXGXKSFRITNXXGGRGELXGGQVRGXRXGEGGRRPGGRRXXRRXHTSXENETXXSXYXPLXSLLFGXNKHAKNLXKKKKKKKKKKKKKKKKKLETSSP

SEQ ID NO: 185846 - protein, 125 aa, Triticum aestivum
  unsure (1)..(125): unsure at all Xaa locations
  Clone ID: PAT_TA_80264.pep
MARTKQTARKSTGGKAPRKQLATKAARKSAPTTGGVKKPHRYRPGTVALREIRKYQKSTELLIRKLPFQRLVREXAQDFKTDLRFQSHAVLXALQEGXRRGXXSGLFXDTKLCAIXAKRVNIMPK

SEQ ID NO: 185847 - protein, 52 aa, Triticum aestivum
  Clone ID: PAT_TA_80265.pep
ASCRIRHEASLLVLNTPDLLPCFLELFTCKEISFRYGSSDTIMSMSHQKYRK

SEQ ID NO: 185848 - protein, 75 aa, Triticum aestivum; identical to SEQ ID NO: 106874
  Clone ID: PAT_TA_80266.pep

SEQ ID NO: 185849 - protein, 126 aa, Triticum aestivum
  Clone ID: PAT_TA_80267.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPGDG

SEQ ID NO: 185850 - protein, 132 aa, Triticum aestivum
  unsure (1)..(132): unsure at all Xaa locations
  Clone ID: PAT_TA_80268.pep
MARTKQTARKSTGGKAPRKQLATKAARKSAPATGGVKKPHRFRPGTVALREIRKYQKXSTELLIRKXLPFQRLVREXAQDFKTXLRFQSSAVSALXKEGAEVLTRGALPREXNSGAIXAKARXQLMPKGHPN

SEQ ID NO: 185851 - protein, 108 aa, Triticum aestivum
  unsure (1)..(108): unsure at all Xaa locations
  Clone ID: PAT_TA_80269.pep
MAPTVMASSATSVAPFQGLKSTAGLPVSRRSNGASLGSVSNGGRIRCMQVWPIXGIXKFXXLSXLPXCQXRTLSSXKSXXXIRXKWVXPCLDIXAXXGXIFRXQPLLG

SEQ ID NO: 185852 - protein, 105 aa, Triticum aestivum
  unsure (1)..(105): unsure at all Xaa locations
  Clone ID: PAT_TA_80270.pep
MAPTVMASSVTSVAPFQGLXSTAXLPVNRRSKRRXASASVNNGGRIKVHXXCGPXXGIKKFEXTLSYFATAQAREALLKQVRLPDSAPKLGWPLPSFKQGLGFLP

SEQ ID NO: 185853 - protein, 139 aa, Triticum aestivum
  unsure (1)..(139): unsure at all Xaa locations
  Clone ID: PAT_TA_80271.pep
MAPTVMASSATSVAPFQGLKSTAGLPVSRRSNGASLGSVSNGGRIRCMQVWPIEGIKKFEXTLSYLPPLSTEALLKQVDYLIRSKWVXCLEFNXVGFIFRXHNASPGYYDGPVXWTMWKLPYXFGWTDATQVINGGWEE

SEQ ID NO: 185854 - protein, 128 aa, Triticum aestivum
  unsure (1)..(128): unsure at all Xaa locations
  Clone ID: PAT_TA_80272.pep
MAASMITSPIVAPTSVPSLSRRGSSFAVVCSGGKKIKVDKPLGLGGGLTVDIDANGRKVGKKGVYQXFVDKYGANVDGYSPIYTPEEWSESGDRYAGGTTGLLIWAVTLAGLLGGGXLLVYNNNALAG

SEQ ID NO: 185855 - protein, 143 aa, Triticum aestivum
  Clone ID: PAT_TA_80273.pep
IRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGLGIEYAVCCSQRLRSSLVWANKPLAGGNQRWPTQRDWRKNFNFKG

SEQ ID NO: 185856 - protein, 130 aa, Triticum aestivum
  unsure (1)..(130): unsure at all Xaa locations
  Clone ID: PAT_TA_80274.pep
MPAMKHASFLQRFLLLLFGLIITTLASSDDQFLFSGFNQSSLTLDGCAVVTDAGLLDLSNGTTALNGHAFYPTPLQFRKSPGGKVQSFSVNVVFKHLQRKPRLEXTGGMAFFIAPAKNFSDAQGAKYFGL

SEQ ID NO: 185857 - protein, 79 aa, Triticum aestivum
  unsure (1)..(79): unsure at all Xaa locations
  Clone ID: PAT_TA_80275.pep
ERERTSLEFFFFFFFFSNCMHHARXIFPITDXXYNXQVSTXHIYRGDXSXXMRSMVXXHEXXXGNKXDGXGXPGTXFPP

SEQ ID NO: 185858 - protein, 60 aa, Triticum aestivum
  unsure (1)..(60): unsure at all Xaa locations
  Clone ID: PAT_TA_80276.pep
RERELVSRFFFFFFTLTQTKHYMXSAAFXXINELNFXQPVPFPHSPWFKPESXXLXQSDV

SEQ ID NO: 185859 - protein, 123 aa, Triticum aestivum
  unsure (1)..(123): unsure at all Xaa locations
  Clone ID: PAT_TA_80277.pep
MATTAMALSPSSFAGKAVKDLPSSALFGEARVTMRKTAAKAKPVSSGSPWYGSDRVLYLGPLSGDPPSYLTGEFPGDYGWDTAGLSGDPENFAKKRELEVIXCRWGMLGALGWVLPELLXRKG

SEQ ID NO: 185860 - protein, 43 aa, Triticum aestivum
  unsure (1)..(43): unsure at all Xaa locations
  Clone ID: PAT_TA_80278.pep
MHLFLVSSYMYTVYGRRETFSLHIASHFEDSGSGTTMXTTLFL

SEQ ID NO: 185861 - protein, 62 aa, Triticum aestivum
  Clone ID: PAT_TA_80279.pep
TMWKLPMFGCTDATQVINEVEEVKKEYPDAYVRIIGFDNMRQVQCVSFIAFKPPGCEESGKA

SEQ ID NO: 185862 - protein, 152 aa, Triticum aestivum
  unsure (1)..(152): unsure at all Xaa locations
  Clone ID: PAT_TA_80280.pep
LVPIRHEAQTMASMTGLSQGVRLPGPAGRRASRFIVRASSAEAEAAGRRAVLGLMASGVVGSAFAQVVHAGNVAAIKVWPPPPLSGGTPRNGQLPNXGQRELSNLPLERNRFLTWQAAANRAGXXGXSGAXGXRPXKXSNLXPLTXKNNWXF

SEQ ID NO: 185863 - protein, 93 aa, Triticum aestivum
  Clone ID: PAT_TA_80281.pep
EANAAVHHDELPEANAAIHHDELPEANAAAGHHDELPAANAAVVNHNQPAEADSDDDGMDVDMEPSSSNVSRSKKKGKGKKLDGFAPDFFADL

SEQ ID NO: 185864 - protein, 110 aa, Triticum aestivum
  unsure (1)..(110): unsure at all Xaa locations
  Clone ID: PAT_TA_80282.pep
MASALTNVSLSTFAPTARGDVLARPQVAAARVTFPTAYRGNGALSCRAGGPGTPPGISRQDVRDKHQRRAXENFSEEPXNXGNAPGXREQGGTQARQAPGKSSKANRSKN

SEQ ID NO: 185865 - protein, 144 aa, Triticum aestivum
  unsure (1)..(144): unsure at all Xaa locations
  Clone ID: PAT_TA_80283.pep
MAQTMASMTGLSQGVRLPGPAGRRASRFIVRASSAEAEAAGRRAVLGLMASGVVXSAFAQVVHAGTVAAIKVGPPPPLSGGLPGTDNSDEARELXLPLKKRFLTCNRLPTGGXRGSGPKESXKEILKLKPLIKKNKWPLPQLNN

SEQ ID NO: 185866 - protein, 146 aa, Triticum aestivum
  unsure (1)..(146): unsure at all Xaa locations
  Clone ID: PAT_TA_80284.pep
SPGALGNAEAKXSSCFFXRPPPAPXVGNHQRPPCARSCNSRSPPSVPYRACSSAQGALRLAAKEVEVAEQRTRRRRGRELATSAASSLPNDVAEGQEHRDEDGVRRHPPSAGNVLSDSTEKCVAWNWKHIVRRCVRVCGVVRLNSS

SEQ ID NO: 185867 - protein, 145 aa, Triticum aestivum
  unsure (1)..(145): unsure at all Xaa locations
  Clone ID: PAT_TA_80285.pep
MAPTVMASSATSVAPFQGLKSTAGLPVSRRSSSAGLSSVSNGGRIRCMQVWPIEGIKKFETLSYLPPLSTEALLKQVDYLIRSKWVPCLEXFSKVGFVFREHNSSXPGYYDGRYWXTMWKLPKFGVQPTPQQVLKRWEGSKKSNL

SEQ ID NO: 185868 - protein, 80 aa, Triticum aestivum
  unsure (1)..(80): unsure at all Xaa locations
  Clone ID: PAT_TA_80286.pep
MSCCGGNCGCGTACKCGNGCGGCNMYPEAEAAGATLLVSATATHKAXSSGGMEMAAENGGCGCTQCXSCGTNCXCSCCXC

SEQ ID NO: 185869 - protein, 64 aa, Triticum aestivum
  unsure (1)..(64): unsure at all Xaa locations
  Clone ID: PAT_TA_80287.pep
ISEKALSASGKALSQEKALSSSCWNPCSLSSIFTSIFSYLTPQISNNYNLVFDLHXXKXXKKKK

SEQ ID NO: 185870 - protein, 53 aa, Triticum aestivum
  unsure (1)..(53): unsure at all Xaa locations
  Clone ID: PAT_TA_80288.pep
INQACLAFSAWFCKNNAVYXNXKADFEHRNRXXFVKIKPNDFAGXLXKTFHKC

SEQ ID NO: 185871 - protein, 113 aa, Triticum aestivum
  Clone ID: PAT_TA_80289.pep
GRRQDDRGDRGRPRADHHGGERAGDHLRGGALQGHAPGRPDAVGSSGLPTDISGHLLIVLLDDELYFFFSHSPSIKSHVTQVSFFLPSKVNVSSFLFKLYAFVQPLLTFFVVH

SEQ ID NO: 185872 - protein, 133 aa, Triticum aestivum
  unsure (1)..(133): unsure at all Xaa locations
  Clone ID: PAT_TA_80290.pep
MAPTVMASSATSVAPFQGLKSTAGLPVXRRSNGASLGSVSNGGRIRCMXVWPIEGIKKFETLSYLPPLSTEALLKQVDYLIRSKWVPCLXFNKVGFIFREQNATPGYYHXRYXWTMXWKLPMFGXCTDPTQGD

SEQ ID NO: 185873 - protein, 162 aa, Triticum aestivum
  unsure (1)..(162): unsure at all Xaa locations
  Clone ID: PAT_TA_80291.pep
MAPTVMASSATSVAPFQGLKSTAXLPVSRRSNGASLGSVSNGGRIRCMQVWPIEGIKKFETLSYLPPLSTEALLKQVDYLIRSKWVPCLEFSKVGFIFREHNASPGYYXXRYWTMWKLPMFGCTDPTQVXKQVEEVKERITLTPNVRINRIRKKCVKVNCVK

SEQ ID NO: 185874 - protein, 125 aa, Triticum aestivum
  unsure (1)..(125): unsure at all Xaa locations
  Clone ID: PAT_TA_80292.pep
MAMASSVAAASLRALAGASPAPLPKPFLVLLSPXXPXRLXXXLRAARPRXPLAPLASSDSFFETSAGVDVAXPEDEALEXVAEEEPAVARRTNEGFGGLRKMWRNVRGTWEARRKGKGCFGCPTD

SEQ ID NO: 185875 - protein, 102 aa, Triticum aestivum
  unsure (1)..(102): unsure at all Xaa locations
  Clone ID: PAT_TA_80293.pep
RETTGTXNXTXDQGLRSLDDADGISXTWXXXPHXXGSXXDGXXRRLXXLNXGDXVXGDAPGAGXDXXXMDSXXAAAEERGERGXDXRRRRXRRCCXHAXWWV

SEQ ID NO: 185876 - protein, 179 aa, Triticum aestivum
  unsure (1)..(179): unsure at all Xaa locations
  Clone ID: PAT_TA_80294.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFRXEHNAXPGVXYNXRYWTMWKLPMFGCTDATQXXNEVEXVKKGVPDAYVRIXIGFQKMLKVQWRQLHPSNQPGAKESRQRP

SEQ ID NO: 185877 - protein, 178 aa, Triticum aestivum
  unsure (1)..(178): unsure at all Xaa locations
  Clone ID: PAT_TA_80295.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDGRYWTMWKLPMFGCTDATQVINEVEXVXKEYPDAYVRNIRFHNIRQVQXRQASSXSNQPGCEESGRLNS

SEQ ID NO: 185878 - protein, 144 aa, Triticum aestivum
  unsure (1)..(144): unsure at all Xaa locations
  Clone ID: PAT_TA_80296.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREQNATPGYXQWRYWXTCWKLPMFGVQPTPRKXXTKVEEVKEREXP

SEQ ID NO: 185879 - protein, 140 aa, Triticum aestivum
  unsure (1)..(140): unsure at all Xaa locations
  Clone ID: PAT_TA_80297.pep
MAPKAEKKPAAEKKPVETEKKPKAEKRVPGKDGGADKKKKKAKKSVETYXIYIFKVLKQVHPDIGISSKAMSIMNSFINDIFEXKLAGESAKLARYNKKXPNITSREIQTAVXRLVLPGEARQARRLPXGTKGVTKFXSX

SEQ ID NO: 185880 - protein, 56 aa, Triticum aestivum
  unsure (1)..(56): unsure at all Xaa locations
  Clone ID: PAT_TA_80298.pep
MIHSYMYASWYXNTXHDFXKXQXRPRPXXRXRPVXWDNNXXKFXQDWAAQRAXQXP

SEQ ID NO: 185881 - protein, 98 aa, Triticum aestivum
  unsure (1)..(98): unsure at all Xaa locations
  Clone ID: PAT_TA_80299.pep
MSGRGKGGKGLGKGGAKRHRKVLRDNIQGITKPAIRRLARRGGVXRISGLIYEETRGVLKIFLENVIRDAVTYTEHARRKTVTAMDVVYALKRQGRTL

SEQ ID NO: 185882 - protein, 95 aa, Triticum aestivum
  unsure (1)..(95): unsure at all Xaa locations
  Clone ID: PAT_TA_80300.pep
FRSXCFSKLPPPKSTDLVHYAIQHAPSFDGRRCRFGSRQCQPYPDQHFAGKCTQLEVARKDHHQVKSTTGATTGNKANGQRVRLVXEVNRXQFFN

SEQ ID NO: 185883 - protein, 79 aa, Triticum aestivum
  unsure (1)..(79): unsure at all Xaa locations
  Clone ID: PAT_TA_80301.pep
MSCCGGNCGCGTACKCGNGCGGCNMYPEVEAAGATLLVSATATHKASSGGMEMAAENGGCGCTQCKCGTXSCGCSCCSC

SEQ ID NO: 185884 - protein, 137 aa, Triticum aestivum
  unsure (1)..(137): unsure at all Xaa locations
  Clone ID: PAT_TA_80302.pep
RRQLTEREPRLRXNALLNRHPQEMDGGQEGLFETEEHEXYREVAGGRELQGGAFQLCSMWRLPSLWXPCSRRRLGSTEGLLSRRCWRRRGXRLXGAACWPGHREPIRAAAASQFVDEREAATGHGQDGRAHPCSILA

SEQ ID NO: 185885 - protein, 111 aa, Triticum aestivum
  unsure (1)..(111): unsure at all Xaa locations
  Clone ID: PAT_TA_80303.pep
MSDTDXHHFESKADSGASKTYPQQAGAIRKGGHIVIKARPCKVVEVSTSKTGKHGHAKCHFVAIDIFNGKXKLEDIVPSSHNCDVPHVDRQDYQLIDITDDGYVSLLTEKW

SEQ ID NO: 185886 - protein, 128 aa, Triticum aestivum
  unsure (1)..(128): unsure at all Xaa locations
  Clone ID: PAT_TA_80304.pep
VSLSLSLETXRHPEKXSSRTSXPTXPKXSPLLLLLXLQXTRXRXXPPXPPPRXXERRRRRKXXATPSFSNXKKSSTNXXELVXRFYQEXXRNRSPXXQTGGDMDNGXYHGRXLNXKNNXHGXPSGAGN

SEQ ID NO: 185887 - protein, 49 aa, Triticum aestivum
  unsure (1)..(49): unsure at all Xaa locations
  Clone ID: PAT_TA_80305.pep
GGRSRFGGIWAPPKFXXXAFFDFFXFFFFFFXFXFFFFFFFFFFFFFFI

SEQ ID NO: 185888 - protein, 194 aa, Triticum aestivum
  unsure (1)..(194): unsure at all Xaa locations
  Clone ID: PAT_TA_80306.pep
SPFQKLSGSIGSQPHSSGGPPAIAMGSRFVNLLAMSCNGGPKTLQPSLLEPGKLISPSPVTASASSNSSTANGRPAASAVPVIRLALQEGRRGVDXISWLXAPGGKTSSPVDQIGXSFLYKHELPLAPHWECPKIXQSPIXEPQXSVXRWAKSLIPSMKRGNPWPGWPXFGGWPSKGPPSKKPGLALXNPNPXK

SEQ ID NO: 185889 - protein, 136 aa, Triticum aestivum
  unsure (1)..(136): unsure at all Xaa locations
  Clone ID: PAT_TA_80307.pep
MAALSSAAVSVPSFAAGAKVAAPRSSRMVVRASLGKKAASAAVAMAASAMLLGGSAMAXDVLLGANGGVLVFEPNDFNVKAGETITFKNNAGYPHNVVFDEDAVPSGVXVSKXSQXEXLNAPXGKLLRXRLTFPGT

SEQ ID NO: 185890 - protein, 144 aa, Triticum aestivum
  unsure (1)..(144): unsure at all Xaa locations
  Clone ID: PAT_TA_80308.pep
TLSSTSRPAAIXASTAANGYHXRRRXXQRRRXCRHPXAAXPMSAPAXDXEREGEVQATPRTPRRRPRAAAVRGAXASLLAAAGRGDPLPXGPALXSXRXAGCXRRATGLXWGLSNNLLXVGFLXGXLXXSSWSPFHXFLYXLAF

SEQ ID NO: 185891 - protein, 153 aa, Triticum aestivum
  unsure (1)..(153): unsure at all Xaa locations
  Clone ID: PAT_TA_80309.pep
MAPKAEKKPAAKKPVEEEPAAEKAEKTPAGKKPKAEKRLPAGKSSAAAKEGGKAKKKAKKSVETYKIYIFKVLKQVHPDIGISSKAMSIXMNSFINDIFEKLAXGEAAKLAKYNKXKPNITSREIQNSVXLVPPRTPPNTPFPEGQQRLSTKV

SEQ ID NO: 185892 - protein, 88 aa, Triticum aestivum
  unsure (1)..(88): unsure at all Xaa locations
  Clone ID: PAT_TA_80310.pep
MDMDRRRHHHAGEFVADVVLWRRGRADINALLLAXAVASWILFHGASGYTXVSLAADVLLLLLAVLYAWSKAAXLLGRPAPPIPVPWP

SEQ ID NO: 185893 - protein, 89 aa, Triticum aestivum
  unsure (1)..(89): unsure at all Xaa locations
  Clone ID: PAT_TA_80311.pep
MXDXEYRCFVGXLAWATDDQSLQNAFSKYXDXVIDSNIITDRETGXSXGFGFXVTFXXDDAMXXCSNHVRPTYRTHPNGPIRRLVRVLV

SEQ ID NO: 185894 - protein, 82 aa, Triticum aestivum
  unsure (1)..(82): unsure at all Xaa locations
  Clone ID: PAT_TA_80312.pep
ADAAISCGQVTSALSPCISYARGNGANPTAACCSGVRSLAGATREQRLQTKRAAKFIKSAAXGXSNLXKAXGIPPKXGXRVP

SEQ ID NO: 185895 - protein, 223 aa, Triticum aestivum
  unsure (1)..(223): unsure at all Xaa locations
  Clone ID: PAT_TA_80313.pep
QTLPQFHVSLPSRLRSPKWRNPPNRASSSSSPSPPSSPLPSSSRSPAPTPPGPPPPPPPTTKLRLRWXPARPAPKQXFGGKXSTLARGXXPXNSEPKLPESLLAXGGSLPSPNLNEQPQXGQTSNETFAISRASKXGIPAFKGLFFRLGXFQXXPGISAXELGKQXXFLSKXGGFRFPAKIFLARPNFXRPXPSKWAPPQGPNPYYXKKGEXLGXXXKNGKXX

SEQ ID NO: 185896 - protein, 66 aa, Triticum aestivum
  unsure (1)..(66): unsure at all Xaa locations
  Clone ID: PAT_TA_80314.pep
AFLIYILSVGLGHGAAALVQATSSALHFIQQITHGLASGTLQPKDYQLLLVHATSXSTSTNKVKKK

SEQ ID NO: 185897 - protein, 183 aa, Triticum aestivum
  unsure (1)..(183): unsure at all Xaa locations
  Clone ID: PAT_TA_80315.pep
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWXQLWKLPMFGCXTDQTQVLNXVXGXQKXDYPERMFRHPFEQKRQVASSNWPSKNQGLRESGKPKSAKKLT

SEQ ID NO: 185898 - protein, 130 aa, Triticum aestivum
  unsure (1)..(130): unsure at all Xaa locations
  Clone ID: PAT_TA_80316.pep
MAASMITSPIVAPTSLPSLSRRGSSFAVVCSGGKKIKVDKPLGLGGGLTVDIDANGRKVGKKGVYQXFVDKYGANVDGYSPIYTPEEWSESGDRYAGGNXPGLLIWAVTLAGLLXGGGVLLVYNTSALAG

SEQ ID NO: 185899 - protein, 75 aa, Triticum aestivum
  unsure (1)..(75): unsure at all Xaa locations
  Clone ID: PAT_TA_80317.pep
AHYNISARFKLVNMLRVVLGKYSKLVPVASMMNIGWWLYIWIVSGRAGHAWAXIWRFRILLRLGFGHLGSFLXLN

SEQ ID NO: 185900 - protein, 85 aa, Triticum aestivum
  Clone ID: PAT_TA_80318.pep
MSCNCGSGCSCGSDCKCGKMYPDLTEQGSAAAQVAAVVVLGVAPENKAGQFEVAAGQSGEGCSCGDNCKCNPCKLLSCMHSVVMV

SEQ ID NO: 185901 - protein, 148 aa, Triticum aestivum
  unsure (1)..(148): unsure at all Xaa locations
  Clone ID: PAT_TA_80319.pep
ELLAQLAAEEQRGHELTKKVKELLPTTKKNVKPERPPPRXRRSNDRARMSKCLTKEAELYFEDFLSNVEDTDFSSFDGERSDTSSTRKRCGTSCYGGNSCSPSESCTXVVSDGVVLPWLQWETSNHHASPTTIKDTRTKHCNAATITT

SEQ ID NO: 185902 - protein, 157 aa, Triticum aestivum
  unsure (1)..(157): unsure at all Xaa locations
  Clone ID: PAT_TA_80320.pep
MAPTVMASSATSVAPFQGLKSTAGLPVSRRSNGASLGSVSNXGRIRCMQVWPIEGIKKFETLSYLPPLSTEALLKQVDYLIRSKWVPXLQFXXVGFIXREHKXXPLGYYDGRVTGXMWESCPMFPGCNRPQRVIQRVVKKEPPLSQRKRKSAQWFVN

SEQ ID NO: 185903 - protein, 132 aa, Triticum aestivum
  unsure (1)..(132): unsure at all Xaa locations
  Clone ID: PAT_TA_80321.pep
MARTKQTARKSTGGKAPRKQLATKAARKSAPATGGVKKPHRFRPXXVXLREIRKYQEEXTKLLIRKLPFQRLVREXAQXDFKTDLRFQVLRPFSAPCKEGPPEGLTSVRGCFEKTKSCCANSNAKHQLPKGT

SEQ ID NO: 185904 - protein, 131 aa, Triticum aestivum
  unsure (1)..(131): unsure at all Xaa locations
  Clone ID: PAT_TA_80322.pep
WVPCLEFSKVGFIFREHNASPGYYDGRYWTMWKLPMFGCTDATQVINEVEEVKKEYPDAYXRIIGFXDNMRHGALXSSFIAFKXNXGCXGPGALKPNSTDRANNKSANWQFLNLLTLAFVFPPPINPSLIP

SEQ ID NO: 185905 - protein, 133 aa, Triticum aestivum
  unsure (1)..(133): unsure at all Xaa locations
  Clone ID: PAT_TA_80323.pep
MAASMITSPIVAPTSVPSLSRRGSSFAVVCSGGKKIKVDKPLGLGGGLTVDIDANGRKVGKKGVYQFVDKYGANVEGXTSPILQRQKEWSESGEPLXXGGNEPGXLIWXVNLPGLLGGGGSSSKNNLPRKATF

SEQ ID NO: 185906 - protein, 175 aa, Triticum aestivum
  unsure (1)..(175): unsure at all Xaa locations
  Clone ID: PAT_TA_80324.pep
GATPAPPPPRPLRPPPCTAPTPCRPPPPPATPRSPPTRRRPPPPTPTPAPSRPLRPPPPPRPRSRTPRXRPPRSPRRPKLVTRFREQGQALIAARRPWGEVFRSPASPKPPKRRRSRPGMRRNFPRQIRLVLRSPANPGPGTFWFLGVWGGLGSSNFAPPPPKGGPNRSGVFGIS

SEQ ID NO: 185907 - protein, 114 aa, Triticum aestivum
  unsure (1)..(114): unsure at all Xaa locations
  Clone ID: PAT_TA_80325.pep
MSPQTETKAGVGFKAGVKDYKLTYYTPEYETKDTDILAAFRVSPQPGVPPEEAGAAVAAESSTGXTWTTVWTDGLTSLDRYKXGRCXHIEPVAGERQANGCYLPITLIKKGSVN

SEQ ID NO: 185908 - protein, 99 aa, Triticum aestivum
  unsure (1)..(99): unsure at all Xaa locations
  Clone ID: PAT_TA_80326.pep
MAPTVMASSATSVAPFQGLKSTAGLPVSRRSNGASLGSVSNGGRIRCMQVWPIEGIKKFETLSYLPPLSTEALLKQVDYLIRSKWVPCLXFSKVXFIFR

SEQ ID NO: 185909 - protein, 138 aa, Triticum aestivum
  unsure (1)..(138): unsure at all Xaa locations
  Clone ID: PAT_TA_80327.pep
MAASLQAAATLMPAKIGGRASSARPSSHVARAFGVDAGARITCSLQSDIREVASKCADAAKMAXFALANSALLVSGASAXRGRPXXLTFHEIQSKTYIEVKGXTGTAKQCPNIXXGVQSXPXKGRQVQMKXFAWKPTP

SEQ ID NO: 185910 - protein, 94 aa, Triticum aestivum
  Clone ID: PAT_TA_80328.pep
MNFVRRPLFKKEMLARGGNISRRLALRRWRPAEGAGGVGDEHLVRSAGFVDGHPGPELPPPPPPWPPPREPTGAGGGTGSALAPRRGGRTEKGA

SEQ ID NO: 185911 - protein, 115 aa, Triticum aestivum
  unsure (1)..(115): unsure at all Xaa locations
  Clone ID: PAT_TA_80329.pep
MAPTVMASSATSVAPFQGLKSTAGLPVSRRSNGASLGSVSNGGRIRXMQVWPIEGIKKVPRTLSYFPTAQATGGPPSKVRNLNSPKLGWPLPPNFKQGVQSSRATKAPLGLINGP

SEQ ID NO: 185912 - protein, 76 aa, Triticum aestivum
  unsure (1)..(76): unsure at all Xaa locations
  Clone ID: PAT_TA_80330.pep
MASTSCFLHQSTARLAASARPAPAVGRTQLFVCKAQKNDEAAPDAAVVTXSRRAALSLLAGAAAVAVKVSPRPLPA

SEQ ID NO: 185913 - protein, 164 aa, Triticum aestivum
  unsure (1)..(164): unsure at all Xaa locations
  Clone ID: PAT_TA_80331.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNREXLEVIHCRWAMLGXALGXVXPXVVPRNXXKFRQAXLXQRPGSXDFQPRGGLXXLGKPPPMTILGLAS

SEQ ID NO: 185914 - protein, 62 aa, Triticum aestivum
  unsure (1)..(62): unsure at all Xaa locations
  Clone ID: PAT_TA_80332.pep
MAETEYRCFVGGLAWATDDHNLQQAFSHYGXILDAKIIXHPRXTXXSRXFGFXTFGSEVDCS

SEQ ID NO: 185915 - protein, 144 aa, Triticum aestivum
  unsure (1)..(144): unsure at all Xaa locations
  Clone ID: PAT_TA_80333.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHNASPGYYDGRYWTMWETAYVRDAPXPTQXXNEVEGRSRKELP

SEQ ID NO: 185916 - protein, 52 aa, Triticum aestivum
  unsure (1)..(52): unsure at all Xaa locations
  Clone ID: PAT_TA_80334.pep
VLSQHGLTNPTIHXRIIXRKSLHXGRFDRSYKKXVRQPSXPHXLXPTTXXTX

SEQ ID NO: 185917 - protein, 194 aa, Triticum aestivum
  unsure (1)..(194): unsure at all Xaa locations
  Clone ID: PAT_TA_80335.pep
XGTPXGXGPXEGSXXGXVSXXEVRXTAEXRLRLESGFXESPPPGSERTRGRAKVDPGRPVRRSTPTARSQRPGRRASEACSSCRPRIAVRVGRRAGTLASASVSLWLSPSGLRPAAPQPPPPRRETPGPPRTAEPLSPALACALWRGDDSLLELGDWNGAKGNHHSHIEPKVQSHDPCSSINLHWGKRSAVLSR

SEQ ID NO: 185918 - protein, 79 aa, Triticum aestivum
  unsure (1)..(79): unsure at all Xaa locations
  Clone ID: PAT_TA_80336.pep
MSCCGGNCGCGTACKCGNGCGGCNMYPEAEAAGAXLLVSATAXXKASSGGMEMAXAXNGGCGCNXCKCGNXCXCSCCNC

SEQ ID NO: 185919 - protein, 72 aa, Triticum aestivum
  unsure (1)..(72): unsure at all Xaa locations
  Clone ID: PAT_TA_80337.pep
NSGFFFFAPXWXFFFFFFFFFFFFFFFFFFFFFFFFPRENTMIIIKPFPRGACFCHTIMYALTVTLEDTLHE

SEQ ID NO: 185920 - protein, 137 aa, Triticum aestivum
  unsure (1)..(137): unsure at all Xaa locations
  Clone ID: PAT_TA_80338.pep
MANPRVFFDMTVGGAPAGRIVMELYKDAVPRTVENFRALCTGEKGVGKSGKPLHYKGSAFQRXVDSPTSMCQGRATSTXATAPGGESIYGEKFAXEKFLQQSKTKPGIXLQWANARGPNNKPAXXFLQSCNGPPNLN

SEQ ID NO: 185921 - protein, 142 aa, Triticum aestivum
  unsure (1)..(142): unsure at all Xaa locations
  Clone ID: PAT_TA_80339.pep
ESLRRHHPCSPAAPPLDDDNLLSEILLRLPPQPSSLPRASAVCKRWRLLVSDPGFSRRFRIHHRRNPPLLGIFDERSGEISFLPTLXCPNRIRPVAYSLKVRRAGRFPAPLGDVRWAFGLRPSNFKRLGKTFLGVNWPTPNQ

SEQ ID NO: 185922 - protein, 155 aa, Triticum aestivum
  unsure (1)..(155): unsure at all Xaa locations
  Clone ID: PAT_TA_80340.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDCRYWTMWKLPMXRVQLTHTGYQQVGEVKKRSNPRFPQSSGPTIFKA

SEQ ID NO: 185923 - protein, 160 aa, Triticum aestivum
  unsure (1)..(160): unsure at all Xaa locations
  Clone ID: PAT_TA_80341.pep
MARTKQTARKSTGGKAPRKQLATKAARKSAPATGGVKKPHRFRPGTVALREIRKYQKSTELLIRKLPFQRLXVREIAQDFKXDLRFQRLRRVRACKRAAXGXSXGXSKDNNLLRHQSKRVTXMPXXIXXCPPESAGKRASTGPFACKKVPVDVGLAWGVK

SEQ ID NO: 185924 - protein, 115 aa, Triticum aestivum
  unsure (1)..(115): unsure at all Xaa locations
  Clone ID: PAT_TA_80342.pep
NLREQGNQEGGXIXWRLEXXNRXXVKKPXXWGFLPLRPGXSXXPSAXEDXDEEPERTNTKLRASGNPPPSSRCSSPSTCPPPPVAXAQIEHRRPQIEHPGLVKISPLTNEGETCC

SEQ ID NO: 185925 - protein, 76 aa, Triticum aestivum
  unsure (1)..(76): unsure at all Xaa locations
  Clone ID: PAT_TA_80343.pep
ERTSREFFFFFFFFFFFFFFFFFFFFFPKKSQYFXTFSFFXXXKXPGLNVPLKLFYNKGPIQKRNSLKKGGIFKKG

SEQ ID NO: 185926 - protein, 70 aa, Triticum aestivum
  unsure (1)..(70): unsure at all Xaa locations
  Clone ID: PAT_TA_80344.pep
LXPVXQXLIPLDXIXGKLKSQFXDHXRXITXCTVXWHPVYVHPVSHNMCYSLQAASRLLKHSNXLCXSAH

SEQ ID NO: 185927 - protein, 126 aa, Triticum aestivum
  unsure (1)..(126): unsure at all Xaa locations
  Clone ID: PAT_TA_80345.pep
GSLEPSAAAATSALSFLLRSKMKFIAAYLLAYLSGNASPSAEDLTSILESVGCEIDNEKRELMLSQVKGKDITELLAAGREKFAAVPSGGGGVAXVSXAAPAAGGAAAPASXSQKKEXKGPWRKKE

SEQ ID NO: 185928 - protein, 113 aa, Triticum aestivum
  Clone ID: PAT_TA_80346.pep
MAPTVMASSATSVAPFQGLKSTAGLPVSRRSNGASLGSVSNGGRIRCMQVWPIEGIKKFETLSYLPPLSTEALLKQVDYLDPLQSGLPLPLSSKVRFNPSVEAKMRPRVNRAA

SEQ ID NO: 185929 - protein, 106 aa, Triticum aestivum
  unsure (1)..(106): unsure at all Xaa locations
  Clone ID: PAT_TA_80347.pep
XXVNFSRXQTFFTXEPSXXSMQECXRMSWPSNHXSPGLSRSXNQSKHPKDAVTSXPAASYARNSGKSKIQQQLKPRYDRWSTPTAHARGLLVXRFVILSTGLRAIG

SEQ ID NO: 185930 - protein, 144 aa, Triticum aestivum
  unsure (1)..(144): unsure at all Xaa locations
  Clone ID: PAT_TA_80348.pep
PASKEAGGEGKTRGRKKGSKAKKGVETYKIYIFKVLKQVHPDVGISSKAMSIMNSFINDIFEKLAGESAKLARYNKKPTITSREIQTSVRLVLPGEXLAKHAVSEGNQGPSTKFXSSTAALILRPLHALLVCYLGSYECYKSLW

SEQ ID NO: 185931 - protein, 118 aa, Triticum aestivum
  unsure (1)..(118): unsure at all Xaa locations
  Clone ID: PAT_TA_80349.pep
MAPAVMASSATTVAPFQGLKSTAGLPVSRRSSGSLGSVSNGGRIRCMQVWPIEGIKKFEXTLSYLPPLSTEXALLKQVDYLIRSKVGACLQFSKGLLRPLSKKPPGLLVEYWDKCWLP

SEQ ID NO: 185932 - protein, 89 aa, Triticum aestivum
  Clone ID: PAT_TA_80350.pep
MKGTKLAAILILQAVLVMGLLSHVNADFFPKCCNNCRSFSGVDVCDDAHPKCPQACSACRVVSTSPEMWRCADMKSTVDGTCGGPCKKY

SEQ ID NO: 185933 - protein, 143 aa, Triticum aestivum
  unsure (1)..(143): unsure at all Xaa locations
  Clone ID: PAT_TA_80351.pep
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFPXSNNSSPGYYDXRYWTIVESCLCSGWNRTQTARLKRLEGRSKGP

SEQ ID NO: 185934 - protein, 142 aa, Triticum aestivum
  unsure (1)..(142): unsure at all Xaa locations
  Clone ID: PAT_TA_80352.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWDKCWKXLPMFGCNERHNKLIKQGGGRSKE

SEQ ID NO: 185935 - protein, 79 aa, Triticum aestivum
  unsure (1)..(79): unsure at all Xaa locations
  Clone ID: PAT_TA_80353.pep
MSCCGGSCGCGSACKCGNGCGGCNMYPEVEAAGATLLVSATATHKASSGGMEMAAENGGCGCTQCKCGTXSCGCSCCNC

SEQ ID NO: 185936 - protein, 77 aa, Triticum aestivum
  unsure (1)..(77): unsure at all Xaa locations
  Clone ID: PAT_TA_80354.pep
AGIKVEAYWPALFAKLLEKRSVDDLILSVGSGGGGAPAAAAAAPAAGGAAAAEEKKEEKKEEAKEESDDYMGFXLFD

SEQ ID NO: 185937 - protein, 161 aa, Triticum aestivum
  unsure (1)..(161): unsure at all Xaa locations
  Clone ID: PAT_TA_80355.pep
MAPAVMASSATTVAPFQGLKSTXAGLPVSRRSSGSLGSVSNGGRIRCMQVWPIEGIKKFETLSYLPPLSTEALLKQVDYXIRSXKWVXCLEFXKVXGFVXREXKXSPGLYNGRYWXQCWKLPIFGXPTPTXVLXKVEXVKKGVPXPNVRXXGFKTPRGTTP

SEQ ID NO: 185938 - protein, 91 aa, Triticum aestivum
  unsure (1)..(91): unsure at all Xaa locations
  Clone ID: PAT_TA_80356.pep
MVKAVAVLTGSEGVKGTIFFTQEGDGPTTVTGXVTGLKEGLHGFHVHALGDTNNGCMSTGPHFKPPLVMGDPKIIPQCWILGKIQLNRVGV

SEQ ID NO: 185939 - protein, 142 aa, Triticum aestivum
  unsure (1)..(142): unsure at all Xaa locations
  Clone ID: PAT_TA_80357.pep
MDRLPSSLQQLYIHGCHAFKSLLKDDGLPSSLQAMDGLPSSLQKLNITECPAIESLPKGSLPSSLKELNIHHCPALTSLPKDGLPSSLQKLILLDCPALKXLPEDGLPRSLQELKIVGCAAINSXPKGXAXKLNATIWCPLL

SEQ ID NO: 185940 - protein, 79 aa, Triticum aestivum
  unsure (1)..(79): unsure at all Xaa locations
  Clone ID: PAT_TA_80358.pep
MSCCGGNCXCGTACKCGNGCGGCNMYPEAEAAGATLLVSATATHKASSGGMEMAAENGGCGCTQCKCGTXSCGCSCCSC

SEQ ID NO: 185941 - protein, 75 aa, Triticum aestivum
  unsure (1)..(75): unsure at all Xaa locations
  Clone ID: PAT_TA_80359.pep
MSCNCGSGCSCGSDCKCGKMYPDLTEQGSAAAQVAAVVVLGVAPENKAGXFEVAAGQSGEGCSCGDNCKCXPCNC

SEQ ID NO: 185942 - protein, 85 aa, Triticum aestivum
  unsure (1)..(85): unsure at all Xaa locations
  Clone ID: PAT_TA_80360.pep
MAETEYRCFVGGLAWATDDNNLQQAFSQYGEILDAKIINDRETGRSRGFGFVXFGSEESXXXAXIEXINGXEXXXPQHHPFQVPV

SEQ ID NO: 185943 - protein, 180 aa, Triticum aestivum
  unsure (1)..(180): unsure at all Xaa locations
  Clone ID: PAT_TA_80361.pep
MAPTXMAXSAXSVXPFQGXKSXAXLPXXRRSNGASLGSVSNGGRIRCMQVWPIEGIKKFETLSXLPPLNTEALLKQVDYLIRSKWVPCLEFNXVGFIFREHNASPGXYDGRYWTMWKLPMFGCTDXHTXVXNXVXGGXKKEXPRRYRNQSGFNAPKCKCVLSILQNQPGLRRIPKGKLHS

SEQ ID NO: 185944 - protein, 124 aa, Triticum aestivum
  unsure (1)..(124): unsure at all Xaa locations
  Clone ID: PAT_TA_80362.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNATPGYYDGRYWTMWKLPISGCX

SEQ ID NO: 185945 - protein, 86 aa, Triticum aestivum
  unsure (1)..(86): unsure at all Xaa locations
  Clone ID: PAT_TA_80363.pep
RFFFFFFPKMCFRGNQQXIVXDXKPNXKXQTSXFXYXXLSANQTXNXNXTELKRGXXGXAHXVXLGFXHTSESXKGASXRKQHKNP

SEQ ID NO: 185946 - protein, 87 aa, Triticum aestivum
  unsure (1)..(87): unsure at all Xaa locations
  Clone ID: PAT_TA_80364.pep
MAIEIESSELRRITNNFSDAQKVGSGGYGDVYKAVYNGEAMAVKLLHATKGIDDRQFMKELRNHMKVQHPNIVRLIGYCNEEXKEIC

SEQ ID NO: 185947 - protein, 75 aa, Triticum aestivum
  unsure (1)..(75): unsure at all Xaa locations
  Clone ID: PAT_TA_80365.pep
MSCNCGSGCSCGSDCKCGKMYPDLTEQGSAAAEVXAVVVLGVAPXNKXGXFEVAAGQSGEGCNCRDNCKCKPCNC

SEQ ID NO: 185948 - protein, 111 aa, Triticum aestivum
  unsure (1)..(111): unsure at all Xaa locations
  Clone ID: PAT_TA_80366.pep
VEFYAGSFPEVRRLWIWGAAQLSQVGIEKGAMQNLVELFFVDCPELQFLPDGIEHLTALEKLGLIDTSEQLVDKLLQMRDSDACSKDLMKISHVRMVGVQLRXKGLCERXX

SEQ ID NO: 185949 - protein, 186 aa, Triticum aestivum
  unsure (1)..(186): unsure at all Xaa locations
  Clone ID: PAT_TA_80367.pep
ASSATSVAPFQGLKSTAGLPVSRRSNGASLGSVSNGGRIRCMQVWPIXGIKKFETLSYLPPLSTEALLKQVDYLIRSKWVPCLEFNKVGFIFREHNATPGYYDCRYWTMWKLPXFGCTDPTQVXNEVEEVXKEYPDAYVRIIXGFDNMRQGXIASGFIPFKXTGVKNPGKGNSSIPQRGQKKAIGF

SEQ ID NO: 185950 - protein, 116 aa, Triticum aestivum
  unsure (1)..(116): unsure at all Xaa locations
  Clone ID: PAT_TA_80368.pep
MAPKAEKKPALEKTPAGKKPAAEKRPAAGKTASKEGGEKKGKKKAKKSVETYKIYIFKVLKQVHPDIGISSKAMSIMNSFINDIFEKLAGESAKLARLXKEANNHQGKTFRSALSP

SEQ ID NO: 185951 - protein, 94 aa, Triticum aestivum
  unsure (1)..(94): unsure at all Xaa locations
  Clone ID: PAT_TA_80369.pep
APPPPAPHLERDASSPEKQQXXHGRKEWRXXEKXGDPLREGRAPXPVGRIGRYXKKGXLXRXGVGXXXPPFNLARRSFXXXSPXXGXWEPXPGK

SEQ ID NO: 185952 - protein, 75 aa, Triticum aestivum
  unsure (1)..(75): unsure at all Xaa locations
  Clone ID: PAT_TA_80370.pep
MSCNCGSXCSCGSNCKCGKMYPDLTXQGSAAAXVXAXVXLGVAPENKXGQFEVAAGQSGXGCNCXENCKCKPCNC

SEQ ID NO: 185953 - protein, 134 aa, Triticum aestivum
  unsure (1)..(134): unsure at all Xaa locations
  Clone ID: PAT_TA_80371.pep
MAPTVMASSATSVAPFQGLKSTAGLPVSRRSNGASLGSVSNGGRIRCMQVWPIEGIKKFETLSYLPPLXXEGLLKQVDXLIRSKWVPCLQFNKVGVLSSRAQTQPPWVLTNPVTGDKCWTCLCFGLQPPPTARI

SEQ ID NO: 185954 - protein, 169 aa, Triticum aestivum
  unsure (1)..(169): unsure at all Xaa locations
  Clone ID: PAT_TA_80372.pep
MANPRVFFDMTVGGAPAGRIVMELYKDAVPRTVENFRALCTGEKGVGKSGKPLHYKGSSFHRXVIPDFMCQGGDFTKGNGTGGESIYGEKFADEKFVHKHTKPGILSMGNAGPNNKGSXFFICTVPAXGSNGNXXSSAKVLQGMDXLXXIKKXXSPXGNLAPNKFLFER

SEQ ID NO: 185955 - protein, 36 aa, Triticum aestivum
  Clone ID: PAT_TA_80373.pep
AKTLPENDCRFAVFDFDFTTPEDVPKSKIFYIFWVL

SEQ ID NO: 185956 - protein, 149 aa, Triticum aestivum
  unsure (1)..(149): unsure at all Xaa locations
  Clone ID: PAT_TA_80374.pep
MAPAVMASSATTVAPFQGLKSTAGLPVSRRSSASLGSVKQWREGLRCMQGVGNLRGSKNFEELXLXXQPSXNGKPSXKQXHXLIRSXXXPCLQIQQXWXSSSVRQXKXPPGYYDXRYWTNVESLPMFWVAPTPTQVLKRSGGRSKKGVT

SEQ ID NO: 185957 - protein, 176 aa, Triticum aestivum
  unsure (1)..(176): unsure at all Xaa locations
  Clone ID: PAT_TA_80375.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEXFNGRTAIIGVVGMXPPEGLGXVGLXPXENXIPWFKQGAIPPGGATNNTGADPKAFVFNGGSGFPENRGPRTGKPAPGGFL

SEQ ID NO: 185958 - protein, 184 aa, Triticum aestivum
  unsure (1)..(184): unsure at all Xaa locations
  Clone ID: PAT_TA_80376.pep
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYXGRYWTMWKLPXFGXCTDATQVLNEVEXVKKXEXPERLIPVVNRLSTKMRPSGNCVKQLPLRQQGCEIWQRAIALN

SEQ ID NO: 185959 - protein, 102 aa, Triticum aestivum
  unsure (1)..(102): unsure at all Xaa locations
  Clone ID: PAT_TA_80377.pep
AXQXXKXAQXQIGXQKIXRGLXXXTXLKFPYXPEXXFXIKGXXXFDQXGYLRTRMGVSLXRGFTHPNRQNDFFLKRDKXTFSCPNNLSKLFXLXEGHPKSIL

SEQ ID NO: 185960 - protein, 50 aa, Triticum aestivum
  Clone ID: PAT_TA_80378.pep
IQLEICLATDSTQMFIYNILRLYHNDLIHLSYSKKLNTIINKLQNLHEHS

SEQ ID NO: 185961 - protein, 77 aa, Triticum aestivum
  unsure (1)..(77): unsure at all Xaa locations
  Clone ID: PAT_TA_80379.pep
MYTARKKIQKDKGVEPSEFEDTVAQAFFDLENGNQELKSDLXKDLYINTANPRWDFCLGKRERPGNVAVGNPRENSM

SEQ ID NO: 185962 - protein, 113 aa, Triticum aestivum
  unsure (1)..(113): unsure at all Xaa locations
  Clone ID: PAT_TA_80380.pep
MVSLKLQKRLASSVLKCGKGKVWLDPNEVNEISMANSRQNIRKLVKDGFIIRKPQKIHSXRSRARRAHXGXQXGRSLLGYCXXRGXKEAKAPQQRXXVGXRRMRPGPFCKVTL

SEQ ID NO: 185963 - protein, 75 aa, Triticum aestivum
  Clone ID: PAT_TA_80381.pep
MSCNCGSGCSCGSNCKCGKVYPDLTEQGSAAAQVAAVVVLGVAPENKAGQFEVAAGQSGEGCSCGDNCKCNPCNC

SEQ ID NO: 185964 - protein, 175 aa, Triticum aestivum
  unsure (1)..(175): unsure at all Xaa locations
  Clone ID: PAT_TA_80382.pep
MDDIAEPGSPTSPTATSSSSSSSSSSSLAANKRPRKDSRHPTYHGVRMRSWGKWVSEIREPRKKSRIWLGTFATAEMAXARAHDVANAXHQRAAPPNLNFPDLAXLLAPARASAGRPKDVQGRGQYSPPSGRISPWRGAKWQMAKEAPEQAGSRTPKGSAGGLAGRGRGSPGPKA

SEQ ID NO: 185965 - protein, 115 aa, Triticum aestivum
  Clone ID: PAT_TA_80383.pep
VYLTGEKRREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 185966 - protein, 172 aa, Triticum aestivum
  unsure (1)..(172): unsure at all Xaa locations
  Clone ID: PAT_TA_80384.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDXARYWTMXGKLPMFRDATRPPXKVDXTKVGRSKKGTLNPPHRDFQCVQGASGVKLHPSKPGCE

SEQ ID NO: 185967 - protein, 97 aa, Triticum aestivum
  unsure (1)..(97): unsure at all Xaa locations
  Clone ID: PAT_TA_80385.pep
MSCCGGNCGCGSGCKCGNGCGGCKMYPEMDEGVNTASQTLIMGVAPSKGTPSFEAAAXNGGCKCGPNCTLQTVATCKWIHEASIKIQIKGRMAWEWT

SEQ ID NO: 185968 - protein, 184 aa, Triticum aestivum
  unsure (1)..(184): unsure at all Xaa locations
  Clone ID: PAT_TA_80386.pep
XGFERRXXDGGNDXXGXXXPELGDRXNVPQGPGPPXXVAPGGGGLXLXRRAEGAXXCNLGPFASSRSFGHXGGTXSASLAMLCSFLRKLLXGHLQAPCSPPSKLCFSSSTLSWGCSSSWKDQSVEKRVVSMASPKPRGSGSIAIASSVLDLLALRQTVTHCAAPALVSGRGRLLLGGGGLLVLG

SEQ ID NO: 185969 - protein, 77 aa, Triticum aestivum
  unsure (1)..(77): unsure at all Xaa locations
  Clone ID: PAT_TA_80387.pep
MRECISXHIGQAGIQVGNACWELYCLEHGIQPDGQMPGDKTVGGGDDAFNTFFXETGAGKHVPRAVFVXFXPNCDLM

SEQ ID NO: 185970 - protein, 89 aa, Triticum aestivum
  unsure (1)..(89): unsure at all Xaa locations
  Clone ID: PAT_TA_80388.pep
LAFLFPXXIXGRIMXSEQSLGRLLSCDFFHRGFSSSWXSSGPHXPQXKGVHASQQSLGRLLSSVSSPGFYLELEILVRLTPPTEGCACL

SEQ ID NO: 185971 - protein, 168 aa, Triticum aestivum
  unsure (1)..(168): unsure at all Xaa locations
  Clone ID: PAT_TA_80389.pep
WCKIEVAQAGGGQEPVVQGLRPLEQPYRRGHHQHPALPAPGEGESAGAXATPDLPTNKGSANLQQQPGGQATKRGGKXPDWRASKRXNPTPGWRDRPWRNXHFXEAGAAISAGSRRXGGRKXTXQQTKGVAXPPXGXWPQTPXVFAFXRXKTGHPGFLXTLXRTXPPX

SEQ ID NO: 185972 - protein, 90 aa, Triticum aestivum
  Clone ID: PAT_TA_80390.pep
GTSLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 185973 - protein, 160 aa, Triticum aestivum
  unsure (1)..(160): unsure at all Xaa locations
  Clone ID: PAT_TA_80391.pep
MAPTVMASSATSVAPFQGLKSTAGLPVSRRSNGASLGSVSNGGRIRCMXVWPIEGIKKFETLSYLPPLSTEALLKQVDYLIRSKWVPCLEFNKXGFNXPLTTTQXLGYYDGRYWDNVESLPXFRVXPNAKXNXFKQGXXEVKKRXYPDPXCPESPEPHAL

SEQ ID NO: 185974 - protein, 76 aa, Triticum aestivum
  unsure (1)..(76): unsure at all Xaa locations
  Clone ID: PAT_TA_80392.pep
MAASALHQTTSFLGTAPRRDDLVRSVGDFGGRITMRRTVKERAPRSIWYGPEXVPKYXGXFSXQTPXXRTGEXPGE

SEQ ID NO: 185975 - protein, 164 aa, Triticum aestivum
  unsure (1)..(164): unsure at all Xaa locations
  Clone ID: PAT_TA_80393.pep
PPXGIAFFSXKAEEXXQPPAGRPAAGRPKGSSPGDXPTHPRKMCPRPPGGXPRGANLAXXAXGGPXGPGSXXIXXXGLGIGWFFLXTRLQSVWAWVSLGSREVYKGGQLVTGGGVPAGEAGQMRLPGACGVSGSGGVRRPVGKSAGCRGKSAPFALLVPNSARG

SEQ ID NO: 185976 - protein, 85 aa, Triticum aestivum
  unsure (1)..(85): unsure at all Xaa locations
  Clone ID: PAT_TA_80394.pep
MDAGAVAGCLRDKTVLVTGSTGYLGKLMVEKILRVQPDVKKVYLXLVXAPDAASAEQAFPDXVLGKDLFKNPGKSTGLLGFQKAD

SEQ ID NO: 185977 - protein, 170 aa, Triticum aestivum
  Clone ID: PAT_TA_80395.pep
MEMERVCNRRAGMPPALLLALHGIDEQMMPASSLPPPQTPMEPMEYLSRSWSVSADDISKALLLKGDTKRSFFAPADALLPPSPMPETMTSSSYELLAAPASFQVIIKIHHQHVTNHLLPSFLLFLAKLVFTLCNMYASVKLERTNLRWKNNGEFAGVCTKHLCSEAFKK

SEQ ID NO: 185978 - protein, 175 aa, Triticum aestivum
  unsure (1)..(175): unsure at all Xaa locations
  Clone ID: PAT_TA_80396.pep
PYIADGCKDVDECKTPGTCNGICHNTEGSHYCTECPSHTVYDTTIKMCTSTKKQNLVLGIVIGISVGFGILLLMSIVILLIRXWNKDIKKKLRXKHFRQNQGLLLEQLISXXENAXDNTKIFSLSELEKATNNFDPHVXFVXEGXGKVXXGXLSDXRXLGKKKSXIXGKFKNSLP

SEQ ID NO: 185979 - protein, 83 aa, Triticum aestivum
  unsure (1)..(83): unsure at all Xaa locations
  Clone ID: PAT_TA_80397.pep
PLSLSLPACTRTSSGXAFSAAFFXLPLFLPXSXLTSPGXPPQXXHGLTRSSRPSVTXSGGHPPXAPRVTGGPXXPXRPPMAXL

SEQ ID NO: 185980 - protein, 157 aa, Triticum aestivum
  unsure (1)..(157): unsure at all Xaa locations
  Clone ID: PAT_TA_80398.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDXXVDSFPFKGGKYEMKKFCLEPNSLNVKAXGIXKNKPXAFKKQTQ

SEQ ID NO: 185981 - protein, 105 aa, Triticum aestivum
  unsure (1)..(105): unsure at all Xaa locations
  Clone ID: PAT_TA_80399.pep
WTIVDXFPFSGATLLFDKKQFIFSXLRRNIQXPXFPSFEGDDLXDAFKKNVEXXTKYXLSKLKDLQFFVGESMHDDGGVVFXYYKEGAAXPTFLYFAHGLKEVKC

SEQ ID NO: 185982 - protein, 155 aa, Triticum aestivum
  unsure (1)..(155): unsure at all Xaa locations
  Clone ID: PAT_TA_80400.pep
LXGLXIPRVWPKXLXVXIPXXGSVLIXFFSRPXSXPKXXLDXAXQVFVFIARXCXNLVFLFPGFPAKXXLWXXSTLEGLFPTTKQLFPSLQVFFXXPGFXNAFDVSKFPEXIGMQHTSRRGRXSFLDRPRPVARPSSEHTTTAKEEALTTSHGGS

SEQ ID NO: 185983 - protein, 149 aa, Triticum aestivum
  unsure (1)..(149): unsure at all Xaa locations
  Clone ID: PAT_TA_80401.pep
LAGFDSAAVGDDECCPWLARPCCLLRRFWRKRRRSGSGGGGRPRPWGWRGGLGVVTSISGVSIRGGPVPRGNPNGRSXPQRVNVRFREGKXXGXGWAKPNLQTPGVGWVGAASQXXPAIXAQIVFXPCPAVXAWGKKKNLPXVPXXLRD

SEQ ID NO: 185984 - protein, 104 aa, Triticum aestivum
  unsure (1)..(104): unsure at all Xaa locations
  Clone ID: PAT_TA_80402.pep
MSGRGKGGKGLGKGGAKRHRKVLRDNIQGITKPAIRRLARRGGVKRISGLIYEEDPRXVLKIFLENVIRDAVTYTEHARRKTVTAMDVSKPSKRQGXNLYGFGG

SEQ ID NO: 185985 - protein, 94 aa, Triticum aestivum
  unsure (1)..(94): unsure at all Xaa locations
  Clone ID: PAT_TA_80403.pep
MAASMITSPIVAPTSVPSLSRRGSSFAVVCSGGKKIKVDKPLGLGGGLXVDIDANGKEGGXKGVYQXFVYKYGAHVHGYKPIXTPXEWAESGER

SEQ ID NO: 185986 - protein, 129 aa, Triticum aestivum
  unsure (1)..(129): unsure at all Xaa locations
  Clone ID: PAT_TA_80404.pep
LVPNSARGGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCXESGKG

SEQ ID NO: 185987 - protein, 123 aa, Triticum aestivum
  unsure (1)..(123): unsure at all Xaa locations
  Clone ID: PAT_TA_80405.pep
VAXRWXPPVXAXPLXXXRICPSLPXFIGWLLFYPXGSRRTRPXHXAAAQAERQQGSRXPCCAGARAGVAGPDAVPHGWRRGGQLRVPRQLQATTGVLPLLHSGHNLGLGQQQQADEEPDLTLQ

SEQ ID NO: 185988 - protein, 80 aa, Triticum aestivum
  unsure (1)..(80): unsure at all Xaa locations
  Clone ID: PAT_TA_80406.pep
DAPPPPGARTLASIFLDSAESSFTNSSARRDCSDSPSTASXVSAEGGGDALTAEDAVVVGPLRSSERLLFEPGGVGGQQQ

SEQ ID NO: 185989 - protein, 89 aa, Triticum aestivum
  unsure (1)..(89): unsure at all Xaa locations
  Clone ID: PAT_TA_80407.pep
MSCCXGNCGCGTACKCGNGCGGCNMYPXEAEAAGATLLRLRHRHPTRRAPAGMEIGGREKRAGWRAGNQVAKLRATKLAGAPLLALRFD

SEQ ID NO: 185990 - protein, 159 aa, Triticum aestivum
  unsure (1)..(159): unsure at all Xaa locations
  Clone ID: PAT_TA_80408.pep
GPIEGIKKFETLSYLPPLNTEALLKQVDYLIRSKWVPCLEFSKVGFIFREHNATPGYYXXRYWXTMWKACLMFGVQLNPQQLTKVGGRVKKGSNPEPVMSRNQSGIPNKQLSVAIAKLQSAFKANRGAKGRGKGPTSNNKGNILKLQFCKLLLLFPSPN

SEQ ID NO: 185991 - protein, 109 aa, Triticum aestivum
  unsure (1)..(109): unsure at all Xaa locations
  Clone ID: PAT_TA_80409.pep
MAPTVMASSGTSVAPFQGLKSTAGLPVSRRSNGASLGSVSNGGRIRCMXVLXQLRGIKKFRRTLSYFATGFKQREGPPSKQGSELTLFRFKVGLLPPKFQKGLGFNPSR

SEQ ID NO: 185992 - protein, 145 aa, Triticum aestivum
  unsure (1)..(145): unsure at all Xaa locations
  Clone ID: PAT_TA_80410.pep
MARLNSKAVVSAVVLAAVVLMMAGREATALSCGQVDSKLAPCVSYVTGKAPSXSKECCSGVXGLNGLARNNPDRKDVQGASKSLPTKHQQSTMGQRSSGRSPGKRGSAVALPQSSNQPNWKQSTKFKYNLPERNAKGPLVLEAIS

SEQ ID NO: 185993 - protein, 146 aa, Triticum aestivum
  unsure (1)..(146): unsure at all Xaa locations
  Clone ID: PAT_TA_80411.pep
MAGKGGKGLLAAKTXAAXTAHXDKGKKGPISRXSXRAGXQFPXVGRFHPQXXXKXSRQRAXXGAXXXGXIXFYXGSXXQLKSLELGXKPHKXXXGKRXNPXXLNLAILEXKKXXTPIKGTXSCGGXXPPNHKXSLIXKSSQIQKIF

SEQ ID NO: 185994 - protein, 76 aa, Triticum aestivum
  Clone ID: PAT_TA_80412.pep
MSCCGGNCGCGSGCKCGNGCGGCKMYPEMDEGVNTASQTLIMGVAPSKGTPSFEAAAENGGCKCGPNCTCNPCTCK

SEQ ID NO: 185995 - protein, 124 aa, Triticum aestivum
  unsure (1)..(124): unsure at all Xaa locations
  Clone ID: PAT_TA_80413.pep
GRLHFRXRRGXMNAPXGCNQASXPTGAEERRRGQRGREQQGRCSGASAIERXGRVAAAAAATTTTADRRAWAPANAEWNWGFVKLSEQDESGAETGFSIALRFVCPGVSRWRGSHVRGRTTRVX

SEQ ID NO: 185996 - protein, 54 aa, Triticum aestivum
  unsure (1)..(54): unsure at all Xaa locations
  Clone ID: PAT_TA_80414.pep
LXQTXPRXRGDXXRTAGLVEFXNXHXPVLGHRRGPLRGRXXLXRGAHELPQVVA

SEQ ID NO: 185997 - protein, 80 aa, Triticum aestivum
  unsure (1)..(80): unsure at all Xaa locations
  Clone ID: PAT_TA_80415.pep
MAALSSAAVSVPSFAAKAATPMRSSRMVVRASLGKKAAXSAAVAVAANAXMLLGGSAMAQXTLLLGANGGRCWCSKPKRI

SEQ ID NO: 185998 - protein, 163 aa, Triticum aestivum
  unsure (1)..(163): unsure at all Xaa locations
  Clone ID: PAT_TA_80416.pep
YREGLMSPQTETKAGVGFKAGVKDYKLTYYTPEYETKDTDILAAFRVSPQPGVPPEEXXAAVTAESSTGTRTTVWTDGLTNLDRYKGTXFHNQPVXGENNQXVCYXXXPINLFXKGSVSNKFTSNVXGTLFVSKXQRAPRLXDLQIPPPFQKXFKXXPKGIQI

SEQ ID NO: 185999 - protein, 169 aa, Triticum aestivum
  unsure (1)..(169): unsure at all Xaa locations
  Clone ID: PAT_TA_80417.pep
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVXRRSKKEXPDAYVRVIGFQXLRQVQCVQLIPIKAXGQ

SEQ ID NO: 186000 - protein, 123 aa, Triticum aestivum
  Clone ID: PAT_TA_80418.pep
LFENKISSNWQACFVPRSLQKHLDEHMARVRVGRRSRVGRLAGSLQLQCCFPALRGRCSPVWWTGGCKVGVARSAPWCLCLPSSLMDAVEGSRYHWRQPLKAPSIFRHQAEVRLHPTLLAGTA

SEQ ID NO: 186001 - protein, 107 aa, Triticum aestivum
  unsure (1)..(107): unsure at all Xaa locations
  Clone ID: PAT_TA_80419.pep
MAARGNIKLELDSLVDNSLTEMEFEEGWSSLIERYDASKNEYLQFMWRIRKIWAPVYFKTXFYPFAESLGRSEGMNIVLFXNYVLPKDRIXKFIQRYEEIQETTXKT

SEQ ID NO: 186002 - protein, 178 aa, Triticum aestivum
  unsure (1)..(178): unsure at all Xaa locations
  Clone ID: PAT_TA_80420.pep
MATMSLAAASPLTASTPRGLAVSAPRAPFLGLRSFGAPATRFAGLAAAPRPSGRGDAAVVRMAKREQELEEIRAMXTENLEQEVVDLKGELFLLRLXKRSARQEFKXXEFGRNAQRGFARLLTVKKXKGKLNKGINKKKFXRXLDKKWELGXCGWTPQSPKEKKXGDKTANFQINSTP

SEQ ID NO: 186003 - protein, 165 aa, Triticum aestivum
  unsure (1)..(165): unsure at all Xaa locations
  Clone ID: PAT_TA_80421.pep
MAAKEPMRVLVTGAAGQIGYALVPMIARGVMLGADQPVILHMLDIEFAAEALKGVKMELIDAAFPLLKGVVATTDVVEXACTGVNVCXLMGWWIPQGKEGMGKGKDVMNKNVSIXXSSNXLLLEAQXXPQMQRFXFXSKPNKXQXXQXXKEXAPXXXLKKXTIFP

SEQ ID NO: 186004 - protein, 122 aa, Triticum aestivum
  unsure (1)..(122): unsure at all Xaa locations
  Clone ID: PAT_TA_80422.pep
GYATVAPRARSSTIVASLGTPAPSNSSSFRPKLIRNTPIQAAPVAXPALMDAAVEAPQRTGFEKXLKNRGLTKKKARFPSEAPQRAXQGAQIKWCSGVAAXSRXWPXVNLGLXPGXGXNNXK

SEQ ID NO: 186005 - protein, 177 aa, Triticum aestivum
  unsure (1)..(177): unsure at all Xaa locations
  Clone ID: PAT_TA_80423.pep
MASLVAVQPVAVRGLAGSSISGRKLAVRPASAAVSRSTRRARGAAVVAKYGEKSVYFDLDDIANTTGQWDLYGSDAASPYNGLQSKVLQQLRPRPLTKRRLLLKVLLLGGGSLLAYVKRQRLPRTGSPXXKGPNCPPTPGATWERKIQIKGFLLPPRACVQRDLNGFPPIGPQIPRL

SEQ ID NO: 186006 - protein, 182 aa, Triticum aestivum
  unsure (1)..(182): unsure at all Xaa locations
  Clone ID: PAT_TA_80424.pep
LAFTLGVKQMICCCNKMDATTPKYSKARYEEIVKEVSSYLKKVGYNPEKVPFVPISGFEGDNMIERSTNLDWYKGPTLLEALDXINEPKRPSDKPLRLPLQDVYKIGGIGTVPVGRVETGVIKPGKVVTFGPTGLTTEXSKSVEMQHESLLXAPPGXNSGFKREKTXXSKDXKRGVCCNPNS

SEQ ID NO: 186007 - protein, 57 aa, Triticum aestivum
  unsure (1)..(57): unsure at all Xaa locations
  Clone ID: PAT_TA_80425.pep
CXRKGALRETVNLPSGGGFAINFFSGQTTKTNFAVSCRRQRKTDGKIGSSCRIRHEA

SEQ ID NO: 186008 - protein, 157 aa, Triticum aestivum
  unsure (1)..(157): unsure at all Xaa locations
  Clone ID: PAT_TA_80426.pep
MQIFVKTLTGKTITLEVESSDTIDNVKAKIQDKEGIPPRPSKRLIFAGKQLEDGRTLADYNIXKGVHPPTCPCVCGGGMQDFWKEPQLGKELINPFEGLSLNNQSEQIVQRGKDSKQRGGIPGTQAAWIFLLGANLGWSTLRPTNKNPKKGFPLTLV

SEQ ID NO: 186009 - protein, 120 aa, Triticum aestivum
  unsure (1)..(120): unsure at all Xaa locations
  Clone ID: PAT_TA_80427.pep
MAASMITSPIVAPTSVPSLSRRGSSFAVVCSGGKKIKVDKPLGLGGGLTVDIDANGXXVGKXGVXQFVENTXATSEGXSQSKTPXEWSESGXTAXPGGTXGLXIWAXXLAGLXGGGVLLV

SEQ ID NO: 186010 - protein, 144 aa, Triticum aestivum
  unsure (1)..(144): unsure at all Xaa locations
  Clone ID: PAT_TA_80428.pep
MARTKQTARKSTGGKAPRKQLATKAARKSAPATGGVKKPHRFRPGTVALREIRKYQXKSTELLIRKLPFQXRLVRGDRARDFKEPXLKFQVLPLCGAARARRGQLPWGAVSKENKPGANSKKRQMAKGNPSSRGKKRKFWLPPN

SEQ ID NO: 186011 - protein, 120 aa, Triticum aestivum
  unsure (1)..(120): unsure at all Xaa locations
  Clone ID: PAT_TA_80429.pep
KLQGKTLFIRASKLFFSRKGALRALPVNGVXGRARSLLKDXDRPGPRLHPRSRTPKTLRRLPRAPRSLRRSRRLAPCPGRRGFSGEGGLALDAGCSGRRGRATGALASAGEMGDSDGEGP

SEQ ID NO: 186012 - protein, 85 aa, Triticum aestivum
  unsure (1)..(85): unsure at all Xaa locations
  Clone ID: PAT_TA_80430.pep
GEAQEHTSRRGATAQLFRLVSPRLAPPRPLPVPPARRQPNSFPRGLNSRRAPAGRNLLXGIXXSANKXGVGKEXLXXNNXXKKXL

SEQ ID NO: 186013 - protein, 68 aa, Triticum aestivum
  unsure (1)..(68): unsure at all Xaa locations
  Clone ID: PAT_TA_80431.pep
XLTGGKIYFEPXXFSLXFCFIHFGFPFFLFLLFFXSPTFAXLTPIAYHPLLRLIEFGDECXQEQLFYH

SEQ ID NO: 186014 - protein, 112 aa, Triticum aestivum
  unsure (1)..(112): unsure at all Xaa locations
  Clone ID: PAT_TA_80432.pep
IXKFWNXKIPRDVEXXTXXAXXVNRHXHCPKXNSXNFRXLDYXXPVXXGHRXHLXGLXXGLAGWFXXYXXHXNYKNPCKSIXXFXXKKKKKKKKKKKKKKKKNSKLGLSLSP

SEQ ID NO: 186015 - protein, 44 aa, Triticum aestivum
  unsure (1)..(44): unsure at all Xaa locations
  Clone ID: PAT_TA_80433.pep
XTKLNEHISXQMRPLVLSRPIFVFIYQKIHYNSTNGRICPLILL

SEQ ID NO: 186016 - protein, 157 aa, Triticum aestivum
  unsure (1)..(157): unsure at all Xaa locations
  Clone ID: PAT_TA_80434.pep
PTTTSPAACPEKHLSCPPVFVHDRERPYILLLLIRFRRIFLDLRHRSPTGPSIDLVRGSHRRAVPPPQERRRAQAEADGPAGHVGGAPRRLRWRRWWKNCWGDRRMRCTWCCXPCLRLVGGFPASVQVLQXGXXAFKLXLXGCPPTCRGXAPXXRXG

SEQ ID NO: 186017 - protein, 150 aa, Triticum aestivum
  unsure (1)..(150): unsure at all Xaa locations
  Clone ID: PAT_TA_80435.pep
MAPTVMASSATSVAPFQGLKSTAGLPVSRRSNGASLGSVSNGGRIRCMQVWPIEGIKKXSKTLSXLPTLKQREGLLKARSELTLIRFKVXCLCLRSXXKGXGLIFRXAKXNPWGYNNWRFWEMWXLPXMFXXNXPNQGXKQVXEGKKGXP

SEQ ID NO: 186018 - protein, 120 aa, Triticum aestivum
  unsure (1)..(120): unsure at all Xaa locations
  Clone ID: PAT_TA_80436.pep
TTPKYSKARYEEIVKEVSSYLKKVGYNPDKVPFVPISGFEGDNMIERSTNLDWYKGPTLLEALDQDQXKPKRPSNKPLRLPLQDVYKIGGIGTXVPVXPFLKTGXXKPGLWVVTFGPNWV

SEQ ID NO: 186019 - protein, 95 aa, Triticum aestivum
  unsure (1)..(95): unsure at all Xaa locations
  Clone ID: PAT_TA_80437.pep
RFFPXIWXLXXXNGXQVXXXVNQVCEXDXPHSPXLCXLKXGLXXXFGGGRRRRRVVKXXNXPVNXXXNYCFLXFPNSPTHFXFSTFFFXTILQSH

SEQ ID NO: 186020 - protein, 132 aa, Triticum aestivum
  unsure (1)..(132): unsure at all Xaa locations
  Clone ID: PAT_TA_80438.pep
GLVMFREKDIESRPFLEAAKACMEICRSSGVPLLINDRVDIALACNADGVHVGQSXISARXVRELPLDRGKIIGVXXXRXXQNXXQRLWRNGXDXLGGGGXFQPRTKXNNPXXGNXRXKXVCFGXKFPXXXN

SEQ ID NO: 186021 - protein, 47 aa, Triticum aestivum
  unsure (1)..(47): unsure at all Xaa locations
  Clone ID: PAT_TA_80439.pep
IDQYCISSRSLSHXGSNKKVDSCXKKKKKKKKKKKKKKNSRLVLSLS

SEQ ID NO: 186022 - protein, 100 aa, Triticum aestivum
  Clone ID: PAT_TA_80440.pep
MSCCGGNCGCGTACKCGNGCGGCNMYPEVEAAGATLLVSATATHKASSGGMEMAAENGGCGCTQCKCGTSCGCSCCKLLDSSIMHAPVPCVHQSIISIYY

SEQ ID NO: 186023 - protein, 130 aa, Triticum aestivum
  unsure (1)..(130): unsure at all Xaa locations
  Clone ID: PAT_TA_80441.pep
VDCVRDYEVLRKELPGDTEVAESLFHAQVALKTTRGEEVSNMKFGGEVEIVTXSIEQVRAAIHSPGVTVLYFMATMNQQCAQITPSXWDALCSECPSVNFLKVKCXXRSPXISKGQRNARNPRAIKIQRG

SEQ ID NO: 186024 - protein, 107 aa, Triticum aestivum
  Clone ID: PAT_TA_80442.pep
EDKPIFADSSPEQHGAPMYDSERIPAAAKEVEHNDAPAAAQEVKRDHAAGMRLGDLGGPPSAKEVKLDDTQRVPLGDLWRPGSGAGEARRSGGAALVLAPPAAGARR

SEQ ID NO: 186025 - protein, 85 aa, Triticum aestivum
  unsure (1)..(85): unsure at all Xaa locations
  Clone ID: PAT_TA_80443.pep
MQIFVKTXTGKTITLEVXSSDTIXNVKAXIQDKEGIPPXDQQRLXFAGKXQLERWGETLSDYXHSRKRVHXPILSLKXLGWTNGK

SEQ ID NO: 186026 - protein, 143 aa, Triticum aestivum
  unsure (1)..(143): unsure at all Xaa locations
  Clone ID: PAT_TA_80444.pep
MAPTVMASSATSVAPFQGLKSTAGLPVSRRSNGASLGSVSNGGRIRCMQVWPIEGIKKFETLSYLPPLSTEALLKQVDYLIRSKWVPXCLEFXKGGFIFRXSKNAXPGYYDGPGTGQMWEAAYVSGNRQRKLINGGKLKRSYP

SEQ ID NO: 186027 - protein, 90 aa, Triticum aestivum
  Clone ID: PAT_TA_80445.pep
MSDSEDHHFESKADAGASKTYPMQAGAIRKGGFLVIKNRPCKVVEVSTSKTGKHGHAKCHFVALDIFNGKKLEDIVPSSHNCDVPHVDRY

SEQ ID NO: 186028 - protein, 59 aa, Triticum aestivum
  unsure (1)..(59): unsure at all Xaa locations
  Clone ID: PAT_TA_80446.pep
SVICVIWIKGRNEIXKVSKXYTXFLXFLQXMINXXXXPASXGKINCQWALKXGRVVPXE

SEQ ID NO: 186029 - protein, 48 aa, Triticum aestivum
  Clone ID: PAT_TA_80447.pep
IIVPAGFNEQGVPFGICFGGLQGYEPRLIEMAYAFEQATKVRKPPMFK

SEQ ID NO: 186030 - protein, 149 aa, Triticum aestivum
  unsure (1)..(149): unsure at all Xaa locations
  Clone ID: PAT_TA_80448.pep
MAPKAXKKPAAKNPAYDEPAAEKAEKTPAGNKPKADXRLPAGKSAAXEGGDKKGKERKAKKXVGDVQRFYIFKVAETSCNPDIXDLLQGHXQSMNSFINXHLXKAPPGRXPXWXGXTKKPTIXXSGEIQNSXRLVLPGXLXKXPVSXXN

SEQ ID NO: 186031 - protein, 60 aa, Triticum aestivum
  unsure (1)..(60): unsure at all Xaa locations
  Clone ID: PAT_TA_80449.pep
LSPXXPRTRGXSPLPPHNXPPWPPSPPPPPPXCSSXRPPPPPXIPLLPLXTSLFPSHGFG

SEQ ID NO: 186032 - protein, 100 aa, Triticum aestivum
  unsure (1)..(100): unsure at all Xaa locations
  Clone ID: PAT_TA_80450.pep
MAPAVMASSATTVAPFQGLKSTAGLPVSRRSSGSLGRVSNGGRIRCMQVWPIEGIKKFETLSYLPPLSTEALLKQVDYLIRSKXGVPCLEVQQGLGFVFR

SEQ ID NO: 186033 - protein, 101 aa, Triticum aestivum
  unsure (1)..(101): unsure at all Xaa locations
  Clone ID: PAT_TA_80451.pep
MAAAFSSTVGAPASTPTNFLGKKLXKXXTXALXXXGKSSKGNRFTVMGXRENIHKETTVLVGKGPCFEYLPNEPSKGQLTKGKGWTPLLSAQIEGTQQGAF

SEQ ID NO: 186034 - protein, 141 aa, Triticum aestivum
  unsure (1)..(141): unsure at all Xaa locations
  Clone ID: PAT_TA_80452.pep
MAPAVMASSATTVAPFQGLKSTAGLPVSRRSSGSLGSVSNGGRIRCMQVWPIEGIKKFETLSYLPPLSTEALLKQVDYXIRSKWVPCLEXFNKVGFVFREQNSSXPGYYDRRXGTMWKXLPMFGLQRQHRVLKRGREVDYP

SEQ ID NO: 186035 - protein, 159 aa, Triticum aestivum
  unsure (1)..(159): unsure at all Xaa locations
  Clone ID: PAT_TA_80453.pep
MAAAFSSTVGAPASTPTNFLGKKLKKQVTSAVNYHGKSSKANRFTXSWQAENLDEKRNTDKWKGLAYDISDDQQDITXRGKGIVDSLFQAPTGDGTHEAVLXSSYEYVSQGXSRNYDFDNNMGXFYIAPAFMDKLCFPSLQRNSRTPAQTSKXPLILGV

SEQ ID NO: 186036 - protein, 156 aa, Triticum aestivum
  unsure (1)..(156): unsure at all Xaa locations
  Clone ID: PAT_TA_80454.pep
MQIFVKTLTGKTITLEVESSDTIDNVKAKIQDKEGIPPDQQRLIFAGKQLEDGRTLADYNIQKESTLHLVLRLRGGMQIFVKTLTGKXTITLEVEXSSDTIRTMSRAKXQGTREGQFPRDQQAPGFFGRESLGGMGRQPAGLTTIPRKGVQPQPGG

SEQ ID NO: 186037 - protein, 115 aa, Triticum aestivum
  unsure (1)..(115): unsure at all Xaa locations
  Clone ID: PAT_TA_80455.pep
AIDPSGCAXLRTYDFRTQRYQRPGQQQRESTVGRPVLECGEEGGKRRDGWSSWMLGDQAAAMASPGRLGLLGPARSSAGAVVRGGPGPPVLGSWWRGAASPHRGRAVAEGAAEGA

SEQ ID NO: 186038 - protein, 130 aa, Triticum aestivum
  unsure (1)..(130): unsure at all Xaa locations
  Clone ID: PAT_TA_80456.pep
PGAPLPCPVPIHRSPPPLEPTAGHLQIRRSPATRPAHHLLPYADPLDLGLHSLPPTSARRGWPVVGRANHRALKGAQPLREARFILRAGRPGCCVPFLIFQLLQGEXWATPPPRLGXGPXISNWGGGVFQ

SEQ ID NO: 186039 - protein, 79 aa, Triticum aestivum
  unsure (1)..(79): unsure at all Xaa locations
  Clone ID: PAT_TA_80457.pep
LAAGEADSSXIXHEQYLNLTRRXTXWDXRRRASIRGSGPAALARFSPPGXYPTPGHIAQXXSVTALRPSLYSSGFHQXV

SEQ ID NO: 186040 - protein, 126 aa, Triticum aestivum
  unsure (1)..(126): unsure at all Xaa locations
  Clone ID: PAT_TA_80458.pep
MAASMITSPIVAPTSVPSLSRRGSSFAVVCSGGXNIKVDKPLGLGGGLTVDIDANGRKVGKKGVYQFVDKYGANVDGYNPIYTPXEWSESGERYAGGTNGLLXXAVNLXGXLGGGASSKKTTAPGK

SEQ ID NO: 186041 - protein, 93 aa, Triticum aestivum
  unsure (1)..(93): unsure at all Xaa locations
  Clone ID: PAT_TA_80459.pep
PPHGRHCKAHCLTSLSLEXIWDWNPLPRTSXGLHNASSNFLVAXNGINALXQYICLPIILXNXSGXXCKTXFNXGGXKDXXGLSILVHXGTXV

SEQ ID NO: 186042 - protein, 92 aa, Triticum aestivum
  unsure (1)..(92): unsure at all Xaa locations
  Clone ID: PAT_TA_80460.pep
LPDQIALAPSACSTNSCLQGLAQEDDYAILIPLSHIFALMLQALKLPPAIYHHKTYLANGVSCDGYFQFINYSLSMGLLIPTSISGVILXXL

SEQ ID NO: 186043 - protein, 61 aa, Triticum aestivum
  unsure (1)..(61): unsure at all Xaa locations
  Clone ID: PAT_TA_80461.pep
TXIGXRGVEGTXXGTGRGXGPAGAAAQTAGAXXRRXSGHLLLAXVTGAGXQVMAGSHGRWT

SEQ ID NO: 186044 - protein, 131 aa, Triticum aestivum
  unsure (1)..(131): unsure at all Xaa locations
  Clone ID: PAT_TA_80462.pep
MARPGGASAPNVVRGRPGARRXLXXLDFDLEAFSHNPAHGSFAPLXAFQPSAMTNCVNQRFLSYXVELLSRHCHSXGKTNLSHDGLTPAHVPYWWVNNPTLGEFCFTMIGRADIEGSKSNVAMNAWLPQAS

SEQ ID NO: 186045 - protein, 101 aa, Triticum aestivum
  unsure (1)..(101): unsure at all Xaa locations
  Clone ID: PAT_TA_80463.pep
MAPTVMASSATSVAPFQGLKSTAGLPVSRRSNGASLGSVSNGGRIRCMQVWPIEGIKKFETLSYLPPXLNTEXLLKQVDYLIRSXWVPCLRXXAXLGFNFR

SEQ ID NO: 186046 - protein, 168 aa, Triticum aestivum
  unsure (1)..(168): unsure at all Xaa locations
  Clone ID: PAT_TA_80464.pep
MAVGKNKRISKGRKGXKKKAVXPFTXKQWYDIKAPLLFTXRNVGKTLVSRTQGTKIASEGLKHRVFEVSLAXLQNDEDQAYRKIRLRXEDXQXINVLTNXWGMDFTNDKLXSLVKKWETLIWAQVDVEDLTNNSQWFRQFGKNTNLNNFYAQSDYIPKDLLWANKPNL

SEQ ID NO: 186047 - protein, 49 aa, Triticum aestivum
  unsure (1)..(49): unsure at all Xaa locations
  Clone ID: PAT_TA_80465.pep
FXFXXFXXFFFFFFFFFFFFFFFFLVQNELNLSMAITTNLINFXYGTTS

SEQ ID NO: 186048 - protein, 108 aa, Triticum aestivum
  unsure (1)..(108): unsure at all Xaa locations
  Clone ID: PAT_TA_80466.pep
TPRGRGRXAPPVTPAPVPLVGVHLGHRFDXRTSDPRPPRPRRDPHYLETAADAPVINYIDDDPCFVSSKASRCWSPXAXRHPRRRLLLLHRRCLLLRATPLTTTXEVV

SEQ ID NO: 186049 - protein, 79 aa, Triticum aestivum
  unsure (1)..(79): unsure at all Xaa locations
  Clone ID: PAT_TA_80467.pep
SSSVGARGRVLISKPPATPVKPPFASSALAPXPXPAESCSRRRSSSTXTSXMXESLXXLSTPVSALRAAGCXKXDXXXP

SEQ ID NO: 186050 - protein, 184 aa, Triticum aestivum
  unsure (1)..(184): unsure at all Xaa locations
  Clone ID: PAT_TA_80468.pep
SSLLCPQNPSRRLTARRRRSELFLHRRNHGDPDQQEEEVCERWRFLRRAERDADPGACRGRLLRRGGARDAQXAREIIIKGQRGRKTCFGEEXAARXKGSSTSRSSKKRFKLSRRNGXFKLLXPXXGSSKPVGPPGGXXAPKAEVNSXLQNLLXGGXXPSRKGQXLXXVSSPFXXXKIGAXKXX

SEQ ID NO: 186051 - protein, 200 aa, Triticum aestivum
  unsure (1)..(200): unsure at all Xaa locations
  Clone ID: PAT_TA_80469.pep
DHGASRRTHYPSPPARPLPVLRPRLIRGCELPRSTQGQGAGGFFSGIPWFRGGQXGLALRGAEAWAPGLSWRGGGPGRLXAKGGKVPRRRGNSATLPLVLPPNKGSLFTKQAXXKLPVPNCXQLXXKLTNGKKIGRXESXLAAGXFQISNWNKLSKAQXAXFKXTKLTGGGKNWFNWGKGFXXXLQINKSQGXNRPMXLV

SEQ ID NO: 186052 - protein, 94 aa, Triticum aestivum
  unsure (1)..(94): unsure at all Xaa locations
  Clone ID: PAT_TA_80470.pep
MGKIKIGINGFGRIGRLVARVALQSDDVELVAVNDPFITTEYMTYMFKYDTVHGHWKHXSDIKLKDDKTLLXFGEKPXNRPSGVRETLXEFPWG

SEQ ID NO: 186053 - protein, 105 aa, Triticum aestivum
  unsure (1)..(105): unsure at all Xaa locations
  Clone ID: PAT_TA_80471.pep
MSGRGKGGKGLGKGGAKRHRKVLRDNIQGITKPAIRRLARRGGVKRISGLIYEETRGVLKIFLENVIRDAVTYTEXHARRKTVTAMDVVYALKRQXGRNLYGFGG

SEQ ID NO: 186054 - protein, 149 aa, Triticum aestivum
  unsure (1)..(149): unsure at all Xaa locations
  Clone ID: PAT_TA_80472.pep
MAPAVMASSATTVAPFQGLKSTAGLPVSRRSSGSLGSVSNGGRIRCMQVWPIEGIKKFETLSYLPPLSTEALLKQVDYLIRSKXWVPCLXXSAKVGFRLSLXKTXPPGYXQRPIWTMLXLPNFSGCNGRHLKRVEGRSGVTLPYRPGSN

SEQ ID NO: 186055 - protein, 79 aa, Triticum aestivum
  unsure (1)..(79): unsure at all Xaa locations
  Clone ID: PAT_TA_80473.pep
MAPKAEKKPAAAEKTPAAEKTTAGKKPKAEKRPPKSKEGGADKKKKKAKKSVETYKIYIFKVLKQVXPDIGISSKQCPS

SEQ ID NO: 186056 - protein, 101 aa, Triticum aestivum
  unsure (1)..(101): unsure at all Xaa locations
  Clone ID: PAT_TA_80474.pep
MGAAEQHQHPPAPEGEKKTLVFTYGTLKRGFSNHGLLQDLARXGDAAFVXAASKGAPLPARLAGPXRXPFLLKLPGYGQRVKGXKFYSGXPQGGSPPGTKG

SEQ ID NO: 186057 - protein, 114 aa, Triticum aestivum
  unsure (1)..(114): unsure at all Xaa locations
  Clone ID: PAT_TA_80475.pep
FPPRFPFXLXXYNFXKXIXVQXXSXXEIGGAXPGWRGRRTERGRWASQSTGELLRPFLNSPRPPVWRKVTCRAAAFFIRRIARXSRAIWTRLNRSQXLRRRRPPPPSCSAARTN

SEQ ID NO: 186058 - protein, 56 aa, Triticum aestivum
  unsure (1)..(56): unsure at all Xaa locations
  Clone ID: PAT_TA_80476.pep
RKSYSPLSSMLSRRLKNLCWRKENSXVNACLLLIKRSLLLIKRRQEMISLAQKKKK

SEQ ID NO: 186059 - protein, 133 aa, Triticum aestivum
  unsure (1)..(133): unsure at all Xaa locations
  Clone ID: PAT_TA_80477.pep
MAPAVMASSATTVAPFQGLKSTAGLPVGRRSSGXLSSVSNGGRIRCMQVWPIEGIKKFETLSYLPPLSTXALLKQVDYLIRSKWVPCLEFXAKVGFVLRXXHXXSPGYNERGEYWDNVESWMRHLTPIHATER

SEQ ID NO: 186060 - protein, 119 aa, Triticum aestivum
  unsure (1)..(119): unsure at all Xaa locations
  Clone ID: PAT_TA_80478.pep
CPPAXLWSFVLTRXXSFGAXGLPDRXQLMXXAXLFFLRXGRRPVSPPWSXQPRRGAGASTXASTGAGTSSVLATSSAETXXSTAGASSXSAAXGFWTSAVAIAVVDARKCPEWQTXQVS

SEQ ID NO: 186061 - protein, 51 aa, Triticum aestivum
  unsure (1)..(51): unsure at all Xaa locations
  Clone ID: PAT_TA_80479.pep
EKGXHTLVHNXHALGSCXKKIXNRERKWPXVKQLLHWGVYFIVLLLNILYL

SEQ ID NO: 186062 - protein, 138 aa, Triticum aestivum
  unsure (1)..(138): unsure at all Xaa locations
  Clone ID: PAT_TA_80480.pep
MAALSSAAVSVPSFAAKAATPMRSSRMVVRASLGKKAAXSAAVAVAASAMLLGGSAMAXDVLLGANXGVLVFEPNEFXVKSGENINFKKKPRFPAKSCVSXRNPXRPGVDVSKXSXXEXSTPQXKXFXXXLNVPXNXR

SEQ ID NO: 186063 - protein, 179 aa, Triticum aestivum
  unsure (1)..(179): unsure at all Xaa locations
  Clone ID: PAT_TA_80481.pep
VGKTQLLGRFAKDEFFLDSKSTIGVEFQTRTLTLHRKQVKAQIWDTAGQERYRAVTSAYYRGALGAMVVYDVTRRATFDHVPRWVEELRAHADXSTVVALVGNKADAPAQRPRGCPPNRRGFAGGAKGSFSRSGAGETLEAAALSSRLPRVLRPSPPGRLGPNKGAGGTQKGGGRALFT

SEQ ID NO: 186064 - protein, 80 aa, Triticum aestivum
  unsure (1)..(80): unsure at all Xaa locations
  Clone ID: PAT_TA_80482.pep
PFXCXKTXXLALWKVWRXKNPFGGXGICLWXGFLGGPSNLWVTFXQETXLRENGCSPKVSSRXCSNLKGPXKVNRXXGNP

SEQ ID NO: 186065 - protein, 160 aa, Triticum aestivum
  unsure (1)..(160): unsure at all Xaa locations
  Clone ID: PAT_TA_80483.pep
ASCRIRHEVFDEWLNEWWKSSPNSSDPSNEASSSLSEESXENLDQSDQXFKPGWKDIFRMNQSELEAEIRKVSQDSSLDPXRKANXIQNLKTKPLDXCQQKSPKPRXRKXXNGFTGIPGXFPPYRDSRENKILGCXQYKKKLQXWLXACXKXVQHARVCP

SEQ ID NO: 186066 - protein, 77 aa, Triticum aestivum
  Clone ID: PAT_TA_80484.pep
LVPNSARGCKRLFCHIMASSGRFQYMKMVLLLVILELILGISAGYGRGVPIYSKCTCSRHSIIISNQLRVFLIDNYI

SEQ ID NO: 186067 - protein, 68 aa, Triticum aestivum
  unsure (1)..(68): unsure at all Xaa locations
  Clone ID: PAT_TA_80485.pep
GRPLHFPFSSPSLPXRTPPPSXISXRCLLRXLDPDPPPPKPXXXPXRXDPXAXYHYXXPTPAPXXPRP

SEQ ID NO: 186068 - protein, 137 aa, Triticum aestivum
  unsure (1)..(137): unsure at all Xaa locations
  Clone ID: PAT_TA_80486.pep
MARTKQTARKSTGGKAPRKQLATKAARKSAPATGGVKKPHRFRPGTVALREIRKYQKSTELLIRKLPFQRLVREIAQXDFKTDLRFQKLRRLRAAXRRAEXYLVGLFEDXNLCAIXAKRXLTSCPKDIXLARRXRWG

SEQ ID NO: 186069 - protein, 158 aa, Triticum aestivum
  unsure (1)..(158): unsure at all Xaa locations
  Clone ID: PAT_TA_80487.pep
MAPTVMASSATSVAPFQGLKSTAGLPVSRRSNGASLGSVSNGGRIRCMQVWPIEGIKKFETLSYLPPLSTEALLKQVDYLIAXKWVPCLEXFKQGLGSSSREHNASPGYYELAGYWAKCWEACMFGLDANTKIPWGRVQKRSPTFSNNGSKNAKGAVL

SEQ ID NO: 186070 - protein, 143 aa, Triticum aestivum
  unsure (1)..(143): unsure at all Xaa locations
  Clone ID: PAT_TA_80488.pep
MAPKAAEKKPAEKTTAGKKPKAEKRAPASKEAGGEGKTRGRKKGSKAKKSVETYKIYIFKVLXXVHPGRWASPPKVMSIMNSFINDIFRRKLAGEVRXKLARXNKEAQPSRSREIQDLRSAFVPPRGSXPKXRPSXGGPKAQV

SEQ ID NO: 186071 - protein, 99 aa, Triticum aestivum
  unsure (1)..(99): unsure at all Xaa locations
  Clone ID: PAT_TA_80489.pep
CSSSCCCLTAARSIQHRGSNNGDGVVRAEELQRRGRAEACWRLRPGPAAPGCPFCAYATTSXRVTMSAEWXPGQXPRPAXLDGSXXKEFGVSNPLHRRK

SEQ ID NO: 186072 - protein, 183 aa, Triticum aestivum
  unsure (1)..(183): unsure at all Xaa locations
  Clone ID: PAT_TA_80490.pep
AGGPICAARTRPTRGTLDPVTHQSPVVGPANRRRRSHHPAPSFCLSSSFLCAPELLDVCCLGGLALAARPRATRPSGRRCTRRPLCSSNSTSDSRDFWCPPQATKRKTHASFXGIXFXFWLKDYXVWHKFSMXVKINCXMVVAXLSXKGIEFXWVCKVCGIVXNLFIAXQXWFVVFVPXPGFX

SEQ ID NO: 186073 - protein, 125 aa, Triticum aestivum
  unsure (1)..(125): unsure at all Xaa locations
  Clone ID: PAT_TA_80491.pep
PRSPKSSHSPTPPQPLVPMARTKQXARKSTGGKAPRKQLATKAARKSAPATGGVKKPHRFRPGTVALREIRKYQKSTELLIRKLPFQXRLVXEIAQDFKTDLRXQELRRLXXCMRRPXGYLVGVF

SEQ ID NO: 186074 - protein, 211 aa, Triticum aestivum
  unsure (1)..(211): unsure at all Xaa locations
  Clone ID: PAT_TA_80492.pep
PATVDLAAVTGVQPRFQSKSTIHLTASYGEPENPQFDPGQAEARPNRPKPCLLPVRARSPNPDRSAPPPPPRSTMLDLGHGMDPQDLRRLLPGPAAPSPPTPRSLRPPGFLLEPAGVTSPNNAXPTPAGGLLQQGGXTFPGSTVWRRPNRLGLSXXWRPMARAQRPXNSNPTVVWSKRNSSVPLSLGAKGGAQRNNSKGPGAGPNPKGPSG

SEQ ID NO: 186075 - protein, 151 aa, Triticum aestivum
  unsure (1)..(151): unsure at all Xaa locations
  Clone ID: PAT_TA_80493.pep
PRNYSIKKNRNRFFKMVNFFTFSFVTGLLTVGAADIIQPXSTLSGTIAPMLEPLQSAAGLSFDKLSASPGVRPKGLALTSPXRYLSQTLPDXDPKXSKXGIXSSXIXSDNXCSRQNEKXXXISCFPGXXKGILPXXLFFIXKGFXVXTKXA

SEQ ID NO: 186076 - protein, 125 aa, Triticum aestivum
  unsure (1)..(125): unsure at all Xaa locations
  Clone ID: PAT_TA_80494.pep
SQPWVPGDRFSLIGAPSTHGRSAASEPPPPXPRXPXXXPPPPRRPPPAAPPAPPSRPRRPDRASPPPRTPRAARRGAPPPRGAASPSSRPPPRSRRRGNPARTTPPRGGEIECVWEMEGAAARYY

SEQ ID NO: 186077 - protein, 104 aa, Triticum aestivum
  Clone ID: PAT_TA_80495.pep
RFGRPSSRVLWRSKTIIGRTLRNASSSSCRFLKVYWESNAREGRSPIQWTKTSRFTADKDVQLSYFNWLENLIENQLVFNRMSAAMVICKTSSTVVVHTGEAPI

SEQ ID NO: 186078 - protein, 75 aa, Triticum aestivum
  unsure (1)..(75): unsure at all Xaa locations
  Clone ID: PAT_TA_80496.pep
EFERSRPYXLKGXAGXCGRPVXQARPPTKQRVXRLRHGXXPFSPLPRYGNXXLGLXTVGPEPNQNPNRKGRRSQP

SEQ ID NO: 186079 - protein, 152 aa, Triticum aestivum
  unsure (1)..(152): unsure at all Xaa locations
  Clone ID: PAT_TA_80497.pep
MAPKADKKPVAENKVEKAAEKTPAGKKPKAEKRLPAGKTASKEAGGEGKTRGRKKGSKAKKGVETYKIYIFKVLKQVHPDIGISSKAMXIMNSFINDIFEKLAXESAXKLARYXKKPTITSREIQTLRSASFPEAQSNPSGGNQGVTKSLSS

SEQ ID NO: 186080 - protein, 130 aa, Triticum aestivum
  unsure (1)..(130): unsure at all Xaa locations
  Clone ID: PAT_TA_80498.pep
MSCCGGKCGCGAGCQCGNGCGGCKMFPDVEATAGAAAMVMPTASHKGSSGGFETAGEEPGAATAPXCKVRHRXRXASLLASCXLKPGRPKEGRAGPSNRNEGKEGTAKKSQSVNPKRYSFTPPNKQCPPP

SEQ ID NO: 186081 - protein, 141 aa, Triticum aestivum
  unsure (1)..(141): unsure at all Xaa locations
  Clone ID: PAT_TA_80499.pep
MAPKAAEKKPVATAEKTTAGKKPKAEKRAPASKEAGGEGKTRGRKKGSKAKKGVETYKIYIFKVLKQVHPDIGISSKAMSIMNSFINDIFEKLAGESAKLARYNKKPTITXREIQTSVRLVLPXSSQARPLLXGTKGVXKV

SEQ ID NO: 186082 - protein, 106 aa, Triticum aestivum
  unsure (1)..(106): unsure at all Xaa locations
  Clone ID: PAT_TA_80500.pep
QQLPERMRRRXHPLPVRHRRRRQRLRHARLPPDLQARPGLMAGAGHLLATWRSSASRLQEGQAXXKNDHLHILXKTXPLKPWXXTXWGGXTLRXTRXKDXPTTKKV

SEQ ID NO: 186083 - protein, 122 aa, Triticum aestivum
  unsure (1)..(122): unsure at all Xaa locations
  Clone ID: PAT_TA_80501.pep
VDLDFEHNVRPAPVITEEVTASLEEMIKKRIAEGHFDDVEKPSTLPYKVPKQQKEMDENKSKKGLAEQYXDEFKEKTGHCTCHTCYFRXTERMRQNXFILRRICLKLXDALPHFHFGPKPVN

SEQ ID NO: 186084 - protein, 135 aa, Triticum aestivum
  unsure (1)..(135): unsure at all Xaa locations
  Clone ID: PAT_TA_80502.pep
VAPRARSSTIVASLGTPAPSNSSSFRPKLIRNTPVQAAPVAPALMDAXVERLKTGFEKFKTEVYDKKPDFFXPSRAAKAPKYMGVRRCADSXRVFPSVXLVALEXPGEGFNIRNNQNCPRPNAKKVRLGVGGQSK

SEQ ID NO: 186085 - protein, 144 aa, Triticum aestivum
  unsure (1)..(144): unsure at all Xaa locations
  Clone ID: PAT_TA_80503.pep
MAVRKGGDRKKAVTRSVKAGLQFPVGRIGRYLKKGRYAQRVGSGAPVYLAAVLEYLAAEVLGACPATRARDKQRKTRIIPXRQLLLAFRKRTKEAXERLLPRGYQFAQXGGYSPXIKLFCXXPQXXPPPXGXKXKAXXPPXKKN

SEQ ID NO: 186086 - protein, 144 aa, Triticum aestivum
  unsure (1)..(144): unsure at all Xaa locations
  Clone ID: PAT_TA_80504.pep
ATTGYKWGGTANHLCDFAXEDSATPAWAGLQTVSSAELQPVCWWSXQTNNDKCXNRXQALFVMGNQRXPIIAWEXTKKNWLGNGYFFATXRTNHXSXFCWETLILWLGTFSFFFFXTKILPGYQKKKKKKNXXGGPVPXSPKIG

SEQ ID NO: 186087 - protein, 102 aa, Triticum aestivum
  unsure (1)..(102): unsure at all Xaa locations
  Clone ID: PAT_TA_80505.pep
MARTKQTARKSTGXKAPRXQLATNAARKSAPATGGVKKPHRFRPGTVALREIRKYQKSXTKLLIRKAPLPSASSRGNSPKNFKEPNLRLPSPSAVRPCGPPG

SEQ ID NO: 186088 - protein, 175 aa, Triticum aestivum
  unsure (1)..(175): unsure at all Xaa locations
  Clone ID: PAT_TA_80506.pep
MAPTVMASSATSVAPFQGLKSTAGLPVSRRSNGASLGSVSNGGRIRCMQVWPIEGIKKFETLSYLPPLNTEALLKQVDYXLIRSKWVPCLEFXKVXGFIFREHNASPGYYDGRYWTMWKLPMFGCNRHTGLSTLEGSQEYPERVTSATSGFTTCAKGAAFNLQNPGRRSRERAKA

SEQ ID NO: 186089 - protein, 67 aa, Triticum aestivum
  unsure (1)..(67): unsure at all Xaa locations
  Clone ID: PAT_TA_80507.pep
RHTXKNHLGNEWKKPFAGSSHAKGIVLEXXXXIEXKQPNSAIRKFARVQLVXKXXKIAAFLPNEGVP

SEQ ID NO: 186090 - protein, 121 aa, Triticum aestivum
  unsure (1)..(121): unsure at all Xaa locations
  Clone ID: PAT_TA_80508.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASXPGYYDGRYWXTMWKAA

SEQ ID NO: 186091 - protein, 97 aa, Triticum aestivum
  unsure (1)..(97): unsure at all Xaa locations
  Clone ID: PAT_TA_80509.pep
AARRGSSATMSGRGKGGNGLGKGGAKRHXKVLRDNIQGIXKPAXRXLRSXXGGVKXATXGLNYQEXXRAVXKDFSSRKIRSPPKTATPRQRPSPNDF

SEQ ID NO: 186092 - protein, 139 aa, Triticum aestivum
  unsure (1)..(139): unsure at all Xaa locations
  Clone ID: PAT_TA_80510.pep
MAPAVMASSATTVAPFQGLKSTAGLPVSRRSSGSLGRVSNGGRIRCMQVWPIEGIKKFETLSYLPPLSTEXLLKQVNYLIRSKWVACLXFNKXXFVFRWQKNSPRVTKNGXILGQCWKLPNXSGWQNNRLVKRWGRKVP

SEQ ID NO: 186093 - protein, 103 aa, Triticum aestivum
  unsure (1)..(103): unsure at all Xaa locations
  Clone ID: PAT_TA_80511.pep
MAAAFSSXVGAPASTPTNFLGKKLKKQVTSVVNYHGKXSSXXNRFTXVMGXENIDEKRNTXQWXGLPNEYPEQARFTNGHPWTFFQRPPKGANGNPRPFLQAP

SEQ ID NO: 186094 - protein, 75 aa, Triticum aestivum
  unsure (1)..(75): unsure at all Xaa locations
  Clone ID: PAT_TA_80512.pep
MSCNCGSGCSCGSDCKCGKMYPDLTEQGSAAAQVAAVVVLGVAPENKAGQFEVAAGQSGEGCXCGDNCKCNPCNC

SEQ ID NO: 186095 - protein, 101 aa, Triticum aestivum
  unsure (1)..(101): unsure at all Xaa locations
  Clone ID: PAT_TA_80513.pep
GREATALSCGQVDSKLAPCVSYVTGKAPSINKECCSGVQGLNGLARXSPDRKIACXCLKSLATSINSINMDXVSGVXPGKXXVSVPFPISMSTXATQLVNI

SEQ ID NO: 186096 - protein, 59 aa, Triticum aestivum
  unsure (1)..(59): unsure at all Xaa locations
  Clone ID: PAT_TA_80514.pep
FFXFFXFWFFFFFFFVPLCNLIILTKRNSTRCVNLSKIQHYRMSCSCFRLGSNSAPLPS

SEQ ID NO: 186097 - protein, 66 aa, Triticum aestivum
  unsure (1)..(66): unsure at all Xaa locations
  Clone ID: PAT_TA_80515.pep
AARARPFXTXAVPXXMLFPAACSMXQVWLHXCAQMLLDRAMAGTSXXGXCRNGGXQXAAHYXTPKP

SEQ ID NO: 186098 - protein, 104 aa, Triticum aestivum
  unsure (1)..(104): unsure at all Xaa locations
  Clone ID: PAT_TA_80516.pep
APLPTPQQFRTDXLALTLPKALTARPLRRHXVQXQRRHRVQGLRARTXXPPAAXPSRXAPPPPSSPSWLSSXHNXXXKHPXAKGPXRXSTXAXGEKLXQHVXMK

SEQ ID NO: 186099 - protein, 90 aa, Triticum aestivum
  Clone ID: PAT_TA_80517.pep
MKNTKLVAILLLHAILVMGILAHVNANYFPKCCDKCRSFSGVDICDDAHPQCPKGCSTCRAVQTGRVKTFRCADMRSTINGTCGPRCKKN

SEQ ID NO: 186100 - protein, 144 aa, Triticum aestivum
  unsure (1)..(144): unsure at all Xaa locations
  Clone ID: PAT_TA_80518.pep
MAPAVMASSATTVAPFQGLKSTAGLPVSRRSSGSLGSVSNGGRIRCMQVWPIEGIKKFEXTLSYLPPLSTEALLKXVDYLIRSKWVPCLXFXKVGFVFREXNSSPGYYDGRYWXTMWKLPNVXGCXDPXKVLKQVEGRSKKEXP

SEQ ID NO: 186101 - protein, 103 aa, Triticum aestivum
  unsure (1)..(103): unsure at all Xaa locations
  Clone ID: PAT_TA_80519.pep
MARTKQTARKSTGGKAPRKQLATKAARKSAPATGGVKKPHRFRPGTVALREIRKYQKSTELLIRKLPFQXGLVREXAQDFKXTELRFQVLPPVSALQGGPPRA

SEQ ID NO: 186102 - protein, 149 aa, Triticum aestivum
  unsure (1)..(149): unsure at all Xaa locations
  Clone ID: PAT_TA_80520.pep
IHPALAGRHHDRSRHGDGAAAAPPPRPALLPEPRLCRPVAPAAPTRRRRRPPRADHRQLLVAFGAGRGRADVLVHGADQDEAARPRRARRSAIXTLGVRVTCNXRXXLYARRRAGAGARRAAFEPGCANGTRLKIRRGPWXGXGGLANL

SEQ ID NO: 186103 - protein, 133 aa, Triticum aestivum
  unsure (1)..(133): unsure at all Xaa locations
  Clone ID: PAT_TA_80521.pep
AATHPHPRSHLRRRTPPPPRATPTTHRRSPDTPHAARASPRSALLEPPPPNRHAPPCPSHPLPXPRTTGSPAPLLTFFCGYPTWDPSGLPWPLPLRHPLTSAGPSTTPSEKLSXDPPLAPSPCLRQIGLINPA

SEQ ID NO: 186104 - protein, 143 aa, Triticum aestivum
  unsure (1)..(143): unsure at all Xaa locations
  Clone ID: PAT_TA_80522.pep
MASPSPLVDFPQHLLEEIFLRLPAAEDLARASATCVTFRRLVTDRHFLRRFRRLXPPPFLAFFDSHRLHPALPPQPSAPAARGLALGAEXSFSFVPXNPXAGRGRAFGAVXGNPGTXGFFFRQNPLGTSLPLKTGGNPGPQLT

SEQ ID NO: 186105 - protein, 136 aa, Triticum aestivum
  unsure (1)..(136): unsure at all Xaa locations
  Clone ID: PAT_TA_80523.pep
KLPQTKIEGXFCLQPPXLVEARKRXVXXLDYHFFGYNEWLARLIFFPXFLRPNLPSATLLPCXALQLLQGVLLIXLLLGGMPGHXRRSPSSATLACLSGLAFPPXFDMADGAGGGAGGRGRETLAGAATTGGGRKV

SEQ ID NO: 186106 - protein, 137 aa, Triticum aestivum
  unsure (1)..(137): unsure at all Xaa locations
  Clone ID: PAT_TA_80524.pep
RPPGRRPSARAASPCARRRASPRWRRPASPWYGSDRVLYLGPLSGDPPSYLTGEFPGDYGWDTAGLSADPEXTFAKNREXLEVIHCRWAMLGALGCSSRSCSPANGVKFGEGVLFKGRLPNFQPRGASXXXGNPTLV

SEQ ID NO: 186107 - protein, 71 aa, Triticum aestivum
  unsure (1)..(71): unsure at all Xaa locations
  Clone ID: PAT_TA_80525.pep
GERERTSLEFFFSFTDIRRRQLNSALINKQAVLLVVCIYERIMHALTHVFLSEKKKKKKKKXKKKKKKXXK

SEQ ID NO: 186108 - protein, 85 aa, Triticum aestivum
  unsure (1)..(85): unsure at all Xaa locations
  Clone ID: PAT_TA_80526.pep
XQLVSSFFFFLPISVSRKKEXQXESKRNETLESXLFGTKVIQGIWSGRQATXXVATRVXXXLPKGGRPPXXSTDLLLPPIYTYVP

SEQ ID NO: 186109 - protein, 78 aa, Triticum aestivum
  Clone ID: PAT_TA_80527.pep
MSCCGGNCGCGTACKCGNGCGGCNMYPEAEAAGATLLVSATATHKASSGGMEMAAENGGCGCTQCKCGTSCGCSCCNC

SEQ ID NO: 186110 - protein, 179 aa, Triticum aestivum
  unsure (1)..(179): unsure at all Xaa locations
  Clone ID: PAT_TA_80528.pep
MAPTVMASSATSVAPFQGLKSTAGLPVSRRSSSAGLGSVSNGGRIRCMQVWPIEGIKKFETLSYLPPLSTEALLKQVDYXIRSKWVPCLEXFNKVGFVFREHNNSPGYXEGRYWTMWXLPISGATTPKKCXNKXEEXKKGXPXAYFXVNRXPKTCAKWNWVSFIPLRQPGLPRIWEGLK

SEQ ID NO: 186111 - protein, 108 aa, Triticum aestivum
  unsure (1)..(108): unsure at all Xaa locations
  Clone ID: PAT_TA_80529.pep
MAPTVMASSATSVAPFQGLKSTAGLPVSRRSNGASLGSVSNGGRIRCMQVWPIEGIKKFETLSYLPPLNTEALLKQVDYLIRSKWVPCLQFNXVGVXLXRKXKAXPGY

SEQ ID NO: 186112 - protein, 145 aa, Triticum aestivum
  unsure (1)..(145): unsure at all Xaa locations
  Clone ID: PAT_TA_80530.pep
MAPAVMASSATTVAPFQGLKSTAGLPVSRRSGSAGLSSVSNGGRIRCMQVWPIEGIKKFETLSYLPPLSTEALLKQVDYLIRSKWVPCLXFNKVGFVFRXEHNNSPRATKNSILDKCGKLPNVRGATERKRKAQTKGWKAKKRYP

SEQ ID NO: 186113 - protein, 133 aa, Triticum aestivum
  unsure (1)..(133): unsure at all Xaa locations
  Clone ID: PAT_TA_80531.pep
MXNPRVFFDMTVGGAPAGRIVMELYKDAVPRTVDNFRXLCIGXKGVGKXSGKPLXYXGXAFHRXIXPDFMCQXGDXTXGNGTXGGXSIXXRXXPPTRXFXXXHXQXPGIFSNGQXPXPXTNXSQXFATPPWIA

SEQ ID NO: 186114 - protein, 153 aa, Triticum aestivum
  unsure (1)..(153): unsure at all Xaa locations
  Clone ID: PAT_TA_80532.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDNNLCAIQAXKRVNIMPKDIQLRPHPVAKRPKLLLQSKMRPGKIPVN

SEQ ID NO: 186115 - protein, 167 aa, Triticum aestivum
  unsure (1)..(167): unsure at all Xaa locations
  Clone ID: PAT_TA_80533.pep
MAGRKGGDRKKAVTRSVKAGLQFPVGRIGRYLKKGRYAQXRVGSGAPVYLAAVLEYLAAKVRPDXSSPRASLLLCSSCVRQINXLGSCLKSQVLGARPQRRQRTKRKTRIXPRQLXLAVRXKNKKLGRVLXGVNNRQXGXVPKINSXVXPKXFPPPPPKKGAXXPKK

SEQ ID NO: 186116 - protein, 122 aa, Triticum aestivum
  unsure (1)..(122): unsure at all Xaa locations
  Clone ID: PAT_TA_80534.pep
MAAKGDGPAIGIDLGTTYSCVGVWQXHDRVEIIANDQGNRTTPSYVAFXDSEXRLIGDAAKNQVAMNPINNVFDAKRLNGRRFNDSTVQXSDIKLWALKXVXXLGEKPMNNVQXKGEGKQFA

SEQ ID NO: 186117 - protein, 123 aa, Triticum aestivum
  unsure (1)..(123): unsure at all Xaa locations
  Clone ID: PAT_TA_80535.pep
MAPTVMASSATSVAPFQGLKSTAGLPVSRRSNGASLGSVSNGGRIRCMQVWPIEGIKKFETLSYLPPLNTEALLKQVDYLIRSKWVPCLEFNKVGFTSVKHNASPGYXXAGYXTMWETAXFSG

SEQ ID NO: 186118 - protein, 83 aa, Triticum aestivum
  unsure (1)..(83): unsure at all Xaa locations
  Clone ID: PAT_TA_80536.pep
ERERXRELXRXSGGNLLXRGXLXEXNKRXGXXFTPRGRXRXXVYSNRWLRWRKRQSKXSRXRAXAARFNERDXXTXSCDXGAP

SEQ ID NO: 186119 - protein, 101 aa, Triticum aestivum
  Clone ID: PAT_TA_80537.pep
LEFSKVGFVFREHNSSSGYYDGRYWTMWKLPMFGCTDATQVLNEVEEVKKEYPDAYVRVIGFDNLRQVQCVSFIAFRPTGCEESGKALNYLKQWAKYECPL

SEQ ID NO: 186120 - protein, 153 aa, Triticum aestivum
  unsure (1)..(153): unsure at all Xaa locations
  Clone ID: PAT_TA_80538.pep
MAPTVMASSATSVAPFQGLKSTAGLPVSRRSNGASLGSVSNGGRIRCMQVWPIEGIKKFETLSYLPPLXTEALLKQVDYLIRSKWVPXCLXFNKVGFIXFREAQXQSPGYYXWXGXTGTMWKAAYVWGCTRRPGYQPKGGGQGVPARPAPIDS

SEQ ID NO: 186121 - protein, 79 aa, Triticum aestivum
  unsure (1)..(79): unsure at all Xaa locations
  Clone ID: PAT_TA_80539.pep
MAPAVMASSATTVAPFQGLKSTAGLPVSRRSXGSLXSVSNXXRIXRCXQVWPIEGIXKFETLSXXLPPLXTXPSLKPLP

SEQ ID NO: 186122 - protein, 160 aa, Triticum aestivum
  unsure (1)..(160): unsure at all Xaa locations
  Clone ID: PAT_TA_80540.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFXVKHNASPGYYDGRYWTMWKXLPXFGXTDAXTXVINXVGGKVKKGVPWTPMFRNHRSTASRC

SEQ ID NO: 186123 - protein, 92 aa, Triticum aestivum; identical to SEQ ID NO: 160279
  Clone ID: PAT_TA_80541.pep

SEQ ID NO: 186124 - protein, 148 aa, Triticum aestivum
  unsure (1)..(148): unsure at all Xaa locations
  Clone ID: PAT_TA_80542.pep
MPAGHGLRSRTRDLFARPFRKKGYIPLTTYLRTYKVGEHVDVKVNGAVHKGMPHKFYHGRTGRVCNVTKRAIGVEINKQVGNRIIKKRXHVRVEHVQPSKVNEEFLQRKLNNDKPERRRAKARGEVXXTKXGKPSKGPRRGVQLRGTT

SEQ ID NO: 186125 - protein, 133 aa, Triticum aestivum
  unsure (1)..(133): unsure at all Xaa locations
  Clone ID: PAT_TA_80543.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVXGFIFREHNASPGYYDGPVLGQCGKLPMFGMQPNAQQGD

SEQ ID NO: 186126 - protein, 95 aa, Triticum aestivum
  Clone ID: PAT_TA_80544.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQAD

SEQ ID NO: 186127 - protein, 156 aa, Triticum aestivum
  unsure (1)..(156): unsure at all Xaa locations
  Clone ID: PAT_TA_80545.pep
MAPTVMASSATSVAPFQGLKSTAGLPVSRRSNGASLGSVSNGGRIRCMQVWPIEGIKKFETLSYLPPLXSTEALLKQVDYLIRSKWVPCLEFSKVGFIFRXEHNASPGYYXGRYWTMWKXLPMFGCXDATQVXNEVXEVKXGXPXRVFRNIGFQKR

SEQ ID NO: 186128 - protein, 103 aa, Triticum aestivum
  unsure (1)..(103): unsure at all Xaa locations
  Clone ID: PAT_TA_80546.pep
MDGSKAKKVAAKKFGGPRKKSVTRSIKAGLQFPVGRIGRYLKKGXRYAQRVGSGAPVYLAAVLEYLAXEVLELAGNAAKDNXKNRVRARXXLLAIRXXRKLGC

SEQ ID NO: 186129 - protein, 73 aa, Triticum aestivum
  unsure (1)..(73): unsure at all Xaa locations
  Clone ID: PAT_TA_80547.pep
MASTAAPPAAIVARRAASASVAAAPLRRAXGCQPXRSLAFAAGADPRLAVHXXSRCRAXSAXRGXRXXXTMXK

SEQ ID NO: 186130 - protein, 136 aa, Triticum aestivum
  unsure (1)..(136): unsure at all Xaa locations
  Clone ID: PAT_TA_80548.pep
FNVPMEFLPVPTHGGPDCSKWPRCVADITSQCPSNLKVPGGCNNACTRNRSNSCKPTTYLRFFKQLCPDAYSYPKDYSSSTFTCPTGTNYQXVFCPPINPSSLPPSPSASIPTRKTSIGSPSDIGISFRAGLTVMK

SEQ ID NO: 186131 - protein, 145 aa, Triticum aestivum
  unsure (1)..(145): unsure at all Xaa locations
  Clone ID: PAT_TA_80549.pep
MAAAGDAGEKKMITLKSSDGEEFEVEEAVAMESQTIRHMIEDDCADNGIPLPNVNSKILSKVIXYCNKHVQGQPRRWGCPPEPEAGASGXRPRRPPPRDLKNWGTPSFVKGPTKLLRSIPGLALPKIGGGPTLPTGLLDIDSKGQ

SEQ ID NO: 186132 - protein, 89 aa, Triticum aestivum
  unsure (1)..(89): unsure at all Xaa locations
  Clone ID: PAT_TA_80550.pep
VSTINDADQGSADVAYRTPPAPYEKSKSLGSGGSMGARLKLKGIDGXRAPPSVQPKKSPRRTSPPGNSQLNSKGDLFGPWQADKGKGNF

SEQ ID NO: 186133 - protein, 156 aa, Triticum aestivum
  unsure (1)..(156): unsure at all Xaa locations
  Clone ID: PAT_TA_80551.pep
ATRPPLSPHGRPTTTSSAMRRLLRPPPAICHHRTERPSEPRPASGASMSAPLQLRGSASRAIPDGPGAAAMLVNAPAGGALLKEAERCGDACSPALPRRASRPPPLGRGLRANRQASRRAPGQPPFCKXPPPTGLXGGRRGEKEPSAGLLAPLLDL

SEQ ID NO: 186134 - protein, 110 aa, Triticum aestivum
  unsure (1)..(110): unsure at all Xaa locations
  Clone ID: PAT_TA_80552.pep
TRSKALALAAARADAVAPSXLAAAWGTRALSTLPRDXAAASPXSXPRQPAAVSPLGLSKIXGYEQASRLGGTXLXPRWFSXXXSNGXSDQXTSXTIXGXGQSDAMKXXXG

SEQ ID NO: 186135 - protein, 149 aa, Triticum aestivum
  unsure (1)..(149): unsure at all Xaa locations
  Clone ID: PAT_TA_80553.pep
MARTKQTARKSTGGKAPRKQLATKAARKSAPATGGVKKPHRFRPGTVALREIRKYQXKSTELLIRKLPFQRLVREIAQDFKTDLRFQSSAVSALQXEAAEAYLVGLFEDTNLFAIQRQSASTIHAQRTISSPAGIRRGKRASCFPSGES

SEQ ID NO: 186136 - protein, 107 aa, Triticum aestivum
  unsure (1)..(107): unsure at all Xaa locations
  Clone ID: PAT_TA_80554.pep
MSFHLHKFPLMSKSRKISRMLAEQDEQRPPGQPRRRRRGSSGGNAEEHAAPAAAAETEIEEAEEEDGDEEQQQVSMEDGKSYRITFPDFPGGPGTFEXXAKFCYGVR

SEQ ID NO: 186137 - protein, 84 aa, Triticum aestivum
  unsure (1)..(84): unsure at all Xaa locations
  Clone ID: PAT_TA_80555.pep
HASAKGVAPKARVAAYKVCWKGAGCLDSDILAGFDRAVADGVDVISVSIGGGNGAVSPFYXXXIAIGSXXAVXXGVFVXXSXXX

SEQ ID NO: 186138 - protein, 89 aa, Triticum aestivum
  Clone ID: PAT_TA_80556.pep
HPTSTTQVRQMPSRQASSRSPLYSTNFVRLCLGNGSITRDFKAQKRRSHFYQGLLGVLSRICTSRREQAGVQDGSRWLRVTLHMNCATS

SEQ ID NO: 186139 - protein, 63 aa, Triticum aestivum
  unsure (1)..(63): unsure at all Xaa locations
  Clone ID: PAT_TA_80557.pep
TRPQHLXGLLNATFGNATEMIIAIYALKNGMIRVVQQSLLGSILSNMLLVVGCAFFAXXIIHX

SEQ ID NO: 186140 - protein, 100 aa, Triticum aestivum
  Clone ID: PAT_TA_80558.pep
GSRFSGAAGAWFREGFGGGASALSTRGGHEIPGRQLVGVAVAPPCPAAAPPRCRRSRAPRPPSAAAHRGSRRGWRRRRCGWEERRRAGGREAAAGERTRG

SEQ ID NO: 186141 - protein, 185 aa, Triticum aestivum
  Clone ID: PAT_TA_80559.pep
PRVFPQVHKLLGADPEKVNVSINLVALKILKLLPVDYFESQLSSIIHRICNFLKNRLESVRDEARSALAASLKELGIGYLQFVVKILRAILKRGYELHVLGYTLHFLLSKTVTAEMNGSLDYCLQDLLSVVESDILGDIAEQKEVEKIASKMKETKKRMSFETLKLIAQSITFRTHSSKLILPIS

SEQ ID NO: 186142 - protein, 105 aa, Triticum aestivum
  Clone ID: PAT_TA_80560.pep
PRVRALSVECCDHHCHPWHHACPRFHTAPCMRAYPEFQNACLLTVLCCHSIVCHFIFEKRKRPSASECTYPCILLTKFVFSKRSDFVFRSERTGSNVHASLGTEK

SEQ ID NO: 186143 - protein, 59 aa, Triticum aestivum
  Clone ID: PAT_TA_80561.pep
TRPVHSQTCRVWPWLPAHQQDVVVLVVEDVVDLQLYPLCILSENQQYLQKLDFPSRRSH

SEQ ID NO: 186144 - protein, 84 aa, Triticum aestivum
  Clone ID: PAT_TA_80562.pep
GPFAPEHGENLVSSSQNHFIIFTYVRSLVLLFTSCWPERVAKLQPLGQYHPCRSRQRRGLFLPACRACVWCVSTLTCSIFFLQS

SEQ ID NO: 186145 - protein, 182 aa, Triticum aestivum
  unsure (1)..(182): unsure at all Xaa locations
  Clone ID: PAT_TA_80563.pep
DSCAAARPSSPSRTTQPPVRPSPPPARYSPPPVPTPAAVQLPLRALCPFALCRHRDTRKPPSGPSAPATDGASVPKLQPNINISSTPPRHEEEQTGELTYQANSAPMETVHTKEAMGTTCPEDNGQGKDGSTTDEQYDPRIPPSPPSDLKSLKEVHGRTKQVPYLLIPEQHPQSSQXVLPSG

SEQ ID NO: 186146 - protein, 47 aa, Triticum aestivum
  Clone ID: PAT_TA_80564.pep
PRVRSEVKGIISYLLEKREEDEYRKISRRLMFMASQGFNTQVPSFDP

SEQ ID NO: 186147 - protein, 73 aa, Triticum aestivum
  Clone ID: PAT_TA_80565.pep
FSACQRGPRQDNKYPMTKLSGSRYESGANSPFMPHVLYGAKKCFLPLYFLYKKIPVVRLLAFVNTCLLLNPDI

SEQ ID NO: 186148 - protein, 51 aa, Triticum aestivum
  Clone ID: PAT_TA_80566.pep
ECEVAQATSYRSQIYNYLNFMVWAKNNNHILHLTTEKYTFNHSLNNFLSNS

SEQ ID NO: 186149 - protein, 184 aa, Triticum aestivum
  Clone ID: PAT_TA_80567.pep
TRPHSLLRVTTDDILKVTKNFSKEHIIGDGGFGTVYKAALPEGRRVAIKRLHDGHQFQGDREFLAEMETIGKVKHPNLVPLLGYCVCGDERFLIYEYMENGSLETWLRNRADAVEALGWPDRLKICLGSAHGLAFLHEGFVPHIIHRDMKSSNILLDVNFEPRVSDFGLARIISACETHVSTDI

SEQ ID NO: 186150 - protein, 53 aa, Triticum aestivum
  Clone ID: PAT_TA_80568.pep
NFSNDVTCYHKLKYQHKGLHKKAIILLEEKNKRAIFNQKMQIHDNASKLQSTF

SEQ ID NO: 186151 - protein, 195 aa, Triticum aestivum
  Clone ID: PAT_TA_80569.pep
TRPGRGSVSVCESYLPMGKLTRKVLRANRMENKVKLFHKRSDELEVGVELDSPADVLVSEILDSELLGEGLIPTLQQAHDSLLVKNPKTVPYRATTYGQLVESPFLWKMHDLHSNEANAADGVWLTPDGMENIVSVKLQQHAMQCDPLEDEIRLLSEPFKVFEFDFSERPESQRENKITIKTTGDGCVHAIISWW

SEQ ID NO: 186152 - protein, 184 aa, Triticum aestivum
  unsure (1)..(184): unsure at all Xaa locations
  Clone ID: PAT_TA_80570.pep
XLXXVETPLEITHYRPIALVHSLIKLLTEVLASRLQHLISTRSFHAIRRYQRXCATVKNFALASKLVRCAQKRKMPLVMLKMDFQEAFDSFSWSCILQLLRQRFWSQRHLGDLQNWTNSGNGKRVLGNKNSVSHQYNPRLGRLSKPFPEQVVFFLRSFSANCSVWHLNGALFSAQLRCQTEQVV

SEQ ID NO: 186153 - protein, 56 aa, Triticum aestivum
  Clone ID: PAT_TA_80571.pep
HASGKSNFVRATWSKQERKSLHLNKRKQVIVELSAFQWIALKPRQKMKGYKLYAGK

SEQ ID NO: 186154 - protein, 193 aa, Triticum aestivum
  unsure (1)..(193): unsure at all Xaa locations
  Clone ID: PAT_TA_80572.pep
PRVRXGSGSGSQAMPMARRSSGRGGGGPGVEVTMVMELAAAEDNVIIINRPDQAGLGCNLYINISSSTFASPTPKPCPVADGLRLWLLVQLPSTALPHLGSLSPGQPTRVSFRPQRNNLVANIIRSPFASRPEQTNNCKGFNLMCCTTRYSSTCVFPRILFLPYICAFXXSLLLFLLCLAFCHLMHGVLILLX

SEQ ID NO: 186155 - protein, 133 aa, Triticum aestivum
  unsure (1)..(133): unsure at all Xaa locations
  Clone ID: PAT_TA_80573.pep
RNGGPKLKKKGIYLRLKKRRRRAKVQKCRSGRGSKSLAASPLQSGLPSHLSSPAAAHPSRPFSSWSLLLFTFPCPNLLLLLLSTSCCCFSSRPCCCSIPNLAALSLSLSLSLSLSLSLSNXXDLXXCNNXXYV

SEQ ID NO: 186156 - protein, 113 aa, Triticum aestivum
  Clone ID: PAT_TA_80574.pep
TLRGASWYLANPRSRACSNIKLGGVPTALYLANPGQSWRPPGTQYNCLTHHRVVILRVLGALVLVGLSGLEVISGYRVLDKCTWSHPSRHTLTGPEEELCAQGCCSCSLPDAW

SEQ ID NO: 186157 - protein, 202 aa, Triticum aestivum
  unsure (1)..(202): unsure at all Xaa locations
  Clone ID: PAT_TA_80575.pep
PRVRRPTKLQCLAKSYTSLPKDMPKDCGHAQPELREVEAAAATAGSGGMSVPCTRFYGDVKSGPEVVVSSGAQLGFSNHSVDRVKFPASGSLPVSIGGPRRYIGSVSAMEVEQSEDYTCIIAHGSNPKTTRIFGXDCILEPCPVLMPDWESKEIDVDKEGTELYWLVKGSPDADAXXDSTRFCSSCKKNLNGNESSIYRYVD

SEQ ID NO: 186158 - protein, 109 aa, Triticum aestivum
  unsure (1)..(109): unsure at all Xaa locations
  Clone ID: PAT_TA_80576.pep
AFYRDEIDSVIKXMPADXAQGPDGFSGVFLKSGWHIVRYDFYQLSTFMMANSXLQSINTGYITRIPKTASPETANDYRPSTLLNCCLKVIMKVLANQLQRLILHITHRN

SEQ ID NO: 186159 - protein, 190 aa, Triticum aestivum
  unsure (1)..(190): unsure at all Xaa locations
  Clone ID: PAT_TA_80577.pep
TRPIGKPPPRVDPTTPRAATPTVPRQCRRRETGRSLPLPRRAGRLPAWSTAQRTARGTARAWRCRATRCASCSRNSARSSTSGTTQTRATSPPRATWPRSAPGSARRAXPRXRPLRRPPPRPAALRPPRHARRRAQVLRRRPRFREKSGSRHRGRRGARVPLTVRWTDGPFRGGFGVEVCCVRDSPVNDL

SEQ ID NO: 186160 - protein, 80 aa, Triticum aestivum
  unsure (1)..(80): unsure at all Xaa locations
  Clone ID: PAT_TA_80578.pep
MPPTALLLVVLAVAALHAPAASAALSQEPPATPCAAAIVSFSPCLAXVAVVAPPALPSPAPTSACCAAFLRAVSAGDGGL

SEQ ID NO: 186161 - protein, 157 aa, Triticum aestivum
  unsure (1)..(157): unsure at all Xaa locations
  Clone ID: PAT_TA_80579.pep
HASDPVSVVSRSGPGRQVCERLTTRQSAFDRLNGQHDHCAADKGLVQTNLNGQGAAQSGQVTVVKRALMASTIVASASQQAAGPERVREVRPGMTGSPIASRADTTVVPARDGLANNVSSALVPSSVLAGPQVVGSAAQRIAPDPEAGGVVGXXXXR

SEQ ID NO: 186162 - protein, 91 aa, Triticum aestivum
  unsure (1)..(91): unsure at all Xaa locations
  Clone ID: PAT_TA_80580.pep
MADGAASLLPTAGYDGEDRISALHDDLLCAIISRLSVTDAARTTALSPRWCHLWRSTPLALDDVHLHESXRDAVVPRILADHPXPFRXXAE

SEQ ID NO: 186163 - protein, 215 aa, Triticum aestivum
  unsure (1)..(215): unsure at all Xaa locations
  Clone ID: PAT_TA_80581.pep
HASADAWADAWAGVYKETVSVPWEKTNLVLVGDGMGKTVITGDLNADTPGVSMFNTATVGVLADGFMARDLTIANTAGPDAHQAVAFRSTGDRTVLDTVELLGHQDTLYVHAMRQFYTRCRVAXXVDFVFGNSAAVLHDSDLVVLPRQLRPXEKGETDALXAQGRTDPAQPTGXICSXXCRVNXXDEYMAFYRQKPGVHHVFLGRXXXXYSXTVX

SEQ ID NO: 186164 - protein, 215 aa, Triticum aestivum
  unsure (1)..(215): unsure at all Xaa locations
  Clone ID: PAT_TA_80582.pep
HASDGMFKHEDVIKSLRCLYEISKNLKDIRFKGGALSLDTSKPTILFDEDGAPCDSYRYKRNDACFIVEELMLLANMSAAEVISNAFPDCALLRRHPEPNPRKLKEFEAFCAKNGFELDSSSSGQLHLSICRLKEELQDDPVMFDILMFYASKQMQSAEYFCTGDLISKKDDWAHYALSIPLYTHFTSPLRXYPDIIVHRTLNAVIXXEQMYLKQ

SEQ ID NO: 186165 - protein, 109 aa, Triticum aestivum
  unsure (1)..(109): unsure at all Xaa locations
  Clone ID: PAT_TA_80583.pep
XXXXXARSALTRCAXXSXVSGSSAATPVLPDNNPPRTRSRSRFNQPRCPRCESAPRRPEQAGMLPRRKRVGEGERRGVASSEGAVVGRDPSGSFWKGSEIRRGGVRTRG

SEQ ID NO: 186166 - protein, 105 aa, Triticum aestivum
  unsure (1)..(105): unsure at all Xaa locations
  Clone ID: PAT_TA_80584.pep
XCXLQQQXXPXLGXPAAWAPVAQNVXPPPQKMTPFFSPMLWFPPFFFPLEKKYFLKERTLIFYHSPPQTKKNPPATVNYLCPFQVTLPAAPPGGSLKRLGGYVVF

SEQ ID NO: 186167 - protein, 194 aa, Triticum aestivum
  unsure (1)..(194): unsure at all Xaa locations
  Clone ID: PAT_TA_80585.pep
TRPVETADVTILRFTDYQRRQEGSPESELVASTLMQNETETGAGPLELIIELGVVGVSLIDHKPRELLYLNLQKVFISYMTGYDSGTTSRFKLIIGQLQLDNQLPLSIMPVVLATESMPDSNHPVFKANIAVSNVTSNGXXVXXHVYIRVTDQTXXXNIHXXIVWALVDFYNNLRFTGTSSSXXVTXXDPEXXI

SEQ ID NO: 186168 - protein, 100 aa, Triticum aestivum
  Clone ID: PAT_TA_80586.pep
PTRGRPATHLSAARHTRIHAAARIRDGQIRGIRASRTSAVPRHTSAALKPWPPRPRTSAPPGARLRPAADMRPMPPCRPREAETDQIPPPPVAAGLCPVA

SEQ ID NO: 186169 - protein, 157 aa, Triticum aestivum
  unsure (1)..(157): unsure at all Xaa locations
  Clone ID: PAT_TA_80587.pep
PKGTVVLLTGPTYQCYKNSXIFSPSFSFFLXXICQHIYPQRLSLHPGGGARRRKQIHPACTITLXLVSGFTFTTLSLAHTFSSLFPPPRNPCTQTTTRIWRCAFIPLVLLCQHIYSQRLPLHPGGGAGQMKQIHPVCNITLPPTVSYPASPLHPLPR

SEQ ID NO: 186170 - protein, 136 aa, Triticum aestivum
  unsure (1)..(136): unsure at all Xaa locations
  Clone ID: PAT_TA_80588.pep
IWMNIFSIVVCSFXXFPENKHHEESKKDEFKLLAPQSIYAPQSHPLLMFTKNPYKSRTAYDCRNLGGGSARRRWGTSGGAGAAAPPSSRVAGRSGGGGTRWGGARXXGGRAGQIGAAEIPRREELGGVGGETLRVR

SEQ ID NO: 186171 - protein, 45 aa, Triticum aestivum
  unsure (1)..(45): unsure at all Xaa locations
  Clone ID: PAT_TA_80589.pep
XYFVVLSXIWGQFCLSGEFTETSNGIKLLLRFCRLLALSRSCVVE

SEQ ID NO: 186172 - protein, 87 aa, Triticum aestivum
  unsure (1)..(87): unsure at all Xaa locations
  Clone ID: PAT_TA_80590.pep
MDTATLLPVALALLAIPVTALLLNRLRFGRXLPPGPRPWPVLGNLFQIEPVRCRCFAEWAXRYGPIMTVWFGSTPMVXXXTXXXXXE

SEQ ID NO: 186173 - protein, 132 aa, Triticum aestivum
  unsure (1)..(132): unsure at all Xaa locations
  Clone ID: PAT_TA_80591.pep
HASGTTWSRDGEARWLGDASARQSEGLGRGIKDSCNSSNRRIEHMHKTSKATKPGRKSWTTRWSILCRQPVATIEHNKHHGSLLVVGDSPAPLSGHLWLLPCSLVLLCLMDGAPMPRTHAPXXXEXXXXKXX

SEQ ID NO: 186174 - protein, 144 aa, Triticum aestivum
  unsure (1)..(144): unsure at all Xaa locations
  Clone ID: PAT_TA_80592.pep
EPTTGRRRRTHGSVRISASDPAEAYVDTDAEALAAAAALYAPPLLAEPCLSGSSAMEVASGMFRKFKTKKISVCTALQGNKWISALRQVNTTELVHESIKLWLLIXXVQIPQAKMSSPGCWTTDGMYMTRSTYXXCSGALTXXL

SEQ ID NO: 186175 - protein, 182 aa, Triticum aestivum
  unsure (1)..(182): unsure at all Xaa locations
  Clone ID: PAT_TA_80593.pep
PRVRDTDEVFAKIRLVPARPQDADANDAIAAAAAQEDKPASFAKTLTQSDANXXXGFSVPRYCAETIFPRLDYSADPPVQTVLAKDVHGVVWKFRHIYRGTPRRHLLTTGWSSFVNQKKLVAGDSIVFMRTENGDLCVGIRRAKKGGIGGPELLPPPSPAAGGNYGGFSMFXRGRRTAATTR

SEQ ID NO: 186176 - protein, 220 aa, Triticum aestivum
  unsure (1)..(220): unsure at all Xaa locations
  Clone ID: PAT_TA_80594.pep
HASAQKAVQISRPSTMDNAQRSSRSSASPNRLSLSPRSMARTKSPISASRASPPLSVQPPTPSRRPSTPPAAKILTLPQRSASPVSRRMSTGSSGSALNGTRGASPVKANHRSSSPKPQGWQSNDPAFSYNAPPNLRTSLPDRSVSRSRGGSPTSFSGXXTGSRGRRQSMSPTPTRRASSSHSIERDRLSTHSKASATSSGDDDLDSMQSISIGSSPAAV

SEQ ID NO: 186177 - protein, 70 aa, Triticum aestivum
  unsure (1)..(70): unsure at all Xaa locations
  Clone ID: PAT_TA_80595.pep
TRPPLPKXIGGDWRGLGHILTYKWFKSSSNLFNPHGSTLNRTSPRASTVAHTPSPGHQTSADVPGFAHGQ

SEQ ID NO: 186178 - protein, 155 aa, Triticum aestivum
  unsure (1)..(155): unsure at all Xaa locations
  Clone ID: PAT_TA_80596.pep
LRLCWRTTPTMTSSCPSPRSSRSTSASPCRSTSASRAPSRSRIPRRSLTVAGSSDRSPPPTGSCPRASGTTLRSPRRAPRRAPITSLPFPRRAARPVPSTSLRFPRRTPRRAPTASLRFPRRTSRLAPTASLRFLRRTXRLAPTSSSSFRRTLSK

SEQ ID NO: 186179 - protein, 144 aa, Triticum aestivum
  Clone ID: PAT_TA_80597.pep
PRVRKCKSKSSVTTIQYRTFSLVARCPVLLSCAQDGNLYFFSIATNSHGYLTLICSLKLASPVQNIRASFCPLLSLEKGEFIVTGSGDSNVYFYDLARPKNSCVNKLQGHGSPVMGVAWNHGENLLASSDSDGTVIVWKRAKTN

SEQ ID NO: 186180 - protein, 105 aa, Triticum aestivum
  unsure (1)..(105): unsure at all Xaa locations
  Clone ID: PAT_TA_80598.pep
MNKRPREDEPSSSQKRQFGAGGGYGEQEGYSEERISAQRVADHYSARSNQTLEERENSPIIHLKKLNNWSHLRQIKSVLVQLYARXGDCVLXLACXXXXDLIKXX

SEQ ID NO: 186181 - protein, 189 aa, Triticum aestivum
  unsure (1)..(189): unsure at all Xaa locations
  Clone ID: PAT_TA_80599.pep
MPFSLRRLLRLLRDIMTLPAADDAAVSEGERRQWEPPFDASRPAPPISYPITDLAALASRSYLSEDSNFHLPFNRASMPLPSPGAPLPPRRRLLVCHDFQGGYRXXAAPXGGANPDAYALWHWHLVDVFVYFSHYLVTLPPPCWTNAAHLHGVKVLGTFITEWDKGAEICXXMFATQDSAQMYAEXLXX

SEQ ID NO: 186182 - protein, 208 aa, Triticum aestivum
  unsure (1)..(208): unsure at all Xaa locations
  Clone ID: PAT_TA_80600.pep
TRPPAPLESFEELVSRYDCDSYLVGNLSKLGFQEPTPIQRQAISILLSGRECFACAPTGSGKTLAFLLPMLMKIKPGSKGCVKAVILCPTRELAAQTTRECKKLAKGRKFGVKLMTKDLSQDGNFKDMHCDILVSTPLRLDHAIRKRDLDLSRVEYLVLDESDKLFELGFVEVIDSIVKACSNPSIIRSLFSATLPETIXXLARTIMH

SEQ ID NO: 186183 - protein, 142 aa, Triticum aestivum
  unsure (1)..(142): unsure at all Xaa locations
  Clone ID: PAT_TA_80601.pep
NXXXXXAIXXPHHHHPGAHLVGVRRNHLDLKGEXGARELAIPRCQAPASRRLLPERASQRGRAGCHATATSRTGSRGGSRTAPGGSKPLEMQPACRREEDGMPLLEPRIDEQSQQHEDTNFVGRRTPTATDRRGLXXSSVFT

SEQ ID NO: 186184 - protein, 194 aa, Triticum aestivum
  Clone ID: PAT_TA_80602.pep
MESMTGQMNSYFSAKSESANHLKRRIAKAKDMYTSGVQCMNELVNTLRQRSITDSEQMKLNISSQAIAVDNFIAVMVSETEQVLTEVLRSTSELKELLAFSAEQQELGLQKSLTSAQAMSKTSIDFFNDISTHASRLMKLMEQSQRGCSSRLAEFEKGFEEVAIREEQAAVDKIAGILAGLTARKRTMVNLSIV

SEQ ID NO: 186185 - protein, 216 aa, Triticum aestivum
  unsure (1)..(216): unsure at all Xaa locations
  Clone ID: PAT_TA_80603.pep
PRVRLREARERQEPEIRPPRQRITDFDELRERKRFEGLVTRGGVPAWVKYARWEEGQGDLARARSVYERALDLDAARRDHAMWLKYAEFEMRSRCVNHARNVWDRAVSLLPRVDQLWHKYIHMEELLGAVASARQLFERWMAWRPDIAAWNSYIKFELRYXXVERARAIYERFVAEHPRPDTFVRYAKFEMKHGGAERARRVYEHASELLVDDXXX

SEQ ID NO: 186186 - protein, 61 aa, Triticum aestivum
  Clone ID: PAT_TA_80604.pep
FFFFGRSQKSDVRYISSAQDIPRELRLFLGEGVECLHRVIKQAHQNNVLANTILVIQHEIS

SEQ ID NO: 186187 - protein, 107 aa, Triticum aestivum
  unsure (1)..(107): unsure at all Xaa locations
  Clone ID: PAT_TA_80605.pep
EAXXXSSPRQLPSPTPMPDGVAPPPLCSSLIFWVFGVRPGLAPGRGCSRSWCRXXVFVCFHSPLPVISHCSGFGLVCTTATFVLACISXVPFVMQILXXXVWFSLXX

SEQ ID NO: 186188 - protein, 45 aa, Triticum aestivum
  Clone ID: PAT_TA_80606.pep
HASGKFIFVCYIDALHRLWFKIQNPLYLVVIIWFSTCYVPMAGCP

SEQ ID NO: 186189 - protein, 217 aa, Triticum aestivum
  Clone ID: PAT_TA_80607.pep
HASGSGPPRHPSPPPPRDLIHPPEVRPGRSGQCCGDPPSAAAAADRGEETKNGENDFEENGSLDPVVYQLVRVEGDGTLVPPTEDEVLQIEQFLDDKVDLPSIDDVGNVEDFFTNDCMLLKEPDFEEGYSELETNGEIHTQQFDADLEVDRLKPSDDSLDIPSKCTVVHDHKPDKLNTEQGDNNIVHQDNASTETPKSTVLNDSCSAEKEKADACSR

SEQ ID NO: 186190 - protein, 175 aa, Triticum aestivum
  unsure (1)..(175): unsure at all Xaa locations
  Clone ID: PAT_TA_80608.pep
MEASRFGFGRDMAAAFKFDPTDADIVASYLLPRAVGLDEPHGREHAVIDDDPMSIPPWDLMEKHNHGTSDQAFFFGPPRNGGRVTRVVPGKGGGTWQGQNGXXXGPSPCXAMAPAXXEVDIXXXXXDLTYKRAGDKXXXGWVMSEYQXTSPPLLSTVLTRIGLIVXAXEXXKRQP

SEQ ID NO: 186191 - protein, 61 aa, Triticum aestivum
  unsure (1)..(61): unsure at all Xaa locations
  Clone ID: PAT_TA_80609.pep
CLICRKDPNYKRMVMACFIXXVYLLEIDRQDQKGEEIGLAPKWWKPFKYKVTQTLVDEXXG

SEQ ID NO: 186192 - protein, 130 aa, Triticum aestivum
  unsure (1)..(130): unsure at all Xaa locations
  Clone ID: PAT_TA_80610.pep
GGIAASQRXXXEGLRRPQXSPSPAPDGAGVTPRSAMTPSHCTAADCREIQHSCRSAPPQRQTPHHRHHQPGRPRPHHHYPRWPWTRTAQIWPPGEAANRVRRLPTTTTRGDVMPSSRKVPHAGTAAGKSR

SEQ ID NO: 186193 - protein, 163 aa, Triticum aestivum
  unsure (1)..(163): unsure at all Xaa locations
  Clone ID: PAT_TA_80611.pep
MHVVPCACIRSNFRTCDHDFCSRCVAVKLGQNIAHVGYSEGEDGDDDLFYCNICMEMVARTLKFSVNSCGHVFCSSCITQYVAAKLDNNVARVECPDPGXXGGVVELERCHDIIPLDLLXXWGFLLCESALGTKXIYCPYRECSAPLLADSEAGVTAVVPATG

SEQ ID NO: 186194 - protein, 124 aa, Triticum aestivum
  Clone ID: PAT_TA_80612.pep
FIRTLTHSGCTSSVRGHQPNARSLARQYFQSSQAQSRQSISPGTVFRYPTKQALQATYIPLSSLFLYSSNGKKKSIRLPDLHLHLATLLQKHTVPARNPAKEKEDGTTSWPRPAPGSGTRQAPR

SEQ ID NO: 186195 - protein, 215 aa, Triticum aestivum
  unsure (1)..(215): unsure at all Xaa locations
  Clone ID: PAT_TA_80613.pep
TRPSELKFQDLPCGVKHFFSTHVVDQCLSSSEHTVPRFSVNVDSSISWDEVLNSCALRLSHDLIQHHVQLLHGRAHNNHDEQKEVFVPMEISAPDESKSCENQESIILAKSSLYVDKRPSYPTKLATCSAQLQPSASDVKDKEEDPEKLDFHESVSRNPSSRTMKGNESLSIIAFGIQILQHPQFSKLCWVTSKXXEGPCTDINGPWXXXPXXSX

SEQ ID NO: 186196 - protein, 134 aa, Triticum aestivum
  unsure (1)..(134): unsure at all Xaa locations
  Clone ID: PAT_TA_80614.pep
HASGNKFGRPSPQRLARNCAARRQDLSDAARSLQVQRGGRAAAAAALVGFFALAVGVGRRDGASGGTSGGGERTGRRDHXXECCSWCDXXMSLHSSPAAAGDAPTGTAEELLERARGLVPDALDAAXXXXXXXX

SEQ ID NO: 186197 - protein, 164 aa, Triticum aestivum
  unsure (1)..(164): unsure at all Xaa locations
  Clone ID: PAT_TA_80615.pep
RQSXTSTPWTTYRTCLACSTRSTALCTHESQNRARQIAQKQSLFRHMAPPPWSCPRPNWPNGRSECASSSVTTSKTSSCRMARSSAAPTRPASHRSSPAPCPTPRPRSPPSRGSALGPGGPTVADAASPAPRLLTASTAAFPRRPPPSPGGGTWPWRAARCSIA

SEQ ID NO: 186198 - protein, 83 aa, Triticum aestivum
  unsure (1)..(83): unsure at all Xaa locations
  Clone ID: PAT_TA_80616.pep
TRPDLSDYDPDTNQFTEKTIMYCDQCEREYHVGCMRNXXDQLTCCPXXCWFCSRGCSXIFQHLQELIGKPIPTPVXXXSCXLD

SEQ ID NO: 186199 - protein, 95 aa, Triticum aestivum
  unsure (1)..(95): unsure at all Xaa locations
  Clone ID: PAT_TA_80617.pep
FFSSKFPYXQNPSEKALKQFFSHDKPLFQRDPFWSPVLEFSRRRGALGGPFFSPLVPPRWGMSSSFRPSGFIVVVRGVFFFFFFPFLGFENHVFF

SEQ ID NO: 186200 - protein, 209 aa, Triticum aestivum
  Clone ID: PAT_TA_80618.pep
HASANDVARKLCSEAIRSLFRNEGKHRGEATVEAVRLISASVKLNDCQLHPDVVEVCLSLKFDEDLGKDESKEEKMKPKKNKRYQNRDVTKPSEKKKIKKELLSKARQEVHADLRAVSFTLDPKEKKMIQRETLAALFETYFRILKHSMNTSNSRYKATSVFPGGSHPLLAPCLKFSHLIDLDFMSELIACLKKLSGYTDHEIPPYTLC

SEQ ID NO: 186201 - protein, 220 aa, Triticum aestivum
  unsure (1)..(220): unsure at all Xaa locations
  Clone ID: PAT_TA_80619.pep
HASAFTDCVKCLITFTSSKFSSDASLNAIAFLRFCAVKLAEEGFVCHDKDTDHQSNNLDSSEGNAIVHKDDHVYFWVPLLAGLARLTTDTRPTIRKGAVEVLFDILKDHGELFSQSFWTNIFGSVIYPLFNGEIRTPNGQSDSTEDDSWNFETKTVAVKCLVDLYVTFFDVMRPELTRVTSVVTSFIRSAYRQSAITGMSVFQRLXXXLASKLSXXEWKX

SEQ ID NO: 186202 - protein, 197 aa, Triticum aestivum
  unsure (1)..(197): unsure at all Xaa locations
  Clone ID: PAT_TA_80620.pep
HASGRSGRSAPRASRPRRRGSTPCCWPTSSWPSRASSASPTPPRPRGTPRSARCGTPSASSASSPRSTRRRTPPPPATARATSAGCPAPTSPRARSSTSPSCTRWRATPTSRRATSSRCSSTRPTWPAQPSSRTSGPTSSSPTCSISXSGSPMSPSSSPAAATPTAGAAAGRCCTTTKWTAAQLSSQCTTTGSTAAP

SEQ ID NO: 186203 - protein, 133 aa, Triticum aestivum
  unsure (1)..(133): unsure at all Xaa locations
  Clone ID: PAT_TA_80621.pep
XXXXXXXXXXXRHQLPSMAYLPLPRXXHCISIGPSSTPSSSPRPRPPHRAPMDLPPLLKGCPLMTDSWCCQPDPRGDPGVLMPCTQPPPRPTTRATRRCSRLRENHPRGQGAERRAGDGATTPGRHHGRDCRL

SEQ ID NO: 186204 - protein, 214 aa, Triticum aestivum
  unsure (1)..(214): unsure at all Xaa locations
  Clone ID: PAT_TA_80622.pep
HASGDLVERPWKGTQVPCDRMDKALFDACTSITLGNGQISRFWHDRWLAGESPRDIAPDIFKLAWRKNLTVSEALTEGRWMRGAQRMSAENQIHQFISLWEKVQTVXLNNNRNVISWNRSSNGSYSNRSAYEAQFIGRIEQPHLATVWRIKVEPKVQFYTWLLLQNRNWTADRLDRRGWPHSPECPXXDXAPETALHLLLTCPYAXXXXCPKLA

SEQ ID NO: 186205 - protein, 165 aa, Triticum aestivum
  unsure (1)..(165): unsure at all Xaa locations
  Clone ID: PAT_TA_80623.pep
CPFLLHFTMSLYSFCCGNFQQLRNSIGHICSIRFLKYHSRISSENVLQNRRHKTRPFSATVLARNAGKGSKQFFSNDRHLHGGSVESSIEVFKQSDLQHLKSLQCYDIQEKVSGGKTDCPATILVFDIETTGFSRRGDRIIEFAARDLMGGKNSTFXXLINPXXX

SEQ ID NO: 186206 - protein, 154 aa, Triticum aestivum
  unsure (1)..(154): unsure at all Xaa locations
  Clone ID: PAT_TA_80624.pep
MPQEARHTSPSSSDPMGSRVSLEQPCVVERAGMPQRRLQEGSGARKRRRRLPSPKTGSKVFTRRCTSNHQPEPCHHRRHTPDGRWPHAPNIRRSHQIWTPGPRSPSXAAGPRRIXPPAPCARRSSQPPRRTGSRGPIFLTPPXGAHRADDRRRA

SEQ ID NO: 186207 - protein, 86 aa, Triticum aestivum
  unsure (1)..(86): unsure at all Xaa locations
  Clone ID: PAT_TA_80625.pep
XXSFTKISASAKKIPTLTFIQALLWLFSFIHITLHALSSQVHVRTCMFLYKAGGSNTFPMRSRGKSVTDCASQTQGFCKLLKLFRA

SEQ ID NO: 186208 - protein, 193 aa, Triticum aestivum
  Clone ID: PAT_TA_80626.pep
PRVRDIRKDLQGLLAEDDLNVIMSSEHRPRCIIEFISQSLQMLDFEEHKRSIMESKLSCFLEGICVCEQIIGIPVPLSYTRLTSRFLVLWHLTLPIILWAECKWIVVPATFVSAASLFCIEEVGVLIEEPFPMLALDAQCQQLHDSMRDMMSVQGLVRKQLAAKTKGRGRGGGRLPQNGWPVSSSRGEQVKVD

SEQ ID NO: 186209 - protein, 215 aa, Triticum aestivum
  Clone ID: PAT_TA_80627.pep
HASDKSRRFDTDIGLPRPNDFHDIPEYFVLEAIPHAVALVRSSDKSSPRQAIEFILQLLKYNDNNGNVYSDVYWLAAMVQAIGEVEFGQQGIGLLSSLLKRIDRLLQFDNFMPGYNGVLTVSCIRALARIAERVSSSICLDRICELIAPFRSMDKPWKVQIEASRVLLDLELHHKGLDAALLLFLKYTDEERSLRGATKLAVHVLRICQANIESN

SEQ ID NO: 186210 - protein, 200 aa, Triticum aestivum
  unsure (1)..(200): unsure at all Xaa locations
  Clone ID: PAT_TA_80628.pep
HASGYLQDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTXXKSVEMHHESLLXXLPGDNVGFNVXNVAVXXLKRGYVAXNSXXXXA

SEQ ID NO: 186211 - protein, 85 aa, Triticum aestivum
  unsure (1)..(85): unsure at all Xaa locations
  Clone ID: PAT_TA_80629.pep
FFFFIELKGLSLQNLNLFTNSFVLLPLNSLPSNHRVHFFTXKCHQKYKKIKYVDDVSRAWLLLCPLLICALTMASLLCVHFFQIQ

SEQ ID NO: 186212 - protein, 135 aa, Triticum aestivum
  unsure (1)..(135): unsure at all Xaa locations
  Clone ID: PAT_TA_80630.pep
MLQSKRAGDALTENLAESSEKNRRICTGGAETLDLLISGYIHSDVNSEEPIDSFSDSSRSVWSELSKEVTSKISRNVVSLALSDGHAVLFACXXIALRSGRYVTSFLTSASLVRAFNDINXXXXYTLKIEVRRNX

SEQ ID NO: 186213 - protein, 173 aa, Triticum aestivum
  unsure (1)..(173): unsure at all Xaa locations
  Clone ID: PAT_TA_80631.pep
PPAAXGSPXXWPXXAPACXXAPATAPPPPAVRSAPLAGSPSSAPPPPDPSPSPAGNTRPRPPNAHSTPRAASERAGLSLPAAPSNSRRNQSAGTDRKGARGCRWELGVGRPLQETAYLSSEAGREGEKAMAMATGARPSVEVGDGRWEDGCCGVQGRGRGGAGERGEERADAW

SEQ ID NO: 186214 - protein, 129 aa, Triticum aestivum
  unsure (1)..(129): unsure at all Xaa locations
  Clone ID: PAT_TA_80632.pep
MPTPGARSLILLPLLVLLLLSAGAANAATEAEALLAWKASLDRPLPDALSTWAKPAGLCSSWKGVCCDAAGRVDSLALRGLGLAGTLDKLDAAALPALAALXXNGNNFIGAIPAGLSRLRXXATLXXXS

SEQ ID NO: 186215 - protein, 179 aa, Triticum aestivum
  unsure (1)..(179): unsure at all Xaa locations
  Clone ID: PAT_TA_80633.pep
ATWWDWGEALLDKFAYMVHKKDHQKNHTSARCTFKRNLHDDRVVEVEMQVSLFLAPPPRVSYFCCSANLTEDDHGEQQGTRRLFVCEPWVIATEGNLALLALCHGYNPAYYGESNNYDYFLYEAAASPAGTPKLTCLPQIQPEMLPAMGTHCFSTGSIAVVRYSXNIPTXATXXXXXXP

SEQ ID NO: 186216 - protein, 190 aa, Triticum aestivum
  unsure (1)..(190): unsure at all Xaa locations
  Clone ID: PAT_TA_80634.pep
MLPYATAAEAEAALGRAMTRAEAAWLCYSASMPDHLLYCHNVAILLLLYTLAPLPLALLELRARAAPDGVAAAVMRPSTYKLQPRAHLSPAAFLRCYLDTGRVLLLTVGTLSLVSYPAVKMVGIRTGLPLPSAGEVAAQMLVYLLVEDYLGYWIHXLLHTRWGYDNIHRVHHEFTAPFGYAAPYAHXPHP

SEQ ID NO: 186217 - protein, 183 aa, Triticum aestivum
  unsure (1)..(183): unsure at all Xaa locations
  Clone ID: PAT_TA_80635.pep
PRVRIIEELRQHLKKKRYLIVVDDVWDQPTWDTIKCAFPEDINGSRVVVTTRVEDVAAAACQNDGEGIYKMQPLSEQNSRMLLLNRVFGSKNDCPPQLKEVMAEILKKCHGLPLAVITIASLLANKEPSRKGWDSIRDSFGTQLATNPTLEEMKSILNLSYMHLPAHLRACXXYFGMYPXXSD

SEQ ID NO: 186218 - protein, 92 aa, Triticum aestivum
  unsure (1)..(92): unsure at all Xaa locations
  Clone ID: PAT_TA_80636.pep
MADKPPVVVVVVVFLPLLGLCSCANVHIVYMGELHPELVRDSHHGMLAAVLGSKQAAXXAILYSYRHGFSGFAAVLTNAXXAQLSDWPXXVR

SEQ ID NO: 186219 - protein, 217 aa, Triticum aestivum
  Clone ID: PAT_TA_80637.pep
PRVRVNRSLILPVEKKGKNVIYACRVHDMVLDTICWLSKEENFVTIVDGNGKYSSSESNVRRLAVQTREEEQGNHLANTRMPKLKSCYASICHKSMMPPLLSFQVLRVLDMKNCIFLENCHLKHLGRLHQLRYLSLENTKIDIGDLKFLQTLDLRNSWIQELPQGTSLLKQLKCLRVDSKRLRNHRIEHFGIEVTNWIGNLITLLSLKISGEISTFV

SEQ ID NO: 186220 - protein, 99 aa, Triticum aestivum
  unsure (1)..(99): unsure at all Xaa locations
  Clone ID: PAT_TA_80638.pep
KKNPPPEKKNRPFVSKKNPLRGGKNGAPFPPGEKGFPRTPKFHXPKKTPRGXRPKKEEAPGGAQTPPRVLKNPGELARRKSPGLTXKTXPRVXKFGGDP

SEQ ID NO: 186221 - protein, 47 aa, Triticum aestivum
  unsure (1)..(47): unsure at all Xaa locations
  Clone ID: PAT_TA_80639.pep
MKXXRICVDXXXVTKFISKIXEREIVMRDAXRFPHFKDGNCSCGDFW

SEQ ID NO: 186222 - protein, 168 aa, Triticum aestivum
  unsure (1)..(168): unsure at all Xaa locations
  Clone ID: PAT_TA_80640.pep
MGKAKGKQRQDEYYHLAKEQGYRSRAAFKLQQPDDRFRFLPAAHAVLDLCAAPGGWMQVAVARAPVGAFVVGVDLVPIRPVRGAHSLTEDITTTKCRSAVRRLMDSKGVAAFDVVLHDGSPNVGGAWAXXXTAQSALVIDAVRLATVFLAPXXTFITXXFXXXXYSAI

SEQ ID NO: 186223 - protein, 103 aa, Triticum aestivum
  unsure (1)..(103): unsure at all Xaa locations
  Clone ID: PAT_TA_80641.pep
LSARILXPFLVNELDPQYLLHDHSKVYEVASPYRLAMEFSSVSVRVTVADSFFALLPAFSARWRIHARPLSRPTXPSXVDRAPWAVCNCNCXXXAAVLDTTTP

SEQ ID NO: 186224 - protein, 106 aa, Triticum aestivum
  Clone ID: PAT_TA_80642.pep
MASSKVCKERFDAAVTYLGAIGIQRETVSPVLTNLLDLYDHNWEFIEADHFRVLTDAIFDEPDPKEEQQRQANKRMNPDSDHCKKKLKIKHHSRKPTSRVNEKLQQ

SEQ ID NO: 186225 - protein, 92 aa, Triticum aestivum
  Clone ID: PAT_TA_80643.pep
PRVRNRSLKHEVNIARYSKKKMKTKIRSIKNKLIIATYEKKQNAMGWFVLTRYMHGLSDHISNVTVLNMSSGKGPIDKIINDPLINIEKKRS

SEQ ID NO: 186226 - protein, 66 aa, Triticum aestivum
  unsure (1)..(66): unsure at all Xaa locations
  Clone ID: PAT_TA_80644.pep
XYIXLNLHKESCSSKIVAYLNLQRLEALELRLKGAFAIPLSPCIRTLNIFTELGVQSPPIVDMMLI

SEQ ID NO: 186227 - protein, 198 aa, Triticum aestivum
  unsure (1)..(198): unsure at all Xaa locations
  Clone ID: PAT_TA_80645.pep
SRSRPTSCRRRNPKLDPATYRPATPAGALGTMAEDDVDWTQIFDRVKGSIFSIRFVPKQDNLEQLQVLADGVKTVKDEELRRNKLRKGHASTGFVYYSRPTGLLIMTSAHGLNHLFDASRPLTLETLGMMDITVLCDHQEEVIQEARLVNAVRKYATARAXGVNSNKDTIVLSVDSINLKNYSDDGVCXXAXXXIDIX

SEQ ID NO: 186228 - protein, 130 aa, Triticum aestivum
  Clone ID: PAT_TA_80646.pep
MIRGQPILELMIADLKLYVQPLEPPLSPREGEIRRSGERPLDPDREGGRQPRAPPPPPPPPPARRGGGTEGSSCRWCARAGGRAFDPRVPLSASVPLALTPPFSAYSYSLPPPRAAAAAGARLLDCFGRV

SEQ ID NO: 186229 - protein, 148 aa, Triticum aestivum
  Clone ID: PAT_TA_80647.pep
PRVRGFSAWVGCACWNWKKAEKAPAAKKPKAEKRLPAGKTASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 186230 - protein, 134 aa, Triticum aestivum
  unsure (1)..(134): unsure at all Xaa locations
  Clone ID: PAT_TA_80648.pep
MAPAMPKQRAVHLPDNEEVARLLLEKHRSMLEKDIPDNLSLTLSNAYRNVCAAKEPIRTLKDLLKIXXVGPWVIRLIKESFPASSPDLSPPKCKEXXKRGXKRPEHSPELVCSNSASMASQELIQLTQLSYSSE

SEQ ID NO: 186231 - protein, 94 aa, Triticum aestivum
  Clone ID: PAT_TA_80649.pep
TRPHTTAPPPPPTPIPGGSGGLPTHCSRISPTPSMFSPDTSHPSTAPLHARHATTLVARRRRRGSGSSGLSANYHCITSRAAAGSGLTLIYLLH

SEQ ID NO: 186232 - protein, 164 aa, Triticum aestivum
  unsure (1)..(164): unsure at all Xaa locations
  Clone ID: PAT_TA_80650.pep
MAASLLHAAASSPLAGPSPAARAAFRPLASSPFLRLARSSPDRRARLDAPLRALSGGARLAAPRSRRFVAALAGEEPMSSELGDDKEKETEKIEIEPXXAXXVWREMLKQFKAEAIRMQALTTXXYDVYSKRAREVLLEASEKLKIQADKAQKDLTIIAXXXGX

SEQ ID NO: 186233 - protein, 158 aa, Triticum aestivum
  unsure (1)..(158): unsure at all Xaa locations
  Clone ID: PAT_TA_80651.pep
ANDGPTXLTVNTKDGPTSCPEMSTGLQQLPQNVESATSQTSNANVPIADKTKEACKEAERELATTFEENGSVNRMEGKDSRERRSKAEPKHQHCHLEKSDSATSQTSYENVPGVDKTKEVCREAERELPTERRTTFQEEKSRVNTMEWKSQRFYQKKK

SEQ ID NO: 186234 - protein, 133 aa, Triticum aestivum
  unsure (1)..(133): unsure at all Xaa locations
  Clone ID: PAT_TA_80652.pep
PRVRXXXDKPHVFMAGDRVHPQSDAIYSYLEKLTTKMIEAGYRPDTEAALYDVEEEEKEHMVKVHSEKLAIAFGLLNTEPGTEIRIIKNLKVCLDCHNATKIISKVTQRLIVVRDASRFHHFRDGVCSCGDYW

SEQ ID NO: 186235 - protein, 82 aa, Triticum aestivum
  Clone ID: PAT_TA_80653.pep
GMPDTYLSSMSFLKRVQFWRYTYFANLCIFFTEGGYIVLVYQNEPLHVIVITKVPAATISNNEALIMAGLWPVALMYLLEIK

SEQ ID NO: 186236 - protein, 74 aa, Triticum aestivum
  Clone ID: PAT_TA_80654.pep
FFVSCHLQVDPRLSTRFFCSRSHPSCKCTIDSQLGLYFFVSCHLQVDPRLAIGVFFVVVVMPCCKSTINSQLGL

SEQ ID NO: 186237 - protein, 64 aa, Triticum aestivum
  Clone ID: PAT_TA_80655.pep
IDMTVRFLYLFAVRSNGALHTYVYCYLIIVGLLYKGLAIILYGPSLRCYLDHLVFYTEPASRRC

SEQ ID NO: 186238 - protein, 68 aa, Triticum aestivum
  Clone ID: PAT_TA_80656.pep
WSWEYPKVFIESDMIPFLKCSWTVPSICFHHVGISEIFAGGSTAVLIEALSLNLDHFVGLLSKSHPCY

SEQ ID NO: 186239 - protein, 44 aa, Triticum aestivum
  unsure (1)..(44): unsure at all Xaa locations
  Clone ID: PAT_TA_80657.pep
NPSLLTIKNPPPKVETTCQHVAVYQSRNNPSPNWAGGTXKNWII

SEQ ID NO: 186240 - protein, 135 aa, Triticum aestivum
  unsure (1)..(135): unsure at all Xaa locations
  Clone ID: PAT_TA_80658.pep
KDKLAKSQLEEWFGSINLNKENGKVIVKPTRAGSSIGVVVAYGANEAAEKAEGIFSEGIDDKVIIEVFLEGGCEFTAIVLDVGTANNSEPIVLLPTEVELQSSISSDIXXXTIFNSRXXYLPTQXXAYHTXXRFP

SEQ ID NO: 186241 - protein, 204 aa, Triticum aestivum
  unsure (1)..(204): unsure at all Xaa locations
  Clone ID: PAT_TA_80659.pep
TRPATDVHASPELVEEEAAPVAEDCTVVSSVDEQQNDVQQCEQSPVALNVVDQEGHFPAETVSSEGPLDVEIHHAGEAAEEAEDHLSTEETEMVPMEAPESGEATEEDEDNQSTEETEMMMPVEETAEEVEEIQLSSEETEMVPVEEAEEVHHSSEETEMVPVEEAEKIHQSSEETEMVPVAEXXAXXTPVPXXXDVEVGFTCH

SEQ ID NO: 186242 - protein, 84 aa, Triticum aestivum
  Clone ID: PAT_TA_80660.pep
GAFLHFIQWGCTERNYTHLTGVTWVSTLSVNIPVNGKDYPEAQCAGLCPTFGFGLNPIYKCVNRGARILEDALIPLLPNTPSVP

SEQ ID NO: 186243 - protein, 191 aa, Triticum aestivum
  Clone ID: PAT_TA_80661.pep
MANPSMAAGGGVPWAEGARAVGAQIRNRLRVAPVDRRWLWRRPEGRAASEAVRQWSDRLRAILQRDKQNQGPDQQQGPGSPDASAAAAAKPSSSAFKFYRKKVGKEVNGVEDSVIFRSLQALAVPLIGNACHVFMHGLNSVQIYGAEKLQQALQERPKDKPLLTVSNHVAAMDDPFVIASLLPPSVMLEAQ

SEQ ID NO: 186244 - protein, 145 aa, Triticum aestivum
  Clone ID: PAT_TA_80662.pep
AKVLPPRRGPVQGQQNRPMGSPGTPPPTPPPPPPPPRCRLSPLQRPSSGPEKSGTASRQEARAPPRRGSTGRARISPPHPQFLLRSLHLRAPGAAAPRTPTPRPPEPGRSTALWCSSSWYGSRRPSRRAGRWPRGRARRSRRRRR

SEQ ID NO: 186245 - protein, 217 aa, Triticum aestivum
  unsure (1)..(217): unsure at all Xaa locations
  Clone ID: PAT_TA_80663.pep
PRVRYVLMENVVDILKFADGFLGRYALSRLVSMRYQARLGLMVAGCYGLPQFKMRAFLWGALPSRVLPKFPLPTHDVVKRGVVPNAFSQCLVAYDEIDDKRLKKALVLQDALSDLPKVPNYQPNDLMENRINPKTEFQRYIRLSRKDMEDYSFGDATPSPKACQLFDHQPLELSTDDYQRVKQIPFRKGANFRDLXXVQVGENNTXEFNPHIPRVFL

SEQ ID NO: 186246 - protein, 92 aa, Triticum aestivum
  unsure (1)..(92): unsure at all Xaa locations
  Clone ID: PAT_TA_80664.pep
CIXXVQDKIRSNDSQXXQMIAASTRKRPPYGPQGPASLCFFCSPWEFKPGGNFSFVCVEIFLVIATGCQKHSTAPSTAQQITKTNTLLTGIT

SEQ ID NO: 186247 - protein, 71 aa, Triticum aestivum
  Clone ID: PAT_TA_80665.pep
FSSRYSLPLPAASAVATMQFLQYTLSICIHKTRTHFTFFFTLNMIKVSMIYLPHKVYCRSHKYELYSTQSI

SEQ ID NO: 186248 - protein, 81 aa, Triticum aestivum
  unsure (1)..(81): unsure at all Xaa locations
  Clone ID: PAT_TA_80666.pep
RFQHFTKFILPSLDIYKHKCPPNASKKGAPSSKRKTLLINSLGLFAVGAGLNLVGRILFLFELFLELFLALPFHFLDVXXL

SEQ ID NO: 186249 - protein, 91 aa, Triticum aestivum
  unsure (1)..(91): unsure at all Xaa locations
  Clone ID: PAT_TA_80667.pep
MASATSPTPPWVILGSVPRVLSAAAAAASLPPGPGSADFSLELPPPPRVALLTIPPRIFPSRPTRASYPCVLAADSSAGXXXLXADQGHAT

SEQ ID NO: 186250 - protein, 191 aa, Triticum aestivum
  unsure (1)..(191): unsure at all Xaa locations
  Clone ID: PAT_TA_80668.pep
MSGDKLVTKILQLMEGGRSLVVLDGLSADEEWDQVKSCLWDDGNAKHSCTIVVTTTNAAVAHYCSGNKDTLCKLDPLDSAAVRQLFYHKVFKRDGLIELHKPMXDLADHIIKKCDGDLCAITIISGLLGTKTRTSEAWNSVLERYDSELRNKPDRVATAAAKLSYVDLXSHMKYLLQYIXIFLXXYSITRA

SEQ ID NO: 186251 - protein, 174 aa, Triticum aestivum
  unsure (1)..(174): unsure at all Xaa locations
  Clone ID: PAT_TA_80669.pep
GRARSRAGGRGASARRGARRRGRGSRPWRAAGGVTRAMLARARATASFRLVVLNGRAFVQRFRPAFQTRDLFTIWGILQLLRRYPGRVPDLDLMFDCVDWPVVRTHLYRGEHALFMPPLFRYCGDDRTLDIVFPDWSFWGWPEINIKPWDALHKDLXXGNSKVRWXSREPYAYX

SEQ ID NO: 186252 - protein, 223 aa, Triticum aestivum
  unsure (1)..(223): unsure at all Xaa locations
  Clone ID: PAT_TA_80670.pep
HASVQMLVHNRYPSAVAEKVLSQESGKSXXVXXPXXKNDFGSGSDHAKAHGSGCLSGDMHHHVLKDGELQKDKQDNECSKNDDSELGTRNGLLNPVKVQKVNSHVLSIRGNGDDKLPPSLQNGKTSPHLNSNQCDHAKLTSGKHPVQVKPDKGDAEQKDMKTNPSTVKGSKQHPALNDSSNGDLSYKAKQLKXXVLENTKQATLSRDALNPVNTSVLLXXXRD

SEQ ID NO: 186253 - protein, 73 aa, Triticum aestivum
  Clone ID: PAT_TA_80671.pep
YACHTNMHPRVEAVLVYVQFSMLPTNTNSVPRSIFPCFLLKELPSKMCHVEITGFSCFLLKELPNNFTYASSV

SEQ ID NO: 186254 - protein, 171 aa, Triticum aestivum
  Clone ID: PAT_TA_80672.pep
HASDPSKRAFAYFVLSGGRFVYASLLRLLVLKFVLSMSASKDVLALASLEVDLSSIEPGSTVTVKWRGKPVFIRRRTDDDIKLANSVDVASLRHPEQDAERVKNPEWLVVIGVCTHLGCIPLPNSGDFGGWFCPCHGSHYDISGRIRKGPAPYNLEVPTYSFLEDNKMLIG

SEQ ID NO: 186255 - protein, 63 aa, Triticum aestivum
  Clone ID: PAT_TA_80673.pep
ESIKHREYISRQQDTSLVLTLLPLLHLKWPDWGCRPRRRSLGSLGLFPHNQHRSHHGGHPDAW

SEQ ID NO: 186256 - protein, 151 aa, Triticum aestivum
  unsure (1)..(151): unsure at all Xaa locations
  Clone ID: PAT_TA_80674.pep
PRVRKAVVFHDGRLAFRPTAGSTLAMFMWLPFGVALASARLTIALTVPYRYSTPILAATGMSWRLKAGDGPPLQTAGVERGCRRGQLFVCNHRTLLDPVYVSVALDRPVRAVSYSLSRLSELISPIGRTVRLTRDRDADGRAMARXXXXGV

SEQ ID NO: 186257 - protein, 216 aa, Triticum aestivum
  Clone ID: PAT_TA_80675.pep
TRPNKTEFSDPFHATDLPSNIDTCTFLGQKADKKKEDNFDSLKKSNADIFHSASSVNETVVGQHTTCSQQSGKDSRRQGFDPGIDFQESRLHSFWEDGHVSDDTFQGDTELSSLLARKNDEKNKGGIERLEKPETKTSTQRSKPSGDFRNEMSEAETCSDGSEVTNYPGVQNGKSAAAATQLPANLCLEETSRGMFQIHAQVDCVKTIENPGVDFE

SEQ ID NO: 186258 - protein, 210 aa, Triticum aestivum
  unsure (1)..(210): unsure at all Xaa locations
  Clone ID: PAT_TA_80676.pep
TRPVGQLVVSLGAALAKETAIFGGALLGKEAAALRGLFGKIRDSKVELESMQAYLQEAERFKDTDKTTAIFVGEVKGFAFQIEDVVDEFTYKLEECKHGGFAGKMKKRLKHIKTWHRLAAKLQEIKAQLKDAKRRKQDYAVTGRFASSARSINQGQALHFTRDEDLVGIEENRDRLIRWLTIGGCSGHGLAQSSSXXTSVWGMPGVGKTT

SEQ ID NO: 186259 - protein, 50 aa, Triticum aestivum
  Clone ID: PAT_TA_80677.pep
ALPLDYHSLPRWRSGQSTPTIPIIHRLFLSIITLCPDAKSSLSKWNPCLL

SEQ ID NO: 186260 - protein, 80 aa, Triticum aestivum
  unsure (1)..(80): unsure at all Xaa locations
  Clone ID: PAT_TA_80678.pep
HASAELSEKTLADFSQIVDYCESSSCLQASHVDSFGEXGXXTLCQRTCDACKHPNQVSLRWEDLLRVPNSRSNKISFKSS

SEQ ID NO: 186261 - protein, 78 aa, Triticum aestivum
  unsure (1)..(78): unsure at all Xaa locations
  Clone ID: PAT_TA_80679.pep
HASXNTLYSTRTLHRRLRCALKTQKLVMPNTHTGMYIFFFCIPLDNMHILHKSLYLMQXSNSCIYVXXXXXXTXXLGH

SEQ ID NO: 186262 - protein, 105 aa, Triticum aestivum
  Clone ID: PAT_TA_80680.pep
HASAFDSCTQEKFSLRAALLWTLNDFPALAYLYGWSTSGKYACPSCGPFTRSYWLKKSKKFCYMGHRRRLTQNHVFRRRKKEFDNTKEMELAPITMSGSSALRML

SEQ ID NO: 186263 - protein, 190 aa, Triticum aestivum
  unsure (1)..(190): unsure at all Xaa locations
  Clone ID: PAT_TA_80681.pep
MKKCDCGHSSVXHFCWWNKYIATPILYGSXXFEGRXTMTLLXXXVLKGIVLXRTKXXRAAXLALPPKTVTLKRDSFDRNEMEFYEALYTQSCTQFDSYVVAGTLLNNYAHIFDLLTKLRXXVDHPYLVAFSKTAESREGCKNQQNGAMESQCGICHELAXXVXXTSCDHVFCXXCLMEYSATLGNXXXXS

SEQ ID NO: 186264 - protein, 63 aa, Triticum aestivum
  unsure (1)..(63): unsure at all Xaa locations
  Clone ID: PAT_TA_80682.pep
HKIFWXXXAXXTKDMQSCNSNSKGATASKESNAHICIILPHCLYVYNAVFNTVMNSQLHRTRG

SEQ ID NO: 186265 - protein, 216 aa, Triticum aestivum
  unsure (1)..(216): unsure at all Xaa locations
  Clone ID: PAT_TA_80683.pep
HASAKPIGLREPKYSPFGPGRLDRPWTGLCAPAVDTTLRSVDAEDPAPAAEXDLEEARRRERERVLGEPLTPAERSFLVDKCQKNRTKRQINLGRDGLTHNMLNDIHNHWKHGEAVRVKCLGVPTVDMQNVCHELEDKTGGLIIHRHGGQLILYRGRHYHPKKRPVIPLMLWKPAEPIYPRLIKTTIXXLTVXXTKEMXKKGLHAPVLTKLAKNGX

SEQ ID NO: 186266 - protein, 215 aa, Triticum aestivum
  Clone ID: PAT_TA_80684.pep
PRVRYTMQILAVDKLVSVQVAENTAQDVAGNPNLPSDRLQVRHYSVPASSSSIATIATVIFAATAIVATLLTVSTSSLIASGAMARPSSYSISEPSRNLLRMACHIQIFALSRWLSINLPVEYYELAKGIEWTIPYIRLPWEGPSADPFVGYSTMPAIAYSELVDRSDVVQADPYYPGAAPGGQQQQIMPMQIPVKPPATPLQIPALDGKPLTAM

SEQ ID NO: 186267 - protein, 115 aa, Triticum aestivum
  unsure (1)..(115): unsure at all Xaa locations
  Clone ID: PAT_TA_80685.pep
SLLILFPNKVPLDRSILFYFPCRITYHFSLQKFFSCYVLSSTSKLITSLYLATLNQMSFILCSPYCMFLHCWIVDLQSNFHMLKENNSTLGGRIPIAFFXSIKHPEHRLHWLXQX

SEQ ID NO: 186268 - protein, 158 aa, Triticum aestivum
  unsure (1)..(158): unsure at all Xaa locations
  Clone ID: PAT_TA_80686.pep
MVEPMAARAIPFPCWLILLLLLPLSHAATGDFTHCGGCDDADEGSLWSTDNILQCQKVSDFLIATAYFSIPLELLYFTTCSDLFPLKWIVLQFGAFIVLCGLTHLINVFTYEPHSFHLVLALTVAKFLTALVSFATAITLLTLIPQLLXXXXXENFLI

SEQ ID NO: 186269 - protein, 65 aa, Triticum aestivum
  unsure (1)..(65): unsure at all Xaa locations
  Clone ID: PAT_TA_80687.pep
HASESLALPSSAAFMPSGRRRRRRXXRAXXSAPFPPTXLPCYMPHLPLATSKPPPWRPXXTCTSP

SEQ ID NO: 186270 - protein, 125 aa, Triticum aestivum
  Clone ID: PAT_TA_80688.pep
PTAGGGFFKGGGSGRFWASQGGVFPTTRGGTKISKRENPPFFEKGWVPVFPPEGARPFKGGGFSPFHQDGLWGRPHGGFFWGKGHPGVWGGGFWKFKGSFFGWNRDWGLGGWKGLKKVWVFLGLA

SEQ ID NO: 186271 - protein, 110 aa, Triticum aestivum
  unsure (1)..(110): unsure at all Xaa locations
  Clone ID: PAT_TA_80689.pep
GNLTGLAFGTGAYGHGFCFMQGPPWENLIWYGPLERELGGAGGITGPFPGKKKPKRVEKPPQNWGFWKKPVFPRGPPLPGRXNGPPPGLNDLSMEPIPGLSNLRPGXXXF

SEQ ID NO: 186272 - protein, 130 aa, Triticum aestivum
  unsure (1)..(130): unsure at all Xaa locations
  Clone ID: PAT_TA_80690.pep
GADVNRIVHKQQLKQQQQRPPSTSASQVSSRQSEKESSCDEEINAILEEEEALIAAHRKEIENTMEIVREEMXXLADVDQPGSLIDNYVAQLNFLLSRKASGLVSLQARLARFQQRLKEEEIFSLKKPSR

SEQ ID NO: 186273 - protein, 169 aa, Triticum aestivum
  unsure (1)..(169): unsure at all Xaa locations
  Clone ID: PAT_TA_80691.pep
QPPHRTQIRLPSPPPPWKFGSRPPPRHLLPAHSTVGRQILTMDGYAIISSDQEQPVIGADWSSRALSDELVIHANSADLSLQLAEEQSQLHDIMGINEMPINDIXSASDSDGSSGNETDKEPGKYFYPGFXXLVNPRPPEVGMRFPTLEDATRYYSAHALLXXXVAIKG

SEQ ID NO: 186274 - protein, 109 aa, Triticum aestivum
  unsure (1)..(109): unsure at all Xaa locations
  Clone ID: PAT_TA_80692.pep
IFKGGPPPEKITQFFWPFPPPGWGQGGGPRPPQGXWFQKKRLGGPPVPFFGGGNQLDLDWDFFWFGGPPPMNPPREDQVFWFGVQPPNFFPPEGSFCLQPKFCWPLVGF

SEQ ID NO: 186275 - protein, 175 aa, Triticum aestivum
  unsure (1)..(175): unsure at all Xaa locations
  Clone ID: PAT_TA_80693.pep
MAEGFAEEGRRGEEPESVTPAAAAGSQGLEDSRLLRSRYLAVKSQINDEKDEMASADSVKFQSVISQVESLHVHVHKPREQVADAEALLDIASSLAASVRSQSALGITPSHLVAALLNKFGTQGDADGEGASLRWSAVGLAASHVFMAVPGCCTMFGPMTTEVKXXRTHTXXKXT

SEQ ID NO: 186276 - protein, 215 aa, Triticum aestivum
  unsure (1)..(215): unsure at all Xaa locations
  Clone ID: PAT_TA_80694.pep
TRPNDPARTGPISDPPVIGAMTDIALIGPARPIGAYTGLGLEFSPARTTNGGEGRRRNQRTINERGAIVESWEVDSYNDEPSFHRKEIAGEWEGQKIQISYMIVPDTVEARIKVKLLLAGGSRYHVTGFIKAWDDNMGHEFVRLLSDSDQTVEVPSDQWTPLPLMISLLCLSNAEEVQLKVAAYLTFRSCSNSEEQALNVSPDQCFKLXXRAXXX

SEQ ID NO: 186277 - protein, 216 aa, Triticum aestivum
  unsure (1)..(216): unsure at all Xaa locations
  Clone ID: PAT_TA_80695.pep
TRPARSSLEASFANEAEIVFTTVSSSGRRLFSRLSHGFDMVVIDEAAQASEVGVLPPLALGAARCVLVGDPQQLPATVISKAAGTLLYSKSLFERFQQAGCPTILLSVQYRMHPQIREFPSRYFYQGRLTDSESVVKLPDELYYKDALMAPYIFYDISHGRESHRGGSSSYQNVHEAQFALRLYEHLQKLVKVNGGKKASVGIITPYKLQLKCLQX

SEQ ID NO: 186278 - protein, 209 aa, Triticum aestivum
  unsure (1)..(209): unsure at all Xaa locations
  Clone ID: PAT_TA_80696.pep
HASAKAAGDMQSEENSKSDGISSGQNIRKRKQVGKAGAQGQPSRGAEPEQSHILQGATAQVPPLPGGASFFRAHQEGPPASAGRTIDNTKPSNPFAMSQVSNFAEGLASGSIPTELQKSILGGTNMFNTGFGWNQSSQGSAIKNTQGSVANLMRPGVNVEGKINVGSQGAFNPTPTSQMDFPKIPPYMSSSFXXGSQFLDXXXXSASGN

SEQ ID NO: 186279 - protein, 213 aa, Triticum aestivum
  unsure (1)..(213): unsure at all Xaa locations
  Clone ID: PAT_TA_80697.pep
HACGHFKSQLDPYMIGALAEIASGRRLFVDDYDRKTKETKMGIMQVTPEVAQWLGRELGYKNYDIELEDNIDLLYWPFINVYFGAAYAKWLFSCDEKERTEEFVVRAYKGGRKKATHKSSAPIFERYLYVKETLLSMRQPDSFNELAPDLLENSSTXLVYWDSKVSEEDMGGMWSQPDVLKEWTNSGERRGNVRFSHDXXKXPYLSRVXXXXV

SEQ ID NO: 186280 - protein, 165 aa, Triticum aestivum
  Clone ID: PAT_TA_80698.pep
MDLLERSAANGRSGMLRMSSPPANPGQLTIFYGGSVCVYDSVPPEKAQAIMLIAAAAAAASKSNGTTAVKPPAMSATNAIQAMLTRSLSLQSTSVANGQPQAVADPGSICKLQADLPIARRHSLQRFLEKRRDRVVSKAPYGAGKPSEGMGASSGMEVVAEGKAQ

SEQ ID NO: 186281 - protein, 130 aa, Triticum aestivum
  unsure (1)..(130): unsure at all Xaa locations
  Clone ID: PAT_TA_80699.pep
MAPGAADRVAIGVCVMEKKVFCSPMEQILERLRAFGEFEIIIFGDKVILEDPIEIWPKCDCLIAFCSSGFPLQKAQAYAALRRPFLVNELEPQYLLHDRRKVYEHLEKYGIPVPNYALVNREYPYQELXX

SEQ ID NO: 186282 - protein, 207 aa, Triticum aestivum
  unsure (1)..(207): unsure at all Xaa locations
  Clone ID: PAT_TA_80700.pep
TRPATREAKNDDGFYAMPDVRLPSDARGVVAAASARDCELACIGECSCTAYSYNGSCWLWHGGLVNLQDMSTSSSTGTGGGSGTILIRLAASEFTSPGHTKTLIIALVAVAAAVAAVTVAVFVSVFVLRRRRLKAQRRVVEGSLMPFTYRDMQSVTNNFSDKLGGGSFGSVFKGSLPDATATLVAVKKLXXVRQGEKQFRAXVSTIG

SEQ ID NO: 186283 - protein, 168 aa, Triticum aestivum
  Clone ID: PAT_TA_80701.pep
TRPRRHNTLYLLALDVVKLGDSNVEAYALAEEKLRHVKVQLEPVAAVRDGLGLFDKELAADSAGSGVGNKQHFGRPESEHTISQGSDVFPAASKKRPAGRPTTSRDKAPYEQPSKRTRFCSICRLQGHKSTTCPARGDVPKAPRKSPRCSKCGLTGHRKNTCSNPPKV

SEQ ID NO: 186284 - protein, 48 aa, Triticum aestivum
  Clone ID: PAT_TA_80702.pep
QVQDQDKVNPWPRSTSTLQLLFGCSCPLPPFTPTYVVPARPPRLAVFN

SEQ ID NO: 186285 - protein, 158 aa, Triticum aestivum
  unsure (1)..(158): unsure at all Xaa locations
  Clone ID: PAT_TA_80703.pep
MAPTVMASSATSVAPFQGLKSTAGLPVSRRSNGASSAAXHNGGRIRCMQVWPIEGIKKFETLSYLPPLSTEALLKQVDYLIRSKWVPCLEFSKVGFIFREHNASPGYYDGRYLTMWKLPMFRXTDAKKVIXNEVEXVKKXYPXAXVRIIRFXKWARMR

SEQ ID NO: 186286 - protein, 67 aa, Triticum aestivum
  Clone ID: PAT_TA_80704.pep
LLYQATSIDAVLKDAGLESKIMEVPKKSGWDLNTSCLSYYWLLILQVINLCNFKISLKATSLGTTMI

SEQ ID NO: 186287 - protein, 168 aa, Triticum aestivum
  unsure (1)..(168): unsure at all Xaa locations
  Clone ID: PAT_TA_80705.pep
MAPAVMASSATTVAPFQGLKSTAGLPVSRRSSXQPRQRXNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPXAYXRVXRFDNLRQCSASLHRFXATGCE

SEQ ID NO: 186288 - protein, 83 aa, Triticum aestivum
  Clone ID: PAT_TA_80706.pep
FPDWTLHPIFNDDDNCCYTEDDDEDVGDVLLDGCDGHHDEPSVIDVIRSNMEVQGLELNMEDEIDQAADMFIRRFRERMSKSI

SEQ ID NO: 186289 - protein, 176 aa, Triticum aestivum
  unsure (1)..(176): unsure at all Xaa locations
  Clone ID: PAT_TA_80707.pep
GLPVSRRSNGATRQRHNGGRIRCMQVWPIXXIXXFXTXSYLPPLSTEVLLKQVDYLIRSXWVPCLEFXXVGFIFREHNXSPXXYDGRXXTMXXLPXFGXTDAXQVINEVEEVKKEYPDAYVRIIGXFDNMXQVQCVSFXRLQSQGLRRVPARLQVTSRKGIYKVLRFSDIALGFSP

SEQ ID NO: 186290 - protein, 150 aa, Triticum aestivum
  unsure (1)..(150): unsure at all Xaa locations
  Clone ID: PAT_TA_80708.pep
KNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQXIVTGKGPVENLFDHVADPVNNNXAWGFATNFAPEAKCV

SEQ ID NO: 186291 - protein, 155 aa, Triticum aestivum
  unsure (1)..(155): unsure at all Xaa locations
  Clone ID: PAT_TA_80709.pep
MAPAVMASSATTVAPFQGLKSTAGLPVSRRSGSAXLSSVXNGGRIRCMQVWPIEGIKKFETLSYLPPLSTEALLKQVDYLIRSKWVPCLEFSKVGFVFREHNSSPGYYDGRYWTMWKLPMFGCTXATRCSNEVEEVKKEYPDXYVRVIGFDNMRK

SEQ ID NO: 186292 - protein, 190 aa, Triticum aestivum
  Clone ID: PAT_TA_80710.pep
AAAGSCENIVDLNRNRLKKTKYEAGTLMATSRGHPPKPGKSRIGHYPDSKDLPRQLDMVAYFQDEPPCQKTHCTNVAVEQYNAQQQSDDKKIMRAVGVDSNMFILDQNDPVSYWHVYFKAYVGRNRYRCFAELSGEKGPELLRYCTAVNKASVVLCKYCFGGIYHPPGVDFTGSPRLPLQMYRQFLRKKD

SEQ ID NO: 186293 - protein, 175 aa, Triticum aestivum
  unsure (1)..(175): unsure at all Xaa locations
  Clone ID: PAT_TA_80711.pep
MAPAVMASSATTVAPFQGLKSTAGLPVGRRSSXQPQQRXNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVXAFDNLRQVQCVXFNRFRPPGCXESARLN

SEQ ID NO: 186294 - protein, 191 aa, Triticum aestivum
  unsure (1)..(191): unsure at all Xaa locations
  Clone ID: PAT_TA_80712.pep
AANYAASRSLVAKXFRXGFFWPTALDDAXELVKHCKGCQLFSSKQHMPASVLKTIPLTWPFAVWGLDMVGPFKTARGGMTHLLVAMDKFTKWVEAKPIKKLNGPTAITFIADITTRYGVPHSIITDNGTNFAKGALARFYATQGIRLDLASVAHPQSNGQVERANGLILSGIKPRLIVPLERSAGCWLDEL

SEQ ID NO: 186295 - protein, 181 aa, Triticum aestivum
  unsure (1)..(181): unsure at all Xaa locations
  Clone ID: PAT_TA_80713.pep
AGLPVSRRSNGAXLRQRHNGGRIRCMQVWPIEGIKKFETLSYLPPLSTEALLKQVDYLIRSKWVPCLEFSKVGFIFREHNASPGYYDGRYWTMWKLPMFGCTDXTQVINEVEEVKKEYPDAYVRIIGFDNMRQXQCVXSFAXKPPGCEESGKXKKLTHDRPYICHCSFNSIALGFPFIFNM

SEQ ID NO: 186296 - protein, 192 aa, Triticum aestivum
  unsure (1)..(192): unsure at all Xaa locations
  Clone ID: PAT_TA_80714.pep
KKQVTSAVNYHGKSSKANRFTVMAAENIDEKRNTDKWKGLAYDISDDQQDITRGKGIXDSLFQAPTGDGTHEAVLSSYEYVSQGLKKYDFDNTMGGFYIAPAFMDKLVVHLSKNFMTLPNIKIPLILGIWGGKGQGKSFQCELVFAKXGINPIHDEXPESWKIGNAGRSQPSSSGQRYREAADMFKKGXXCC

SEQ ID NO: 186297 - protein, 158 aa, Triticum aestivum
  unsure (1)..(158): unsure at all Xaa locations
  Clone ID: PAT_TA_80715.pep
VSRRSNGASXGSVXNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDXYVRIIGFDNMRQVQCVXFIXFKPPGCEESARLNSSFTTGHI

SEQ ID NO: 186298 - protein, 154 aa, Triticum aestivum
  unsure (1)..(154): unsure at all Xaa locations
  Clone ID: PAT_TA_80716.pep
PVPVSRRSNGASSAASXNGGXIRCMQXWPIEGIKKFETLSYLPPLSTEALLKQVDYXIRSKWVPCLXFSXXGXIFREHNASPGYYDGRYWTMWXLPMFGCTXATQVXNEVEEVXNDXNPDAYVRIIXDFDNMCHVXFXXFIXXKSXXCXXSXKA

SEQ ID NO: 186299 - protein, 131 aa, Triticum aestivum
  unsure (1)..(131): unsure at all Xaa locations
  Clone ID: PAT_TA_80717.pep
VISPLGASFLEVHMGXRDRKTASLMERCFILHIDDGGSRWRGAVETRRLXRGDGLAXEEEAVWRHGGVDGREAWQGRCISSALRMDRWKMEVTALAACGAHCECARPVXDPFQVVVGWDTRLKCSLXXLXD

SEQ ID NO: 186300 - protein, 127 aa, Triticum aestivum
  unsure (1)..(127): unsure at all Xaa locations
  Clone ID: PAT_TA_80718.pep
MAPTVMXSSATSVAPFQGLKSTAGLPVSRRSNGAXRQRQNGGRIRCMQVWPIEGIKKFETLSYLPPLSTEALLKQVDYLIRSKWVXCLEFSKVGFIFREXNASPGIRWRYWTMWXCYVRNDAQGDNE

SEQ ID NO: 186301 - protein, 114 aa, Triticum aestivum
  unsure (1)..(114): unsure at all Xaa locations
  Clone ID: PAT_TA_80719.pep
RELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGXFDPLGLAMTPRIRXS

SEQ ID NO: 186302 - protein, 83 aa, Triticum aestivum
  unsure (1)..(83): unsure at all Xaa locations
  Clone ID: PAT_TA_80720.pep
LICXSLLXFLXXLXFQQTGNXLISTLGAAGGLAALXGXXPSXTWPPXSSCRSSPRRPXXFLLLXPPRFPXLSNXXNXHSXXMX

SEQ ID NO: 186303 - protein, 107 aa, Triticum aestivum
  unsure (1)..(107): unsure at all Xaa locations
  Clone ID: PAT_TA_80721.pep
MAPTVMASSATSVAPFQGLKSTAGLPVSRRSNGASSAAXXNGGRIRCIQVWPIEGIKKFETLSYLPPLSTEALLKQVDYLIRSKWVXLLEFSKLGHFREHNLLYDCR

SEQ ID NO: 186304 - protein, 63 aa, Triticum aestivum
  unsure (1)..(63): unsure at all Xaa locations
  Clone ID: PAT_TA_80722.pep
GXAXLQGRXLXGAXXTRXREXACPTXTVQLQXEVXNSGSETVELECXSMHFSTAPIDTQGXXA

SEQ ID NO: 186305 - protein, 180 aa, Triticum aestivum
  unsure (1)..(180): unsure at all Xaa locations
  Clone ID: PAT_TA_80723.pep
GFALATSALLVSGASXEGAPKRLTFDEIQSKTYMEVKGTGTANQCPTIDGGVDSFPFKAXKYEMXKFCXEPTSFTVKAEGIQKNEPPAFQKTKLMTRLTYTLDEMEGPXEVGADGTLKFEEKDGSIRGVTXXFPERTVPSFHVRVAHRKPELAFCAVRVFLDQSVYCRKHGTRERREIAE

SEQ ID NO: 186306 - protein, 108 aa, Triticum aestivum
  unsure (1)..(108): unsure at all Xaa locations
  Clone ID: PAT_TA_80724.pep
TALARQRHNGGRIRCMQVWPIEGIKKFETLSYLPPLSTEALLKQVDYLIRSKWVPCLEFSKVGFIFREHNASPGYYDGRYWTMWKLPMFGCTDATQVINEXEEXRRST

SEQ ID NO: 186307 - protein, 148 aa, Triticum aestivum
  unsure (1)..(148): unsure at all Xaa locations
  Clone ID: PAT_TA_80725.pep
DAEALAAFKHNIRDEWLSRHLGQEKPKSMAALMTLMTHFCPGEDSWRAHSNNISKNHGTLDTKDSNSRSRRXKHKXRIDSDNTEDTAVNAVFKXSKXCQRKKPFKQRTLGXSSLDRYHSRANNGPRXASXHXNGLLGLSRQQXNXGTX

SEQ ID NO: 186308 - protein, 53 aa, Triticum aestivum
  unsure (1)..(53): unsure at all Xaa locations
  Clone ID: PAT_TA_80726.pep
TSQPRXXSAGLNXPRYLSSSQCTILGXXTMNXSLRDLLTCPFIXRXXVQRSPQ

SEQ ID NO: 186309 - protein, 117 aa, Triticum aestivum
  unsure (1)..(117): unsure at all Xaa locations
  Clone ID: PAT_TA_80727.pep
YHALLGRPXLAKFMXIPHYAYLKMKTPSTKGILTVVGDYKKSVACAADSSRLAESLMIAAEKRLLDRVVALAGKKPEMSPIPQESEVEGSFKPXKETKKIPLDPERHAVIGANLDSK

SEQ ID NO: 186310 - protein, 66 aa, Triticum aestivum
  unsure (1)..(66): unsure at all Xaa locations
  Clone ID: PAT_TA_80728.pep
RGMYXCXXLAXSIKXXNHGYHRIKMKLSNFXIXIIXGNTWHLRSCGELLIYDLLTANKLFYLFPKK

SEQ ID NO: 186311 - protein, 94 aa, Triticum aestivum
  unsure (1)..(94): unsure at all Xaa locations
  Clone ID: PAT_TA_80729.pep
MSDTDEHHFESKADSGASKTYPQQAGAIRKGGHIVIKARPCKXVEVSTSKTGKHGHAKCHFVAIDIFNGKKLEDIVPSSHNCDVPHVDRQVISD

SEQ ID NO: 186312 - protein, 118 aa, Triticum aestivum
  unsure (1)..(118): unsure at all Xaa locations
  Clone ID: PAT_TA_80730.pep
MAPAVTXSSXTTVAPXQGLKSTAGLPVSRRTSXQPRQXHNGGRXRCMQVWPXEGIKKYETLXYLPPLATEALLKQVDYXXRSXWVPCLEXARWLRFRXHNSPPGXXXGRXWTMXKHGA

SEQ ID NO: 186313 - protein, 122 aa, Triticum aestivum
  unsure (1)..(122): unsure at all Xaa locations
  Clone ID: PAT_TA_80731.pep
PSAAPTALARQRHXGGRIRCMQVXPIEGIKKFETLSYLPPLSTEALLKQVDYLIRSKWVPCLEFSKVGFIFRXHNASPGYYDGRYWTMWKLPMFGCTDATQVINEVXEVXKEYXDAYVRSSD

SEQ ID NO: 186314 - protein, 129 aa, Triticum aestivum
  unsure (1)..(129): unsure at all Xaa locations
  Clone ID: PAT_TA_80732.pep
VSRRSNGASSAAXHNGGRIRCMQVWPIEGIKKFETLSYLPPLSTEALLKQVDYLIRSKWVPCLEFSKVGFIFXXHNASPGYYDGRYWTMWKLPIFGCTDATQVINEVEEVKKEYPDAYVRXIGFDNMRR

SEQ ID NO: 186315 - protein, 62 aa, Triticum aestivum
  unsure (1)..(62): unsure at all Xaa locations
  Clone ID: PAT_TA_80733.pep
LXRVXNGGRIXCMQVXPIEGIKKFETLYXLQPLSTEALXXQVDYLNRSKXVHCXEXSKXXFI

SEQ ID NO: 186316 - protein, 152 aa, Triticum aestivum
  unsure (1)..(152): unsure at all Xaa locations
  Clone ID: PAT_TA_80734.pep
VSRRSNGASSAAXHNGGRIRCMQVWPIEGIKKFETLSYLPPLSTEALLKQVDYLIRSKWVPCLEFSKVGFIFREHNASPGYYDGRYWTMWXLPMFGCTDATQVINEVEEVKKEYPDAYVRIIGFDNMRQVQCVXSSLKPRAAGVRLKVLTQA

SEQ ID NO: 186317 - protein, 57 aa, Triticum aestivum
  unsure (1)..(57): unsure at all Xaa locations
  Clone ID: PAT_TA_80735.pep
PHNLRDPLLAGGINTPSSRVNSTRTMCCGYDASSCDQLSTASGRFDGMXLQRYYRXL

SEQ ID NO: 186318 - protein, 43 aa, Triticum aestivum
  unsure (1)..(43): unsure at all Xaa locations
  Clone ID: PAT_TA_80736.pep
EIQFIHSFCYFLLSIDHPSFSSKERRYSVDVYICIVNLQLIXE

SEQ ID NO: 186319 - protein, 132 aa, Triticum aestivum
  unsure (1)..(132): unsure at all Xaa locations
  Clone ID: PAT_TA_80737.pep
SSXQPQQRXNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVXSSL

SEQ ID NO: 186320 - protein, 86 aa, Triticum aestivum
  unsure (1)..(86): unsure at all Xaa locations
  Clone ID: PAT_TA_80738.pep
FLQSCPLLFFMDRAHFCESGEIIPVPKFLLQPFLSLISFFAICCFWQIKRDENESRREKPNLGRPXWASLGQTPAPSHPYPRPSHS

SEQ ID NO: 186321 - protein, 43 aa, Triticum aestivum
  unsure (1)..(43): unsure at all Xaa locations
  Clone ID: PAT_TA_80739.pep
ANASXTSXYXSKXHXXMTTVIAXSSAIRQDAVNKAKXFKXKHX

SEQ ID NO: 186322 - protein, 140 aa, Triticum aestivum
  unsure (1)..(140): unsure at all Xaa locations
  Clone ID: PAT_TA_80740.pep
MAPTVMASSATSVAPFQGLKSTAGLPVSRRSNGAXLGSVXNGGRIRCMQVWPIEGIKKFETLSYLPPLSTEALLKQVDYLIRSKWVPCLEFSKVGFIFRXHNASPGYYDGRYWTMWXLPIFGCTDXTQVINEVEEVRRST

SEQ ID NO: 186323 - protein, 146 aa, Triticum aestivum
  unsure (1)..(146): unsure at all Xaa locations
  Clone ID: PAT_TA_80741.pep
RRSNGASSAAXHNGGRIRCMQVWPIEGIKKFETLSYLPPLSTEALLKQVDYLIRSKWVPCLEFSKVGFIFXXHNASPGYYDGRYWTMWKLPMFGCTDATQVINEVEEVKKEYPDAYVRIIGFDNMRQVSASXHRFKPPXCEESGKA

SEQ ID NO: 186324 - protein, 78 aa, Triticum aestivum
  unsure (1)..(78): unsure at all Xaa locations
  Clone ID: PAT_TA_80742.pep
KXNXKCMQLVLATFLPLDPXLAAPSPXLAAPSPGSFXILNGLSXXXXAASSLXLLASXXCGGXAAXEXEAATXRGXVD

SEQ ID NO: 186325 - protein, 122 aa, Triticum aestivum
  unsure (1)..(122): unsure at all Xaa locations
  Clone ID: PAT_TA_80743.pep
GLKXTAGLPINXRSSSXRPQQRHNGGRIRCMQVWPIXGIKKFETLSXXQXLXTEALLKXVGXFXRSKXGACLXFSXVXFXFREHHXXPGYYXGRXWXMWXXXYFRCTDATQVLHEVEEVKKS

SEQ ID NO: 186326 - protein, 92 aa, Triticum aestivum
  unsure (1)..(92): unsure at all Xaa locations
  Clone ID: PAT_TA_80744.pep
XIVXGRTLXVSFDQSSRSXXIXPSIFLTTIQGRTKIXPYDTXQPXLMSPGYSNVTASIXELIIXFXSSXXRFIILNPTQRXSKSAXRFLPEK

SEQ ID NO: 186327 - protein, 103 aa, Triticum aestivum
  unsure (1)..(103): unsure at all Xaa locations
  Clone ID: PAT_TA_80745.pep
VRLSLTSHQEHKYCILPSIRLSRYLSGHLLSRTHLVTRSPTHVVPSRSPGDLSMTNIHSLLPMLIFSVRLSRPLSLVCRPLLARARXFCLFKNTHYSNLLVVR

SEQ ID NO: 186328 - protein, 75 aa, Triticum aestivum
  unsure (1)..(75): unsure at all Xaa locations
  Clone ID: PAT_TA_80746.pep
PPXESVQTSPVIQPLDMTHSITHKPDYTFLKTPPYLPIMAFHSHSELYCHATSTVLSYDMCVHHHIALHYHIELT

SEQ ID NO: 186329 - protein, 162 aa, Triticum aestivum
  unsure (1)..(162): unsure at all Xaa locations
  Clone ID: PAT_TA_80747.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSXYEYVSQGLKKYXFDNTMGGFTSLLLYDKLVVISQELIPANIRSTIWFGEQGKKYSVDFLQM

SEQ ID NO: 186330 - protein, 126 aa, Triticum aestivum
  unsure (1)..(126): unsure at all Xaa locations
  Clone ID: PAT_TA_80748.pep
QEPRNXTRRMXPAPXWGRXSGGNXRDPGXTPAVHGEMVVGRGITXXTAGRLLRCSWRXTTXXPPRHRRCFRRRVGGRVLQXTAARXRXLRACXELPXGXCRGXSLVEVQXTHGHPXKCDYVWSYTW

SEQ ID NO: 186331 - protein, 163 aa, Triticum aestivum
  unsure (1)..(163): unsure at all Xaa locations
  Clone ID: PAT_TA_80749.pep
MAPAVMASSATTVAPFQGLKSTAGLPVSRRSSXPRQRHNGGRIRCMQVWPIEGIKKFETLSYLPPLSTEALLKQVDYLIRSKWVPCLEFSKVGFVFRXHNSXPGYYDGRYWTMWKCPCLGXDAHRXVNEVEEXKKEYPDAMSVYRLHNCAVSAFIAARVQESE

SEQ ID NO: 186332 - protein, 129 aa, Triticum aestivum
  Clone ID: PAT_TA_80750.pep
DTGSSSGPPSQKRKIWIPNSMYRPNAFAPRQTYAAPRLPPPPSRQSRLPAPPSQAPVPTPNNGLCFRCGQPGHRARECNQNQNQLALPTTGRGNNQPRNNNAKSYGRAHANHIDLNEAQDQPATVMGSS

SEQ ID NO: 186333 - protein, 72 aa, Triticum aestivum
  Clone ID: PAT_TA_80751.pep
CVGKHTFLRKTRALICCFCKLQKVFHHSPSTLVGENFELSLINRKGGSIVVLFFSPYQPFYIAYVSFKSEMM

SEQ ID NO: 186334 - protein, 190 aa, Triticum aestivum
  unsure (1)..(190): unsure at all Xaa locations
  Clone ID: PAT_TA_80752.pep
MAPTVMASSATSVAPFQGLKSTAGLPVSRRSNGASFGSVXNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRXIGFDNMRXVQCVTFIXFKPPGCEESGRLNSHSRQAYISALLST

SEQ ID NO: 186335 - protein, 185 aa, Triticum aestivum
  unsure (1)..(185): unsure at all Xaa locations
  Clone ID: PAT_TA_80753.pep
MAPTVMASSATSVAPFQGLKSTAGLPVSRRSNGAXLGSVXNGGRIRCMQVWPIEGIKKFETLSYLPPLSTEALLKQVDYLIRSKWVPCLEFSKVGFIFREHNASPGYYDGRYWTMWKXPXFGCTDATQVINXVXXVKKEYPDAYVRIIDSTTCASACVXFIAXKPPGXKNPXSLKIHKGTFKCIA

SEQ ID NO: 186336 - protein, 81 aa, Triticum aestivum
  unsure (1)..(81): unsure at all Xaa locations
  Clone ID: PAT_TA_80754.pep
NHLLHFISTPTEKKGSKRIKLFRKKGNKVELSQFTTVVCFSGPSDETLPRVSQNHKXRGYCLSMPGGRPSPRAPALSAHRP

SEQ ID NO: 186337 - protein, 112 aa, Triticum aestivum
  unsure (1)..(112): unsure at all Xaa locations
  Clone ID: PAT_TA_80755.pep
ATSVAPFQGLKSTAGLPVSRRSNGASSAAXXNGGRIRCMQVWPIEGIKKFETLSYLPPLSTEALLKQVDYLIRSKWVPCLEFSKVGFIFREHNASPGYTMAGTGQCGTAMFG

SEQ ID NO: 186338 - protein, 152 aa, Triticum aestivum
  unsure (1)..(152): unsure at all Xaa locations
  Clone ID: PAT_TA_80756.pep
SLAPFVFFLPEALMAAPPSYAXHRTPLAASPCPEALRGSTSSATTPNRSWEAATPSSTASSSPTTTATELRRFALLRPVQGLPDHTSEFATSRPTPLQPSTTTELTTPLSCQRTRCQSQEQTHRRRRLLRGGAIYVSRDDDRSVRRSREARF

SEQ ID NO: 186339 - protein, 129 aa, Triticum aestivum
  unsure (1)..(129): unsure at all Xaa locations
  Clone ID: PAT_TA_80757.pep
LTRHRAKTHLSRTSVRREFAAVTXSVPXAYAHREDRPGWRIYPCPRDPVGSCHCRRRSPEPRTVRAERREGEEERSNLTSGPPGPTVSDPRGRXLCLSESAESRVCLLCFESVFSSKRFPFSDFIKTEL

SEQ ID NO: 186340 - protein, 178 aa, Triticum aestivum
  unsure (1)..(178): unsure at all Xaa locations
  Clone ID: PAT_TA_80758.pep
SAAAPTALARQRHNGGRIRCMQVWPIEGIKKFETLSYLPPLSTEALLKQVDYLIRSKWVPCLEFSKVGFIFREHNASPGYYDGRYWTMWXXPMFGCTDATQXINEVEEXKKEYPDGMSDHRFTSQVLHRFKHGCESRKANSYTGTSAFVYLILGFFHNFCCPENIHVEYQSYVYFPYT

SEQ ID NO: 186341 - protein, 172 aa, Triticum aestivum
  unsure (1)..(172): unsure at all Xaa locations
  Clone ID: PAT_TA_80759.pep
VMASSATTVAPFQGLKSTAGLPVSRRSSGSLGRVXNGGRIRCMQVWPIEGIKKFETLSYLPPLSTEALLKQVDYLIRSKWVPCLEFSKVGFVFREHNSSPGYXDGRYWTMWNCYVRTDATRCQRGGVRRIPDAMSVSLTRRSVVLMLRHSSRSQANMDMHLLFAQICQYCFS

SEQ ID NO: 186342 - protein, 85 aa, Triticum aestivum
  Clone ID: PAT_TA_80760.pep
MLMSLLFMRLLAPVSEGPEKLSSYESGIEPMGGAWVQFRIRYYMFALVFVVFVTTSPCQDWVICAPAAFLGCGSRFSGSLSGIEP

SEQ ID NO: 186343 - protein, 117 aa, Triticum aestivum
  unsure (1)..(117): unsure at all Xaa locations
  Clone ID: PAT_TA_80761.pep
XWAMLXALGCVFPEILSKNGIKFGEAVWFKAGAQIFSEGGLDYLGNPNLVHAQSILAIWAVQVVLMGFIEGYRVGGGPLGEGLDXIYPGGXFDPLGLADXPDNXAELKVQKGGGKKN

SEQ ID NO: 186344 - protein, 101 aa, Triticum aestivum
  unsure (1)..(101): unsure at all Xaa locations
  Clone ID: PAT_TA_80762.pep
LPMFGXTDXTQVIXEVEEVKKEYSXAYXRXIGFDNMRXVQXXXFIAFXPPGCEESGKAKQLIHDRYIKCHCSFVNLLGFPSPFLYLFLRIVSMFMEHKGPP

SEQ ID NO: 186345 - protein, 84 aa, Triticum aestivum
  Clone ID: PAT_TA_80763.pep
GATPSPRVFSYPNTPSTTKPCNIFQVYLAGSAPWATLFPVRVGLSRRHVSTCIFSSPCWGRPSGCIIPRSLGSDPVACIILAFT

SEQ ID NO: 186346 - protein, 110 aa, Triticum aestivum
  unsure (1)..(110): unsure at all Xaa locations
  Clone ID: PAT_TA_80764.pep
CDFSCTARFPTGDYSSKGCXXSLNAVPVYFHFLKDFLINEVQSLPPSMSTLVRRKPSTIGLRTDAAGTQVDRNLGSXTGVKGNSRVTPWVYCCHLVDFGKAAECPFSHVI

SEQ ID NO: 186347 - protein, 169 aa, Triticum aestivum
  unsure (1)..(169): unsure at all Xaa locations
  Clone ID: PAT_TA_80765.pep
MAPTVMASSATSVAPFQGLKSTAGLPVSRRSNGASSAAXXNGGRIRCMQVWPIEGIKKFETLSYLPPLSTEALLKQVDYLIRSKWVPCLEFSKVGFIFREHNASPGYYDGRYWTMWNCYVRXTTHXVINEVRVRGVPDAFRYRLMRSQSYLCLSNGLESRKASHTAISL

SEQ ID NO: 186348 - protein, 131 aa, Triticum aestivum
  unsure (1)..(131): unsure at all Xaa locations
  Clone ID: PAT_TA_80766.pep
MAPTVMASSATSVAPFQGLKSTAGLPVSRRSNGAXLGSVXNGGRIRCMQVWPIEGIKKFETLSYLPPLSTEALLKQVDYLIRSKWVPCLEFSKVGFIFREHNASPGYYDGRYWTMWXXPMFGSPTHXVINR

SEQ ID NO: 186349 - protein, 122 aa, Triticum aestivum
  unsure (1)..(122): unsure at all Xaa locations
  Clone ID: PAT_TA_80767.pep
LVXXGXSILQYXDXXIFMEHDXAKARNMKXVLCLFEQLTGLKINFXKSELFCFGXAKDEQEAYRQLXGXELAELPXSYLGIPIHHRRLTNREWKCIEXRFXKKLSCWKGKLMSYGGRLILIN

SEQ ID NO: 186350 - protein, 131 aa, Triticum aestivum
  unsure (1)..(131): unsure at all Xaa locations
  Clone ID: PAT_TA_80768.pep
MAPAVMASSATTVAPFQGLKSTAGLPXSRXSXXPXPXXNXGRIRCMQVWPIEGIKKFETLSYLPPLSTEALLKQVDYLIRSKWVPCLEFSKVGFVFREHNSPPXYYDGRYWTMWNCYXRVTDARGVNEVXE

SEQ ID NO: 186351 - protein, 148 aa, Triticum aestivum
  unsure (1)..(148): unsure at all Xaa locations
  Clone ID: PAT_TA_80769.pep
LPVSRRSSXQPRQRHNGGRIRCMQVWPIEGIKKFETLSYLPPLSTEALLKQVDYLIRSKWVPCLXFSKVGFVFREHNSSPGYYDGRYWTMWKLPMFGCTDATQVLNEVEEVKKEYPDAYVRVXRFDNLRQVQCVXFIASGTGCEESEG

SEQ ID NO: 186352 - protein, 147 aa, Triticum aestivum
  unsure (1)..(147): unsure at all Xaa locations
  Clone ID: PAT_TA_80770.pep
YVCGVNADLYTHADTIISNASCTTNCLAPFVKVLDQKFGIIKGTMTTTHSYTGDQRLLDASHRDLRRARAAALNIVPTSTGAAKAVALVXPNLKGKLNGIALRVPTPNVSVVDLVVQVSKKTLAEEVNQAFXRRNSRISTSGEPLST

SEQ ID NO: 186353 - protein, 158 aa, Triticum aestivum
  unsure (1)..(158): unsure at all Xaa locations
  Clone ID: PAT_TA_80771.pep
GLPVSRRSNGASSAAXHNGGRIRCMQVWPIEGIKKFETLSYLPPLSTEALLKQVDYLIRSKWVPCLEFSKVGFIFRXHNASPGYYDGRYWTMWKLPXFGCTDATQVINXVEEVKKEYPDXYXRIIGFATCAGESLHRLSHGLRGVRALLTTGHICIQF

SEQ ID NO: 186354 - protein, 126 aa, Triticum aestivum
  unsure (1)..(126): unsure at all Xaa locations
  Clone ID: PAT_TA_80772.pep
MAPTVMASSATSVAPFQGLKSTAGLPVSRRSNGASSAAXXNGGRIRCMQVWPIEGIKKFETLSYLPPLSTEALLKQVDYLIRSKWVPCLEFSKVGFIFREHNASPGYYDGRYWTMWXCYVRVTTHV

SEQ ID NO: 186355 - protein, 112 aa, Triticum aestivum
  unsure (1)..(112): unsure at all Xaa locations
  Clone ID: PAT_TA_80773.pep
INGQPDQGVCDVQHTVHSDELFVIRQHKRTVTRSRCVVYACGHPDELFALDXRQKRSYTXHXMQSIKIHPXQHSAHIXXXTCSFGXHTHASYXHRSLXXSXRXVXXMFYXXP

SEQ ID NO: 186356 - protein, 109 aa, Triticum aestivum
  unsure (1)..(109): unsure at all Xaa locations
  Clone ID: PAT_TA_80774.pep
MAASMITSPIVAPTSLPSLSRRGSSFAVVCSGGKKIKVDKPLGLGGGLTVDIDANGRKVGKKGVYQFVDKYGANVDGXXXIXXPXECICDPTRRTPYLGVTSLSGGVSR

SEQ ID NO: 186357 - protein, 96 aa, Triticum aestivum
  unsure (1)..(96): unsure at all Xaa locations
  Clone ID: PAT_TA_80775.pep
CEKXTNIAPGRLLLAVLSYVGLLAAMLGVXIQNRSMLLACYILIKTVSSRIFGEAFQISLNFGEILEEQFWSMYISDMYRRLIAMQFLYYFYSLCS

SEQ ID NO: 186358 - protein, 163 aa, Triticum aestivum
  unsure (1)..(163): unsure at all Xaa locations
  Clone ID: PAT_TA_80776.pep
PTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQXLIFAGXSLRXWRTLADYNIRXVTLHLVLVCAWQ

SEQ ID NO: 186359 - protein, 124 aa, Triticum aestivum
  Clone ID: PAT_TA_80777.pep
KTPCPPRVHHFMWRFALNSHPLLRNVERLGVELDILCPLCHRQAEDGGHLFLRCKEVKIRWRYCGLEYTRQQLLLCDTPSEVLAAVFKLPEEIKLRTICLLWSWWSERNNANHQKRCLDAEGLV

SEQ ID NO: 186360 - protein, 74 aa, Triticum aestivum
  Clone ID: PAT_TA_80778.pep
THGTGDGSTIVMSCSEVKTQLVEDCATTITKKMFSNEKVGPFYKVCPMSSSTIHILLIVTSIELFLTMVCSYRA

SEQ ID NO: 186361 - protein, 173 aa, Triticum aestivum
  unsure (1)..(173): unsure at all Xaa locations
  Clone ID: PAT_TA_80779.pep
MIILHSELPLTFCILCRNPIILTKSLSCLPRMVNTRNNPAPQEQAEGSEVRNANLPHPPSLAEVMMEAERNKRETNRLLERIEQNTSHNQRTNVVSLSDFIKLHPPTFHHSVEPLDADDXFAVFLTKLSALVAEADKVTFAAYHLEGPASLWWENYGAMRPAGHVTTWAEFSE

SEQ ID NO: 186362 - protein, 103 aa, Triticum aestivum
  Clone ID: PAT_TA_80780.pep
LSPLVVSSYLLIQRNDHYEATAGNNPPLVPTATSLRHQQLHLKTAPTLLLLRQQIKSEVSSATMQQLSLPSKRRNMLSARRKWKALVAAFHSKILGGFSSNSN

SEQ ID NO: 186363 - protein, 68 aa, Triticum aestivum
  unsure (1)..(68): unsure at all Xaa locations
  Clone ID: PAT_TA_80781.pep
GHDAELRSIEVVAARHDTYRDDDGAGVSASANSCMILLLLVGAMFHRAQASSPGSQDCRXTXXXXEVL

SEQ ID NO: 186364 - protein, 73 aa, Triticum aestivum
  Clone ID: PAT_TA_80782.pep
RSHGSFMHFYFWSICDYFQVHGKIWPFFEWSNIWPLLVIRPIVGFFIHSKNWCKLGFCFFFLFHNKKACRLLR

SEQ ID NO: 186365 - protein, 163 aa, Triticum aestivum
  unsure (1)..(163): unsure at all Xaa locations
  Clone ID: PAT_TA_80783.pep
VAPFQGLKSTAGLPVSRRSSAASAASXNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVTFIAFRPXPGCEEFRQG

SEQ ID NO: 186366 - protein, 177 aa, Triticum aestivum
  unsure (1)..(177): unsure at all Xaa locations
  Clone ID: PAT_TA_80784.pep
DPLDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKETKNPWVFEPEYPGKSRIFDGRTGDPFEQPVLIGKSYILKLIHQVDEKIHGRSTXGPYSLVTQQP

SEQ ID NO: 186367 - protein, 177 aa, Triticum aestivum
  unsure (1)..(177): unsure at all Xaa locations
  Clone ID: PAT_TA_80785.pep
QYPSLYSIVQRHDAYVATILQSXPLNIHFRRTLVGNRWEAWLHLVSRPMEVQLSHQPDXLCWKLTRTGEFTVKSMXINSSAIPNSAYVWKVKVPLKIKVFMWFVHKQVILIKDNLVKRNWTXSTRCSFCDRDETIKHLFXDCLWAKVLWQTVHIAFNITPLNSVSTLFGTWLVGIES

SEQ ID NO: 186368 - protein, 167 aa, Triticum aestivum
  unsure (1)..(167): unsure at all Xaa locations
  Clone ID: PAT_TA_80786.pep
HGEQDIEASGPEAGEFSAKDYTDPPPAPLIDADELTKWSLYRAVIAEFXSATLALPLTFTVGHRSSGYKHQTDAGGXGPRXACGGVGILRHRVGFXGMIFILVXCTAGISVGTFNPAVTLAVPGRGSVXXRXLLXIXGMPGXIWGWLXKXFQRAKKXVRGXAKSLRF

SEQ ID NO: 186369 - protein, 100 aa, Triticum aestivum
  unsure (1)..(100): unsure at all Xaa locations
  Clone ID: PAT_TA_80787.pep
VDHLQERLGVXAAAXAPXXAVXAPAGXXXEXEAPAXKXREFDVVIEEXXSSXRIGHHQXGXXAEPTWTXKDDXGTSXXGLPKKLKEAVSKXTKPXXAKKQ

SEQ ID NO: 186370 - protein, 94 aa, Triticum aestivum
  Clone ID: PAT_TA_80788.pep
TGTQIIQGSNNGSTMNNPDAHHVDYLGQESFDHFSRTSLFCEGTTSGDLGNVGSPTRQLKYQSTSLDPEITECSPEQPVGVMENTLKANYFKQG

SEQ ID NO: 186371 - protein, 101 aa, Triticum aestivum
  unsure (1)..(101): unsure at all Xaa locations
  Clone ID: PAT_TA_80789.pep
LEPPLLRLERADHDSGGSQEQGCKRGSSFLMSSPSEPNEGCGXTPGXXCXLGXAGXLXXFXXFXGFSRETXXXNSPRPXGKVXSTALXNRXXLKGGRPRGP

SEQ ID NO: 186372 - protein, 82 aa, Triticum aestivum
  unsure (1)..(82): unsure at all Xaa locations
  Clone ID: PAT_TA_80790.pep
RRXPGLGRAXXGXPQXAXPAAXRXPAAVXVAGEHERERRRVAQDGEKAXLPRAXTTPGTPTRXNXKPXXXGXKXNRXTAXAX

SEQ ID NO: 186373 - protein, 153 aa, Triticum aestivum
  unsure (1)..(153): unsure at all Xaa locations
  Clone ID: PAT_TA_80791.pep
CMQVXPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVXFIASSTGCEESGKAKSSHGQHIKCIAFCHSDALVSFHYF

SEQ ID NO: 186374 - protein, 153 aa, Triticum aestivum
  unsure (1)..(153): unsure at all Xaa locations
  Clone ID: PAT_TA_80792.pep
MAPTVMASSATSVAPFQGLKSTAGLPVSRRSSSXRPQQRXNGGRIRCMQVWPIEGIKKFETLSYLPPLSTEALLKQVDYLIRSKWVPCLEFSKVGFVFREHNSSPGYYDGRYWTMWXXPMFGRRTQSTRWRKKIPDAMSRMVHTSSRIILQRQ

SEQ ID NO: 186375 - protein, 131 aa, Triticum aestivum
  unsure (1)..(131): unsure at all Xaa locations
  Clone ID: PAT_TA_80793.pep
AGAARAAIXEADDDLXLLERVKEDKKKRLQKQGIINSSXAETGYLQDXVYKLSXVGQAIDKDDLAAAGDXLXTASDXPXVXXINXGCXKFSSSTEEXSXVDXNSXXVSLXTSXSKSXIXXSKXXFVCHEWM

SEQ ID NO: 186376 - protein, 156 aa, Triticum aestivum
  unsure (1)..(156): unsure at all Xaa locations
  Clone ID: PAT_TA_80794.pep
MAPAVMASSATTVAXFQGLKSTAGLPXSXRSSGSLGSVXNGGRIRCMQVWPIXGIKKFETLSYLPPLSTEALLKQVDYLIRSKWVPCLEFSKVGFVFREHNXSPGYYDGRYWTMWNCYXRXNDAXXXNEVRVRRVPDAMSRMVHNCAVSRIMQRFK

SEQ ID NO: 186377 - protein, 160 aa, Triticum aestivum
  unsure (1)..(160): unsure at all Xaa locations
  Clone ID: PAT_TA_80795.pep
GKHLEAGAKKVLITAPGKGDIPTYVCGVNADLYTHADTIISNASCTTNCLAPFVKVLDQKFGIIKGTMTTTHSYTGDQRLLDASHRDLRRARAAXXNIVPTSTGAXKAVALVLPNSREVNGMRPGATPTCRVLCQSQEDLPRGNRVREPRKSGISSRACR

SEQ ID NO: 186378 - protein, 89 aa, Triticum aestivum; identical to SEQ ID NO: 130083
  Clone ID: PAT_TA_80796.pep

SEQ ID NO: 186379 - protein, 83 aa, Triticum aestivum
  unsure (1)..(83): unsure at all Xaa locations
  Clone ID: PAT_TA_80797.pep
DXKLSXTXLXGEXWLAGTYIRNXPTRVYPIXKQPXYVLHIXLCSFHLLXRWCPLXGRYPRWWDAPPARXPPPXPPXATRGXTC

SEQ ID NO: 186380 - protein, 94 aa, Triticum aestivum
  Clone ID: PAT_TA_80798.pep
TEDFHFAVAVVHAACRCWVTADHPWHMARGASRKREPLCFICLKYLVEHGLSKFSISISLKTLRSMQEPTELRSGDTANPDQPGPSLLQEPSDR

SEQ ID NO: 186381 - protein, 53 aa, Triticum aestivum
  unsure (1)..(53): unsure at all Xaa locations
  Clone ID: PAT_TA_80799.pep
NQKATXLMXXIXXNXXXLTXXKNXXCQASKMYTTEHXXWEQXVYTESAXFTHE

SEQ ID NO: 186382 - protein, 174 aa, Triticum aestivum
  unsure (1)..(174): unsure at all Xaa locations
  Clone ID: PAT_TA_80800.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERXV

SEQ ID NO: 186383 - protein, 75 aa, Triticum aestivum; identical to SEQ ID NO: 106874
  Clone ID: PAT_TA_80801.pep

SEQ ID NO: 186384 - protein, 140 aa, Triticum aestivum
  unsure (1)..(140): unsure at all Xaa locations
  Clone ID: PAT_TA_80802.pep
MQIFVKTLTGKTITLEVESSDTIDNVKAKIQDKEGIPPDQQRLIFAGKQLEDGRTLADYNIQKESTLHLVLRLRGGAKKRRRRLHQAQEXKHKHKKVKLASSSLQVDDATGSTRLGRLPTLGAALMATLDRNMRNAATRS

SEQ ID NO: 186385 - protein, 123 aa, Triticum aestivum
  unsure (1)..(123): unsure at all Xaa locations
  Clone ID: PAT_TA_80803.pep
AVDVDIGANPSAEGGGDDEGVDDQAVKVVDIVDTFRLQEQPAFDKKQFISHMKRYIKNLSAKLEGDDLDAFKKNVESATKYLLSKLKDLQFFVGEXMHDDGGVVFAYYKEGXLXSTFLYFAHG

SEQ ID NO: 186386 - protein, 72 aa, Triticum aestivum
  Clone ID: PAT_TA_80804.pep
KKATTAAAAAPAKKAPAKAAAPKAAATAVAKKAAAPKKAAAPAKKTSAPKKATAAKSTAKAPAKKATAAKKK

SEQ ID NO: 186387 - protein, 47 aa, Triticum aestivum
  unsure (1)..(47): unsure at all Xaa locations
  Clone ID: PAT_TA_80805.pep
SRHAXERWRAEAWPPVLRXPRDEXRRSSTXALKGXGAKXTXVNNIIS

SEQ ID NO: 186388 - protein, 70 aa, Triticum aestivum
  Clone ID: PAT_TA_80806.pep
FFFFKQVQVGHQSIEASKLIFFNKFHTTDAFFFWTIKRLQFISIMPWHTGWAYSDVSKSFQVQSGGMRSQ

SEQ ID NO: 186389 - protein, 126 aa, Triticum aestivum
  unsure (1)..(126): unsure at all Xaa locations
  Clone ID: PAT_TA_80807.pep
TESKRNETFGRXIXGTNXIQRTLSGRQEXXEXATXXGCAPXRLGRXPTLXGPSXLHRPTSSSYIYSYTXKHPGDHETLFHHGXSVPMSSLGXFGVTXKXXEICRXIXSKXVDXFHXEADYLXLXXX

SEQ ID NO: 186390 - protein, 107 aa, Triticum aestivum
  unsure (1)..(107): unsure at all Xaa locations
  Clone ID: PAT_TA_80808.pep
TDXSLQVXKVNEHYMVPSXCDYNFXNLPSKFINRVPSLEXDSMQENHLNSFDLQGWGFEYMTLNCHDGSVHKTTCAYICIHCVFFKNMPKRLVDLCCFCCARHIAIN

SEQ ID NO: 186391 - protein, 85 aa, Triticum aestivum
  unsure (1)..(85): unsure at all Xaa locations
  Clone ID: PAT_TA_80809.pep
XPRDTTKTIHXFNXXPPXPLXFSGRGFXEHQHLQGNTVXXYXQAFXSCLXLIYQXINTNDXWXXRXXKENDSPYXLVXRSXFXRP

SEQ ID NO: 186392 - protein, 103 aa, Triticum aestivum
  unsure (1)..(103): unsure at all Xaa locations
  Clone ID: PAT_TA_80810.pep
MAVGKNKRISXGRKGSKKKAVDPFTKKQWYDIKAPLLFTSRNVGKTLVSRTQGTKIASEGLKHRVFEVSLADXQNDEDQAYRKIRLRAEDVKGVSPTLGMDSH

SEQ ID NO: 186393 - protein, 169 aa, Triticum aestivum
  unsure (1)..(169): unsure at all Xaa locations
  Clone ID: PAT_TA_80811.pep
EAGKPLSMEEVEVAPPHXMXVRVKILFTSLXHTDVYFWEAKGQTPXFPRIFGHEAGGIVEXVGXGVTXLAPGDHVLPVFTGECKVXPHCXFXEXNMCYLLXFXTDRCVMIXDGKXRFSIXGXPXYHFVGTSPSVSNCMIWLFARPPDLFLLFTIFSNTEICKAAKVKFS

SEQ ID NO: 186394 - protein, 73 aa, Triticum aestivum
  Clone ID: PAT_TA_80812.pep
DTLPTVFHGTTNTSARSRKRRQTLGKWTYEYTVASIMDLESVVLVVLQPEREGLEREEHLLEPLPGHGIDEVA

SEQ ID NO: 186395 - protein, 118 aa, Triticum aestivum
  unsure (1)..(118): unsure at all Xaa locations
  Clone ID: PAT_TA_80813.pep
XSKAYKXSRKMAFMRYDYRALPQETTXEXFRAWLAQFDADGDXRIXREELREALXXSTCGSPGGRPXRRCGTPTPTATASSTATRWPXSTPSXAPTSTSXXXTXTPILDCYQPPNNLL

SEQ ID NO: 186396 - protein, 135 aa, Triticum aestivum
  unsure (1)..(135): unsure at all Xaa locations
  Clone ID: PAT_TA_80814.pep
VSPIVFAAAGTVIDSGTVITRLPPRAYAXLRSAFARSMRRYGYKRAPALSILDTCYDFTGHTTVRIPSVALVFXGGAAVGLDFSGVLYVAKVAQACLAFGPTATARTSASSGTRAEDVAVVYDVANNKMGSAQRC

SEQ ID NO: 186397 - protein, 99 aa, Triticum aestivum
  unsure (1)..(99): unsure at all Xaa locations
  Clone ID: PAT_TA_80815.pep
EMXXXKCQIHXTISXLLPDEXSSDXIXXWGHYNXPQPXARSLGFDLLIXQXPIXSMFXQXRXHFXGRMHXNQXYAFHNTXHIXTTTNIPRIMSSPXQNR

SEQ ID NO: 186398 - protein, 109 aa, Triticum aestivum
  unsure (1)..(109): unsure at all Xaa locations
  Clone ID: PAT_TA_80816.pep
NARTXXXXYNERRMHPSXXNXTTRTRXQAIXHQQRKKKKRKXQETESGQCNRPRYITXTPSXXXTRRXXSXKKENSTTRGRGFCIHRGHWKEVGTDXSHPLRMRLXXTS

SEQ ID NO: 186399 - protein, 92 aa, Triticum aestivum
  Clone ID: PAT_TA_80817.pep
LLLGGPWGSKVRWVSLLEPYDQKDDRKGSFQAYKHKVKFISSSIQILFHRIIVSPALGMQVVTPLYMSMNENTSFCISFRKRTVQKFLKRNN

SEQ ID NO: 186400 - protein, 88 aa, Triticum aestivum
  Clone ID: PAT_TA_80818.pep
IFHSYIFITPSIVGIDEAITGTHAHTHTHKDTMGRAWESEQANHTHTHTHPCSTPSDQTLVIHVYSHTNTRTYECMQLNSCRGCTCSC

SEQ ID NO: 186401 - protein, 133 aa, Triticum aestivum
  Clone ID: PAT_TA_80819.pep
PRALKVCARLNWTQQEEKRLASAWLELSTDPIEGNGKKRDKYWDDIAVQYNSLTPADRHRDAVQLKSHFQKVKRKINIFHGAYNAMCKLYTSGYGEEQLQAFALEKYEANQQSAFQHLTMWRELKDNGKWLSN

SEQ ID NO: 186402 - protein, 153 aa, Triticum aestivum
  unsure (1)..(153): unsure at all Xaa locations
  Clone ID: PAT_TA_80820.pep
MAIKRTKAEKKIAYDQKLCQLLEEYTKVLIAVADNVGSKQLQEIRKGLRGDSIVLMGKNTLIRRCIKVHSEKTGNKDFLELSNLLVGNVGLIFTKGDLKEVREEVXKYKVGAPVVLGSXTVDVWFPWQHWSDPPDVFFRCHSTLTGVNYYPVS

SEQ ID NO: 186403 - protein, 153 aa, Triticum aestivum
  Clone ID: PAT_TA_80821.pep
VIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICAVTRWTHTPKYSKAVTRNCQLFVPEEGRYNLTRFLCSILG

SEQ ID NO: 186404 - protein, 114 aa, Triticum aestivum
  Clone ID: PAT_TA_80822.pep
MADQLTDDQIAEFKEAFSLFDKDGDGCITTKELGTVMRSLGQNPTEAELQDMINEVDADGNGTIDFPEFLNLMARKMKDTDSEEDSRRLRVFDKDKTVHSAAESARMTSASDEE

SEQ ID NO: 186405 - protein, 90 aa, Triticum aestivum
  unsure (1)..(90): unsure at all Xaa locations
  Clone ID: PAT_TA_80823.pep
HEMLCLSLHPRVNPIVXLAHSGSXCHCLVLISCRSARISXTSWEQMQMYTSQINHPTIVTIESNNQNLTEELLLAPRSISIPLIWLLSFS

SEQ ID NO: 186406 - protein, 72 aa, Triticum aestivum
  Clone ID: PAT_TA_80824.pep
QWREECQLKVKRKTDSKSCKILWLNNAAIFVAYVENGHLPGQFFLEESQPCNLQCNENVSVYTATLEKCHII

SEQ ID NO: 186407 - protein, 147 aa, Triticum aestivum
  unsure (1)..(147): unsure at all Xaa locations
  Clone ID: PAT_TA_80825.pep
SLGTDNKIWIGAETSDGINFKISLCTEAPPGFSHLFLKTDDAVAVTPTSTVFRDGVKKKLRAEALASCYNAILMQTIVDTQTYPYFYHDYFLLKNDVPSPVISRLPEIPGGPDLILALHQSGHYTVAVLKEGCIATXRLPRIXRGXH

SEQ ID NO: 186408 - protein, 134 aa, Triticum aestivum
  unsure (1)..(134): unsure at all Xaa locations
  Clone ID: PAT_TA_80826.pep
MARTKQTARKSTGGKAPRKQLATKAARKSAPATGGVKKPHRFRPGTVALREIRKYQKSTELLIRKLPFQRLVREIAQDFKTDLRFQSSAVSALXEAAEAYLVGLFEDTNLCAIHASASHHAKDISTIMEGLRSN

SEQ ID NO: 186409 - protein, 151 aa, Triticum aestivum
  unsure (1)..(151): unsure at all Xaa locations
  Clone ID: PAT_TA_80827.pep
KTTAGKKPKAEKRAPASKEAGGEGKTRGRKKGSKAKKGVETYKIYIFKVLKQVHPDIGISSKAMSIMNSFINDIFEKLAGESAKLARYNKKPTITSREIQTSVRLVLPGEXAKHAVSEGTXAVTKFTHPWLVVVYDELGRKRRVCSYSSRC

SEQ ID NO: 186410 - protein, 75 aa, Triticum aestivum; identical to SEQ ID NO: 106874
  Clone ID: PAT_TA_80828.pep

SEQ ID NO: 186411 - protein, 131 aa, Triticum aestivum
  unsure (1)..(131): unsure at all Xaa locations
  Clone ID: PAT_TA_80829.pep
IQAEVEHAXSXLKYFLVMRSFASFPACDASILATSFEIQAHKGYYSDSISQWYSCVLSWKIPTHECPNGQSPHGLYVLESLCFPLAGIILFICFFVLREKTWRCWVIFFSNLKNGRDAFDGVSGMGIVHKT

SEQ ID NO: 186412 - protein, 131 aa, Triticum aestivum
  unsure (1)..(131): unsure at all Xaa locations
  Clone ID: PAT_TA_80830.pep
EPSAAAATSALSFLLRSKMKFIAAYLLAYLSGNASPSAEDLTSILESVGCEIDNXKMELMLSQVKGKDITELLAAGREKFAAVPSGGGGVAVSAAAPAAGGAAAPAAESKKEEKVVEKEESDDDXGFSLFD

SEQ ID NO: 186413 - protein, 62 aa, Triticum aestivum
  unsure (1)..(62): unsure at all Xaa locations
  Clone ID: PAT_TA_80831.pep
GSXYXEVEAVXYXITXXHXGLKSXSXKTKXFIXPKSNHCQGLKTLHLTKSTHYYQYKPNPLS

SEQ ID NO: 186414 - protein, 127 aa, Triticum aestivum
  unsure (1)..(127): unsure at all Xaa locations
  Clone ID: PAT_TA_80832.pep
MKFIAAYLLAYLSGNASPSAEDLTSILESVGCEIDNEKMELMLSQVKGKDITELLAAGRXKFAAVPSGGGGXAVSAAAPAAGGLCXCXESKKEEKVVEKEVYDMGSVCSIVGSCVSSLAETRVILAY

SEQ ID NO: 186415 - protein, 137 aa, Triticum aestivum
  unsure (1)..(137): unsure at all Xaa locations
  Clone ID: PAT_TA_80833.pep
HLFKANGTALDWSLRYQIATGVARGLAYLHTGCRDCIIHCDIKPENILLDTSFVAKIADFGMAKVLGREFSQALTTTRGTIGYLAPEWISGSXVTSKVDVYSYGMVLFEIISGRRIQVKLWMVIIQPFSSTRLSVEN

SEQ ID NO: 186416 - protein, 99 aa, Triticum aestivum
  unsure (1)..(99): unsure at all Xaa locations
  Clone ID: PAT_TA_80834.pep
EPGDEFVNEEPVEYAYEDQAFDNSENLAVAGADDTSAGDATELKWEFDEERGRYYVSFPDXQXWSPVGTIGXLXLGYLXFIGXXRVRLCXDVDMMXIMN

SEQ ID NO: 186417 - protein, 155 aa, Triticum aestivum
  unsure (1)..(155): unsure at all Xaa locations
  Clone ID: PAT_TA_80835.pep
REAVSEPLLRVMRDVSGGKAAIGYIYESMTKVMDSIRTYYIMDEGKCKSFLDIVEQKWLVELHSPLHSAAAFLNPSIQYNPEVKFFTTIKEEFYHVLDKVLTVPDQRQXITSELHAFRKAQGMFASNIAKEAXXTPXPGMCWDNMXFSALHTGLE

SEQ ID NO: 186418 - protein, 57 aa, Triticum aestivum
  unsure (1)..(57): unsure at all Xaa locations
  Clone ID: PAT_TA_80836.pep
DXECYXVGRPFIXXAGMADKVDXREGTDLARXDELLXXDEGAARXDFAXXDADKXNY

SEQ ID NO: 186419 - protein, 102 aa, Triticum aestivum
  unsure (1)..(102): unsure at all Xaa locations
  Clone ID: PAT_TA_80837.pep
FYVDVTNKTEQCVRYKLRAALHIYHQIVVRTTRQIQNTIEIRDVRFLHAPILTFRLDPSCLAAHXLIRPDWSLRGHLAGSPARPSASTPRRGGASPPPSRPP

SEQ ID NO: 186420 - protein, 85 aa, Triticum aestivum
  Clone ID: PAT_TA_80838.pep
FFHRRPAVVQQLDNKAVPLPWRVPHEIQSLLRIEEEFGTKGFTLRKLENYRELTRGSLDSVDAVRGVSVEMCFVLAQQRQGKRVA

SEQ ID NO: 186421 - protein, 105 aa, Triticum aestivum
  unsure (1)..(105): unsure at all Xaa locations
  Clone ID: PAT_TA_80839.pep
IXQFACTRFKXEYPXIFDKXDVNGNXVXALYKFLXSSKGGFSAIXIKWNFSKFLVDKEGSVVXRYXPXHFGLSIEKDXKKCLGVLDPLAGASEIGTLYSTNKNLK

SEQ ID NO: 186422 - protein, 89 aa, Triticum aestivum
  Clone ID: PAT_TA_80840.pep
VGSQPLWSEFQDLYVQAVNPEMSVASALASSPPAICLRRELSGTEQAQLPELLSLITPVSLSSSEDTVHWPLTPSGKFSVKSLYREVVR

SEQ ID NO: 186423 - protein, 55 aa, Triticum aestivum
  unsure (1)..(55): unsure at all Xaa locations
  Clone ID: PAT_TA_80841.pep
GWXNQRLXWVXXSGHXLXASFGXLPXAKXVGLCKAPRGVVACSWPRLCLLLLLNT

SEQ ID NO: 186424 - protein, 92 aa, Triticum aestivum
  unsure (1)..(92): unsure at all Xaa locations
  Clone ID: PAT_TA_80842.pep
PRKNRXPVSLSGEKXXSGTILYCRKKIRXVPIERAPKHWGLLGQPIRVVCCWTGGTSPRGSARRPXXTXPTARCTRPCSSASSSRAVVPPTT

SEQ ID NO: 186425 - protein, 96 aa, Triticum aestivum
  unsure (1)..(96): unsure at all Xaa locations
  Clone ID: PAT_TA_80843.pep
YTTNXYNFTXTNQHXHRRXNSKHXKNXISTXRRYYTLPXSIHTTNTXHSSYLLTXXTTTXTXKNXIXQEXLAXPSSXRTPXREEPGNXRGRXQGRX

SEQ ID NO: 186426 - protein, 84 aa, Triticum aestivum
  Clone ID: PAT_TA_80844.pep
LVLVVPLQNGHCWLPSRPIFGKRTRASINRDSHHSRKGIRSNPSLVEHCTSSRTPLARLFFLCTVPHRPQRQSTTPHTGLGYYT

SEQ ID NO: 186427 - protein, 92 aa, Triticum aestivum
  unsure (1)..(92): unsure at all Xaa locations
  Clone ID: PAT_TA_80845.pep
IPXXGXGFRENVVGSGGXTAAKVLLSXRSXSXGXGYTSXVGQAXPCXARXXPWASTSFTXLHPXHLRXXYLPXLSXCWGTLDCFSIXFQXPX

SEQ ID NO: 186428 - protein, 121 aa, Triticum aestivum
  unsure (1)..(121): unsure at all Xaa locations
  Clone ID: PAT_TA_80846.pep
AEFKXAFSLFDKDGDGCXTTKELGTVMRSXGQNPTEAELQDMINEVDADGNGTIDFPEFLNLMARKXKDTDSQEELKEAFRVFDKDQNXFISAAELRXVMTKLGEKLXDEEVXXMIREAER

SEQ ID NO: 186429 - protein, 101 aa, Triticum aestivum
  unsure (1)..(101): unsure at all Xaa locations
  Clone ID: PAT_TA_80847.pep
YFXQAHRXAXTWIXXPARHISGSXTPXARPSXPWALXVGXXXTXXPDKXLHXCSTXEIXGVHXLETPXTRLPGGXXIAXSFVPFMVAXXLFXQXSHFTRAC

SEQ ID NO: 186430 - protein, 126 aa, Triticum aestivum
  unsure (1)..(126): unsure at all Xaa locations
  Clone ID: PAT_TA_80848.pep
EKAPVPAGKKPKAEKRLPAGKTAAGKXGGDKXGKXKAKXSVETYNTYIFKVLKQVHPDIGISSKAMSIMNSFINDIFEKLAGEAPKLARYNKKPTITSREXQTSVXLVXPGEXGKHAVSXXXRXSS

SEQ ID NO: 186431 - protein, 156 aa, Triticum aestivum
  unsure (1)..(156): unsure at all Xaa locations
  Clone ID: PAT_TA_80849.pep
VDKAAAWQLFTTQAANXGXTVXXHFGASWXVTXLSMXYKFEELXQXHXDMLFXFVDXDDVKGVXXKLGVKXMXXFFLMKGXEVVKKIXGXKXEELHKMVESEEDGSAVTPDIVRKIVVLVNVLECVGWFGVCVCVNNLSDLIDGVPFVEIGLVMVR

SEQ ID NO: 186432 - protein, 144 aa, Triticum aestivum
  unsure (1)..(144): unsure at all Xaa locations
  Clone ID: PAT_TA_80850.pep
DDTNMVREENNKAIVSSLCKLSTQNLRSLNIYAGSSLLTEPLCLPTLEKLITWSSDISQVPTWVSSLRNLQVLRLTLKGIKKSDLCILGALPALLILHLEEVTRXNEKIRISGEVGFHFLRIFYYEAHYEPVDLILXGEGHXQX

SEQ ID NO: 186433 - protein, 44 aa, Triticum aestivum
  unsure (1)..(44): unsure at all Xaa locations
  Clone ID: PAT_TA_80851.pep
KKKXVEXEENTXYXYLXXPKKYIXXTKXVLTGXXKPQDRXDXIE

SEQ ID NO: 186434 - protein, 143 aa, Triticum aestivum
  unsure (1)..(143): unsure at all Xaa locations
  Clone ID: PAT_TA_80852.pep
LTSLQELQFSASENERHCYLSKLQCLPAGLDKLINLKRLMINCCSSIRSLPSLPSSLQELVIDNCYALQSLPNSLPSSLEILSIXAVSIKSLPESLPSSLKKMKISGCWAIKSLPKDGLXSSMLELDVNLGLDSDNLRKEWRS

SEQ ID NO: 186435 - protein, 36 aa, Triticum aestivum
  Clone ID: PAT_TA_80853.pep
RLLILAQLVAASFSRGRTPPWQSQRRRSRRRPGSRR

SEQ ID NO: 186436 - protein, 67 aa, Triticum aestivum
  unsure (1)..(67): unsure at all Xaa locations
  Clone ID: PAT_TA_80854.pep
FFFFQXNKXXTHKXMRSNIXHKYLSYVXISTSPXHMLCNSSLXXEIPXGQRSIIECSSXRXWSFAVI

SEQ ID NO: 186437 - protein, 78 aa, Triticum aestivum
  unsure (1)..(78): unsure at all Xaa locations
  Clone ID: PAT_TA_80855.pep
MSCCGGNCGCGTACXCGNGCGGCNMYPEVEAAGATLLVSATATHKASSGGMEMAAENGGCGCTQCKCGTSCGCSCCSC

SEQ ID NO: 186438 - protein, 141 aa, Triticum aestivum
  unsure (1)..(141): unsure at all Xaa locations
  Clone ID: PAT_TA_80856.pep
TKTILVXXRXNTVSXFAMARRLAVVLVVAAVXLLLVTATAARXDKPEGXQGRQAQGACXXTAQXPGAQXEGAQGRQAEGPAXRPPXAQGPKSKKSRCTXSERXLQXGXKIVXNVILEKSYXXXIXVVIVEXLXLXFLYICF

SEQ ID NO: 186439 - protein, 66 aa, Triticum aestivum
  Clone ID: PAT_TA_80857.pep
VFTFPHFRSAFRVFNFFRVLHGSSTFLRGSSTAASSDPKRTYNLCGNRFASISDASRFLSLVQRPH

SEQ ID NO: 186440 - protein, 131 aa, Triticum aestivum
  unsure (1)..(131): unsure at all Xaa locations
  Clone ID: PAT_TA_80858.pep
GPPRRRRPPFXPHATVVGAVPCAAPPQSRPSAPPRAADVAPYTARVTGVXRGXXFYQCVYLLLEPTPEVIHTSDHFCXHFGFQXSTPYMPHVSLLYGDLTDEEKEAXRXKVEXMXSXLSGLQFXISELALY

SEQ ID NO: 186441 - protein, 79 aa, Triticum aestivum
  Clone ID: PAT_TA_80859.pep
SDMTILMLYDAMVLAYKLFAYLSLLLKSLGGSSLWSSFLMQNFTNQDSNCVCYDHFVTHKLISRYAPLCYDMYAMLYDH

SEQ ID NO: 186442 - protein, 93 aa, Triticum aestivum
  unsure (1)..(93): unsure at all Xaa locations
  Clone ID: PAT_TA_80860.pep
RXIGXLERIXLGTKXXXMFXQLSYXKQQPXFWKLWQAXXLXSTTLLKSLAXHXFEPFXSHSANALXXXEKKASXPDELVLPIWFFTSXFLHXL

SEQ ID NO: 186443 - protein, 100 aa, Triticum aestivum
  unsure (1)..(100): unsure at all Xaa locations
  Clone ID: PAT_TA_80861.pep
XRVAXXRRGRXGXPWDXALXAPVLXAKXXLEXISCTRAYMXRCMXXRLGCPRVHPVSFVICXRXFXXFECNXSXVXWLXVFSPQFXXTQLTRCXKXXKKK

SEQ ID NO: 186444 - protein, 98 aa, Triticum aestivum
  unsure (1)..(98): unsure at all Xaa locations
  Clone ID: PAT_TA_80862.pep
LPFQCNETKTRKTARRRSSWSPGRRHHQSFVQVKTTFVKGXSTKLSPFKLSLQFLVPFRFIIXEKDKGFIKKDKQPTEKKGSKGSXXRERXXEKXXGG

SEQ ID NO: 186445 - protein, 106 aa, Triticum aestivum
  Clone ID: PAT_TA_80863.pep
RIAPLRAGRSGRGVERRGHARECGGTTCTGESGRGSRGCALWIWQQGKGRDGRASPRHSTRMRAAAQVASSRWGIGASGPAVGGASGTGQRWDARQAEEWDGRRRV

SEQ ID NO: 186446 - protein, 120 aa, Triticum aestivum
  unsure (1)..(120): unsure at all Xaa locations
  Clone ID: PAT_TA_80864.pep
PKLVKGSSCSSERRQXAXVEERRQRLMAVSEELNVVDGEKARPWKCCDQTMCNQGLPRRPASCQRQGEEVAPRPARNCLQGTTSGQLPFRVCGDPVLSAGPXAQSAPRSSVRRRRSARXV

SEQ ID NO: 186447 - protein, 111 aa, Triticum aestivum
  unsure (1)..(111): unsure at all Xaa locations
  Clone ID: PAT_TA_80865.pep
MAPKVAVAKKGDAKAQAAKVAKAVKSGSIKKTAKKIRTSVTFHRPKTLSKARDPKYPRIQHPWGGNKLXDQYQILKLPALPXSXAMEEXRRDNNTXVFHSFGPGRPDKKKI

SEQ ID NO: 186448 - protein, 87 aa, Triticum aestivum
  unsure (1)..(87): unsure at all Xaa locations
  Clone ID: PAT_TA_80866.pep
FVLVSPVFXAXXAQRXTEHSHVPLXAPLPIGFAVFLVXLATLPIXGXGXPPXRSLXXAXLYHXNAXAWDAXWXFWVGPFXGEXLAAI

SEQ ID NO: 186449 - protein, 112 aa, Triticum aestivum
  unsure (1)..(112): unsure at all Xaa locations
  Clone ID: PAT_TA_80867.pep
RXNFRXCIKPHIYLPQNSNHXYILWPFXXPFRXIFTCNFHRSHFIMTHTIIVILLXNDHVXGDXVGATNIHVCCPECXTSAMAXXTTXPXSPSRXXXXXDXXLXSIQXXDSX

SEQ ID NO: 186450 - protein, 80 aa, Triticum aestivum
  unsure (1)..(80): unsure at all Xaa locations
  Clone ID: PAT_TA_80868.pep
MGGGNAQKSKMARERNLEKLKGGKGSQLEANKKAMNIQCKICMQTFICTTSXEAKCKEHAEAKHPKSELVPVAFPSPSSS

SEQ ID NO: 186451 - protein, 83 aa, Triticum aestivum
  unsure (1)..(83): unsure at all Xaa locations
  Clone ID: PAT_TA_80869.pep
XVGANILVGXAFXGASMNPAVSFGPALVSWEXGYQXVYWVGPLIGGGLAAFILRAALHLPGTHEQLPHHRILSSELSSSLLLP

SEQ ID NO: 186452 - protein, 79 aa, Triticum aestivum
  unsure (1)..(79): unsure at all Xaa locations
  Clone ID: PAT_TA_80870.pep
MSCCGGNCGCGTACKCGNGCGGCNMYPEAEAAGATLLVSATATHKASSGGXMEMAAXXGGXXXTQXKXGTSRLLPAGSC

SEQ ID NO: 186453 - protein, 135 aa, Triticum aestivum
  unsure (1)..(135): unsure at all Xaa locations
  Clone ID: PAT_TA_80871.pep
GGGGGGGRKGKKKGSVSFVIDCTKPVEDKIMEIASLEKFLQERIKVAGGKAGNLGDSVTVTRDKSKVTVTSDGAFSKRYLXKYLTKKYLKKHNFGDWLXRVIRSQQGAQVYELRXFKXAENEGPRRRTVKSLLRF

SEQ ID NO: 186454 - protein, 116 aa, Triticum aestivum
  unsure (1)..(116): unsure at all Xaa locations
  Clone ID: PAT_TA_80872.pep
LLSSTTIQSKSSSSDMAFHQRSTSLPSRPHVSXXEVELELQSLEASISSSNSISMMCDGLRTLANIYDGLEEIICLPSNQVWLLPAEEHVGMGEMGRFSWSWLRSLAAPCKRSLSR

SEQ ID NO: 186455 - protein, 91 aa, Triticum aestivum
  unsure (1)..(91): unsure at all Xaa locations
  Clone ID: PAT_TA_80873.pep
ICTASNLHFIYLFTAVIXSIFCSXLPLCFCDLXCAXYRIYXRSXQCXXXAXNNKXPXLFXXKXXXHXPHNPPPPPPPPPPPTHPPTPXPXP

SEQ ID NO: 186456 - protein, 102 aa, Triticum aestivum
  unsure (1)..(102): unsure at all Xaa locations
  Clone ID: PAT_TA_80874.pep
AKIYLQTKQISCRLPLRPPXXPTLLSLSLSIQLALILNQLVSPWTNRQALVSAQFFSPPLGIDAHMNGDAAIYYMLILVNHKNKGFLSLVFIACGAQRGDGM

SEQ ID NO: 186457 - protein, 146 aa, Triticum aestivum
  unsure (1)..(146): unsure at all Xaa locations
  Clone ID: PAT_TA_80875.pep
MSDTDEHHFESKADSGASKTYPQQAGAIRKXGHIVIKARPCKXVEVSTSKTGKHGSRKCSXVAIDXFNGKKXRXSFLSSHXVTSPMLDRQDYQLIDITDXGYVSLLXESGNTKDDLKXPXDEFCFXQXQXGIADGARTDPVCEPPV

SEQ ID NO: 186458 - protein, 147 aa, Triticum aestivum
  unsure (1)..(147): unsure at all Xaa locations
  Clone ID: PAT_TA_80876.pep
YLRTYKVGEHVDVKVNGAVHKGMPHKFYHGRTGRVWNVTKRAIGXEINKQVGNRIIKKRIHVRVEHXQPSRCNEEFLQRKLNNDKLKXRPSAGEVIQHQEQPAGPKXGSWWRGTTXETFTPIPVTTSFNDLQGWFTRALFEQKEPFL

SEQ ID NO: 186459 - protein, 110 aa, Triticum aestivum
  Clone ID: PAT_TA_80877.pep
DLERGCVDEQNSEAQVYNSKLERLLRTLQGSLKGSKIVYLNAYEAFTVILQRTNKYGFTETTLGCCGTGAHRVRNYFGNIFYPYSGRECVLIIFHWRCTRQRGFYRSNFT

SEQ ID NO: 186460 - protein, 75 aa, Triticum aestivum
  unsure (1)..(75): unsure at all Xaa locations
  Clone ID: PAT_TA_80878.pep
MSCNCGSGCSCGSDCKCGKMYPDLTEQGSXAAQVAAVVVLGVAPXNKAGQFEVAAGQSGEGCSCGDNCKCNPCNC

SEQ ID NO: 186461 - protein, 137 aa, Triticum aestivum
  unsure (1)..(137): unsure at all Xaa locations
  Clone ID: PAT_TA_80879.pep
FFFFXRXXHXIXRLXLXXYIXHAKXXTTXLIINSHXXXTXDXSXGXATXXRGXTLGXVLAGGGGXAPXXLAGDEVEVLVGVXVGALPGELAAAAXLLGVAAHPGAXLXVXALLRXLAVPAALLPAVHGRPCNNKFKX

SEQ ID NO: 186462 - protein, 48 aa, Triticum aestivum
  Clone ID: PAT_TA_80880.pep
DATPALIKSIKDIDNIYYETEYRKEWCTSNERPAPCFLFARKFTRGPV

SEQ ID NO: 186463 - protein, 88 aa, Triticum aestivum
  unsure (1)..(88): unsure at all Xaa locations
  Clone ID: PAT_TA_80881.pep
EXIERGKGSTLGTNSSKQTWRTPEHVDVRXDXHVDXXTSRGTXAAXEAKTGDXEQDKXXGSSNXSAXXGGSXXRRTXXHFXPAGATGD

SEQ ID NO: 186464 - protein, 129 aa, Triticum aestivum
  unsure (1)..(129): unsure at all Xaa locations
  Clone ID: PAT_TA_80882.pep
SSPSTRHXITXGXLRXSXARHGPGASYLQLXXXGXCQVGHPIVGLPMHXFGCIPXPQCLPXLQCVXCNFSGAHXYXXSAIYCXPMHAFIAPXCKHHFSCASHXRNLNVLXMCKFINKHKCLYWGCAKKK

SEQ ID NO: 186465 - protein, 95 aa, Triticum aestivum
  unsure (1)..(95): unsure at all Xaa locations
  Clone ID: PAT_TA_80883.pep
GKKKAKKSXETYKIYIFKXXKQVHPDIGISSKAMSIMNSXINDXFEXXXGEXAKLXXYNKKPTIVGKIPDLTLPLRPHDTEGARHQVTPSYLRVP

SEQ ID NO: 186466 - protein, 47 aa, Triticum aestivum
  Clone ID: PAT_TA_80884.pep
LFDMKFQAIHYTKPESLYESILNFLRCSLSSALKYKVCETLKSIKSK

SEQ ID NO: 186467 - protein, 57 aa, Triticum aestivum
  unsure (1)..(57): unsure at all Xaa locations
  Clone ID: PAT_TA_80885.pep
FFFFSSSCICLIDVWYNFGQQSWGWETMAVFYSLTCTXCIDRSWRNGGRKVDRSKPX

SEQ ID NO: 186468 - protein, 180 aa, Triticum aestivum
  unsure (1)..(180): unsure at all Xaa locations
  Clone ID: PAT_TA_80886.pep
VESSDTIDNVKAKIQDKEGIPPDQQRLIFAGKQLEDGRTLADYNIQKESTLHLVLRLTGGMQIFVKTLTGKTITLEVESSDTIDNVKAKIQDKEGIPPDQQRLIFAGKQLEDGRTLADYNIQKESXTLHLVLRLRGGSKCWPWSCYVCGLKVGCFLCLRSCSVSRLCCVCCMYVCVTRRD

SEQ ID NO: 186469 - protein, 57 aa, Triticum aestivum
  unsure (1)..(57): unsure at all Xaa locations
  Clone ID: PAT_TA_80887.pep
NYSSYXTHLDXGAVDXXXTXLXMPVSXSPXXKSIKQLNRXVXKVDSEXQAXQTWKFW

SEQ ID NO: 186470 - protein, 91 aa, Triticum aestivum
  unsure (1)..(91): unsure at all Xaa locations
  Clone ID: PAT_TA_80888.pep
MADVDVXTEVAXGAQXXXRTFRKSSYRXVXLDALLDMSTDDLVQMFPARXXRRFKRGLKRKPMALVKKLRKAKKEAXXGEKXEXVRTXXVT

SEQ ID NO: 186471 - protein, 138 aa, Triticum aestivum
  unsure (1)..(138): unsure at all Xaa locations
  Clone ID: PAT_TA_80889.pep
XXSXSXSSCTMFIGKSGXLKLIVVELTNQKNFNMXGGQNESFISVRNKTDQTTRQTQCXRLYWLKKKWHRSLRHARLSPCRRNLLAHATWVQDSTNRPKHSGRLPETREPQSLGPPFPLHASPDVKGGMVGVVLRCGP

SEQ ID NO: 186472 - protein, 117 aa, Triticum aestivum
  unsure (1)..(117): unsure at all Xaa locations
  Clone ID: PAT_TA_80890.pep
GYIGSPQGGGHYSHALPRAEPSFIQRARQQLTSPQQDPLGGGAGLFGPAEPTTGGDPPLGGAPRXRXREGGGSNYINNLGPXLGRITFLTPGXXPXXNPPGEXXXRGDXEKIXKNXP

SEQ ID NO: 186473 - protein, 156 aa, Triticum aestivum
  unsure (1)..(156): unsure at all Xaa locations
  Clone ID: PAT_TA_80891.pep
KPSHGPIHFRAPAKILWRTIRGMIPHKTXEGEAALARLKAYXGVPPPYDRTKRMVIPDALKVLRLQPGHRYCLPRPALPRRFGWNYADTIQGXWRKRGREKAKXSLRQGESXWAKXXFKAEKGSRGRIWEWRFLAILLKRYSEFVALVFWGTSVYF

SEQ ID NO: 186474 - protein, 66 aa, Triticum aestivum
  unsure (1)..(66): unsure at all Xaa locations
  Clone ID: PAT_TA_80892.pep
VXREXDXERVXERQXEEEDDHEXGEXEXARXGQSPLXRLPVAEQIQPEVATGGSXRQXXPGKSSTA

SEQ ID NO: 186475 - protein, 116 aa, Triticum aestivum
  unsure (1)..(116): unsure at all Xaa locations
  Clone ID: PAT_TA_80893.pep
GRYAGKKAVIVRVFEEGTRDRPYGHCLVAGLAKYPKKVIRKDSAKKTAKKSRVXVFLKLXNXXTNLXPTXXTXXVDXKEVAXGAPXSLTXKXKKVGXXKAAKAXLEXXFKTXKRVF

SEQ ID NO: 186476 - protein, 42 aa, Triticum aestivum
  Clone ID: PAT_TA_80894.pep
RWDFLVVDEDGRSLSKLIVAPLLVAYAAAENHCLRSLQQRTL

SEQ ID NO: 186477 - protein, 139 aa, Triticum aestivum
  unsure (1)..(139): unsure at all Xaa locations
  Clone ID: PAT_TA_80895.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVXLAVLQXYKVDDATGKVTRLRKECPTLGGLHKPFTALMGLT

SEQ ID NO: 186478 - protein, 54 aa, Triticum aestivum
  unsure (1)..(54): unsure at all Xaa locations
  Clone ID: PAT_TA_80896.pep
TNXFLXMXGXLKPXXYMWXSKYXIQDITETQLTLLNQIFRRRCACIDTILAVAC

SEQ ID NO: 186479 - protein, 57 aa, Triticum aestivum
  Clone ID: PAT_TA_80897.pep
FFFLKLHAYASILFAMAKSKIHITDVLFSNQTKQKAKGQQGLITYPLNSSISGLQGL

SEQ ID NO: 186480 - protein, 150 aa, Triticum aestivum
  unsure (1)..(150): unsure at all Xaa locations
  Clone ID: PAT_TA_80898.pep
LSIQDESLVPPPVLAALDIVRQGADVMPRKQLNSVLDAELGQGWSSRLRSFDYEPLAAASIGQVHRAVLKDGSDVVMKIQYPGVADSIESDIENVRRLLTYTNLIPKGLFLDRXYKGCKARLARECDYFLEXSNQKRYKELLSDSEGITS

SEQ ID NO: 186481 - protein, 129 aa, Triticum aestivum
  unsure (1)..(129): unsure at all Xaa locations
  Clone ID: PAT_TA_80899.pep
MVSGSGVCAKRVVVDARHHMLGRLASIVAKELLNGQRVVVVRCEEICMSGGLVRQKMKYLRFLRKRMNTKPSHGPIHFRAPAKIXWRTIRGMIPHKTARGEARSQVKAYEGCAPYDRTSXGHPDALSLS

SEQ ID NO: 186482 - protein, 136 aa, Triticum aestivum
  unsure (1)..(136): unsure at all Xaa locations
  Clone ID: PAT_TA_80900.pep
MARTKQTARKSTGGKAPRKQLATKAARKSAPATGGVKKPHRFRPGTVALREIRKYQKSTELLIRKLPFQRLVREIAQDFKTDLRSVSAVSALQXAAESYLVGXFEDTTLRITQVTYAKESVAADREEAKLSCVVVC

SEQ ID NO: 186483 - protein, 112 aa, Triticum aestivum
  unsure (1)..(112): unsure at all Xaa locations
  Clone ID: PAT_TA_80901.pep
CLLLTPSSGPATLAKAECDEHWQEAMHDELMLIEENVTWTLNDFPTGKKLIDLKWVYNLKSDAVSNMXEHKVCLIAKXYIQRPGIDFKEFLPGGRWFSHSCSRNAQFSGSYT

SEQ ID NO: 186484 - protein, 137 aa, Triticum aestivum
  Clone ID: PAT_TA_80902.pep
LHYCTKFLSRTISAEEKGHCRTSLRPSPHKKQVAFQIPSDDDEADDEELAEIIRDRQTKAARAKGSNVPLMLDPKLILDFIDLWHKDPTTPLPEMNLTPGQSHVLTHFIEEEKWKYEEGRRLKKAQYKKQRYLKDNV

SEQ ID NO: 186485 - protein, 110 aa, Triticum aestivum
  Clone ID: PAT_TA_80903.pep
ILELDTSTKLDAHVREEARSTATEASHLRSTHQTPDLATSARLRRAPLNAVKLQPRLMRPYAHAPSLQRQNELLGLGPNSARLGSCPALLDGAHLQIPRHLDLFQPREAS

SEQ ID NO: 186486 - protein, 132 aa, Triticum aestivum
  Clone ID: PAT_TA_80904.pep
HTRKPHQAAPSMHAGTQGCCLVNHSKFILMQPRGSKQASSIASHTSARTHVSASSQEPCCFLFESHKGERHHKLTPDTTTHSSSRSRSTNDRHHQQISFKQPGKHTINQTCSRQQDLQERASIWSPIKDGRT

SEQ ID NO: 186487 - protein, 100 aa, Triticum aestivum
  unsure (1)..(100): unsure at all Xaa locations
  Clone ID: PAT_TA_80905.pep
MAWSDAENERFERALATYGRDTAGLWERVAAAVGGGKTADDVRRHYDLLTQDIGDIESGRYGYPNGGANSNTNRNNGRNKANRXQTLLDHAVHTVEPRTR

SEQ ID NO: 186488 - protein, 136 aa, Triticum aestivum
  unsure (1)..(136): unsure at all Xaa locations
  Clone ID: PAT_TA_80906.pep
HKLGXRXKEAXXSCLGIHLTTPWSSSVALHVSSRLLKCSSRRRRWRLDPGLQRLEAQPGRRGHLRCSRTGVVGSLGVMNTKARSGRPEVVEDGRIERRGAAAVDEGDRPMHGRSAIPVESLLVVDVDGCSAPPGHP

SEQ ID NO: 186489 - protein, 143 aa, Triticum aestivum
  unsure (1)..(143): unsure at all Xaa locations
  Clone ID: PAT_TA_80907.pep
IMGAQVGKSGDAPMARPYGVAILVFTCMHAAGFGWSWGPLGWVVPGEIFPVDIRSAGQAMNVSIGLGLTFVQTQXXLPMLCSFKYATFAYYAGWVAVMTVFIALFLPETKGVPLXESMGTVWVKHWYWKRFXQPQAKSADALT

SEQ ID NO: 186490 - protein, 92 aa, Triticum aestivum
  Clone ID: PAT_TA_80908.pep
PHLASYCWNRQLLAAALLSLSLCLLTFAVVRSPERKKEEIQRSSESGENRVFPAHERFSLYLEHELDPVPELQRGARILYPQAPACTASPCT

SEQ ID NO: 186491 - protein, 166 aa, Triticum aestivum
  unsure (1)..(166): unsure at all Xaa locations
  Clone ID: PAT_TA_80909.pep
QFCYVXRLMFPCTNNAAEYEXLLHGSSDAKEMNLSRVKCFGDSDLVAQQVSGTWDSKDPLMAAXRREVDTVAGHFKGYXVDHIDRRKNEATDALSRLGSQRKPVPPNVFLDVLHNPSVKVPTEEELAIPDPEAQLVAALHVIPDWTIPYLAYMNRGELPEDETSAR

SEQ ID NO: 186492 - protein, 55 aa, Triticum aestivum
  unsure (1)..(55): unsure at all Xaa locations
  Clone ID: PAT_TA_80910.pep
XHPAXRGSGSPSGASGCASAGASSSTSRISGGSGLLVLDPLDLLLLKEFFMCQGN

SEQ ID NO: 186493 - protein, 158 aa, Triticum aestivum
  unsure (1)..(158): unsure at all Xaa locations
  Clone ID: PAT_TA_80911.pep
WWRGGTGSCIPSWRSPTSSRPCAAARLAYGPVWDHMLGYWXATRXRPDSVLFLRYEELLRDPAEHVRALARFVGLPFSGAEEDAGAVHDIVKLCSFGHLKNLEANKTGHVNPILQIPRGAXFRKGAAGDWVNHMTPXMARXLYEIVAXKLHASXVNFH

SEQ ID NO: 186494 - protein, 90 aa, Triticum aestivum
  unsure (1)..(90): unsure at all Xaa locations
  Clone ID: PAT_TA_80912.pep
XNIQGITKPAIRRLARQGRXVSAISGLIYEETRGVLXXFLENVIRXAVTXTEXARRKTVTXMXVVXALKXQGXXXYGFXGGRQVSLSAEE

SEQ ID NO: 186495 - protein, 96 aa, Triticum aestivum
  Clone ID: PAT_TA_80913.pep
LPVDSICLHDMCANLSKSDSTIKDWHTVLLMDQVVDYGGFVFLQMGGCVLHLDIRCRTLRKVYEYRSTRYRDIHPFMMIWPPIFPALKYDPARTAT

SEQ ID NO: 186496 - protein, 66 aa, Triticum aestivum
  unsure (1)..(66): unsure at all Xaa locations
  Clone ID: PAT_TA_80914.pep
SGXXGSQPLVDNSPYDSGPTRAAVGPVSRRLEPWFSSVPLPWVSDQEDESMAKARATSIVQCNRVS

SEQ ID NO: 186497 - protein, 52 aa, Triticum aestivum
  Clone ID: PAT_TA_80915.pep
SHSVLSDSSSDCTTRMFRSSRRCMCGMHLCVTVCAGFLIESWTANHDHSLFT

SEQ ID NO: 186498 - protein, 159 aa, Triticum aestivum
  unsure (1)..(159): unsure at all Xaa locations
  Clone ID: PAT_TA_80916.pep
MDASKLKKVAGKKFGGPRKKSVTRSVKAGLQFPVGRIGRFLKKGRYAQRVGSGAPVYLAAVLEYLAAEVLELAGNAAKDNKKTRIVPRHLLLAIRNDQELGRLLSGVTIAHGASSPNQPGAAPKKTAEKAEKTAXKLPXKATKXPKRPPRLSIGLMVCG

SEQ ID NO: 186499 - protein, 49 aa, Triticum aestivum
  Clone ID: PAT_TA_80917.pep
YAVAHTISSVIGYKYHLVMILNSILFFICMLVKSKHHSHGENIFKSSSL

SEQ ID NO: 186500 - protein, 92 aa, Triticum aestivum
  Clone ID: PAT_TA_80918.pep
SVDFITVSERGWMILYVTATRDSLVLMNDVFPRVVFKPPNVADKYYSIMDEIMKFVFYQDYAYFLIKTRVTLGTYPHLLIPWFVGAWQIVQS

SEQ ID NO: 186501 - protein, 129 aa, Triticum aestivum
  unsure (1)..(129): unsure at all Xaa locations
  Clone ID: PAT_TA_80919.pep
MSHHEVHKHFTSYVVLMDYLIDTPEDVLILKDRGILKSQMSSAHEVADFFNQXRHCSYINYEKHYLRRVYLDVDDYCSNKXAPYHGNVRRNYLSNPWAVVGFVFAVLFACFTIFSTVISIMQTFFHLPK

SEQ ID NO: 186502 - protein, 155 aa, Triticum aestivum
  unsure (1)..(155): unsure at all Xaa locations
  Clone ID: PAT_TA_80920.pep
FFVFMGEFREEFKQKNPKNKSVAAVGKAAGERWKSLSESEKAPYVAKANKLKGEYNKAIAAYNKGESAAAAAPKKAXAKEVEEEDXEESDKSKSEINDDVTIKGTHXDXDDXELRRRILKLLPRNSGAAFRTTLVRGVKEPIPSPPKIPKFYFIG

SEQ ID NO: 186503 - protein, 171 aa, Triticum aestivum
  unsure (1)..(171): unsure at all Xaa locations
  Clone ID: PAT_TA_80921.pep
GHVLQLHTQPLLRVAAASASPRLLPQQWPTSSPLRRCGASHHHRALAAKGAVAYSTRAGRPREELKPQRWSTAPAPSSTGSGGAAAGQRQIGVSWEQTRRPSRAEQSXVGMAARRLSGLDPAITTSQPPSFVRVIFGETKGLPRVCEVTLNGNALCFRLRSFLRASXLRXX

SEQ ID NO: 186504 - protein, 77 aa, Triticum aestivum
  Clone ID: PAT_TA_80922.pep
LDFTFVGTQAWIRTMGYPVVAPWRPWYSKQQVAGFTTEYAYNLTYATVKGAGHTAPEYRPKECLDMLDRWTSPAGKL

SEQ ID NO: 186505 - protein, 59 aa, Triticum aestivum
  Clone ID: PAT_TA_80923.pep
AWRALRSELARRISACPPTTSLNQTRRSGIPFRAGVVVDMCCEMLDGTSGWGTMYYLCS

SEQ ID NO: 186506 - protein, 49 aa, Triticum aestivum
  Clone ID: PAT_TA_80924.pep
RVNKMGRAAGVLENHEEGRRYAEHGLRAYVQDKTPEIMPGINKFFTSPK

SEQ ID NO: 186507 - protein, 94 aa, Triticum aestivum
  unsure (1)..(94): unsure at all Xaa locations
  Clone ID: PAT_TA_80925.pep
MRRMRVLRRLLRKYREAKKIDKHMYHDMYLKVKGNMFKNKRVLMEXIHXSKXEKAREKTLSDQFEAKRAKSKASRERKHARRXXXLXXGXKRTG

SEQ ID NO: 186508 - protein, 147 aa, Triticum aestivum
  unsure (1)..(147): unsure at all Xaa locations
  Clone ID: PAT_TA_80926.pep
KVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVXFNVKNVVSXLKRGFVXSNSKDXPAKEAAT

SEQ ID NO: 186509 - protein, 109 aa, Triticum aestivum
  Clone ID: PAT_TA_80927.pep
GPVFTTAFMPLIQMIAAGINVTVLREQLHLGSVVGSALVVVGLYLVLWGKSNEASSKSKLPPPSNSKLALDEEAEHGGDSRIMQMCNSGGDGESFWEKGGNYFSIFLNG

SEQ ID NO: 186510 - protein, 75 aa, Triticum aestivum
  unsure (1)..(75): unsure at all Xaa locations
  Clone ID: PAT_TA_80928.pep
MSCNCGSGCSCGSDCKCGKMYPDLTEQGSAAAQVAAVVVLGVAPENKAGQFEVAAGQSGEGCSCGDNCKCXPCNC

SEQ ID NO: 186511 - protein, 105 aa, Triticum aestivum
  unsure (1)..(105): unsure at all Xaa locations
  Clone ID: PAT_TA_80929.pep
HGKSLPXNFKKMLSVQLRSSAAKGKLVKVKASYKLSDAAKKDAPKPKPKXXAXAPKAAXKPXKDAXKPKKKGAXKPXKXAAXVGXXXKGPXKKXXFKGKKFXGGQ

SEQ ID NO: 186512 - protein, 39 aa, Triticum aestivum
  Clone ID: PAT_TA_80930.pep
LILQTHKQHNSYRDCNIALLTTHRTPPSTHDTRMKPKKR

SEQ ID NO: 186513 - protein, 125 aa, Triticum aestivum
  Clone ID: PAT_TA_80931.pep
MFTSTREEDISIVQFQDRPQASKNFYLTLSIEALHELTYLQNHMNDLYLEPMMADEWITCWGDVQFRPKKFTNFFFRELQPPAYITMIWKTKCIVKLKVFTWLMLMDRVNIRDMLHRRHFDIGVT

SEQ ID NO: 186514 - protein, 96 aa, Triticum aestivum
  unsure (1)..(96): unsure at all Xaa locations
  Clone ID: PAT_TA_80932.pep
LRLFLFCSRHXLSFFLLCGLVVVFDVLFFLIRFLGYCLRSLCSCPWYVFCLLYFCGHVWFWCRRRVLCSLLLGSTMDVVRVVLILLAYFPXHVLGG

SEQ ID NO: 186515 - protein, 74 aa, Triticum aestivum
  unsure (1)..(74): unsure at all Xaa locations
  Clone ID: PAT_TA_80933.pep
EHTQSXAGATLAASTRSRQQWQXXAPRRAPXRNXCXLRLQPXXCGWPRPCCRREVCRXRXKXRTXNQSPWXNLM

SEQ ID NO: 186516 - protein, 86 aa, Triticum aestivum
  unsure (1)..(86): unsure at all Xaa locations
  Clone ID: PAT_TA_80934.pep
XELXVXQGAXXAFXXFSXAXTXSSFAPXPLXSCTAKKSLSCVCITVIPVAXXCRXXYRCXXRICTCPWTVRFMSDNPRWNVHKLCC

SEQ ID NO: 186517 - protein, 68 aa, Triticum aestivum
  unsure (1)..(68): unsure at all Xaa locations
  Clone ID: PAT_TA_80935.pep
XMLXSSKXATLSSXVXSQGDTYPAGMYSSGTLSXVEPEIVEIXGPSTIATKFPEQEXNXIRNXSXHGX

SEQ ID NO: 186518 - protein, 88 aa, Triticum aestivum
  unsure (1)..(88): unsure at all Xaa locations
  Clone ID: PAT_TA_80936.pep
DNTTLAEMDPXSFLKFDAGYYRLVAXRRGILHSDSALLEHPXXRAYVGRQAXXGFFGXEFFRGLXASXMVKXGNIXVLXGRXGDSNKW

SEQ ID NO: 186519 - protein, 70 aa, Triticum aestivum
  unsure (1)..(70): unsure at all Xaa locations
  Clone ID: PAT_TA_80937.pep
RNMXXNSPXNHCLSNEMRKRYDGTXLHSCYPCSRSALLXSXNVPNTLRAPPRPRNGKAPVTANTRIAVXS

SEQ ID NO: 186520 - protein, 170 aa, Triticum aestivum
  unsure (1)..(170): unsure at all Xaa locations
  Clone ID: PAT_TA_80938.pep
DYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFXKTLTGKTITLEVESSDTIDNVKAKIQDKEGXPXDQQRLIFAGKSLRMAHLADYNIQKESTFIGAPSPRWQ

SEQ ID NO: 186521 - protein, 64 aa, Triticum aestivum
  unsure (1)..(64): unsure at all Xaa locations
  Clone ID: PAT_TA_80939.pep
LTARPXLTIAPPTWRAKDVGGNDTYGITRIPTTVAGARGCEKSRINSQHKDRLPRFGPRGCVKP

SEQ ID NO: 186522 - protein, 138 aa, Triticum aestivum
  unsure (1)..(138): unsure at all Xaa locations
  Clone ID: PAT_TA_80940.pep
MYTARKKIQKDKGVEPSEFEDTVAQAFFDLENGNQELKSDLKDLYINTAIQMDVVGNRKAVVIHVPYRLRXXFRKIHVRLVRXLEKKFSGKDVVFXATRRIVRHPRRVCVXPSTRTXTAVHDVSWCVTSNGNRFDVKI

SEQ ID NO: 186523 - protein, 72 aa, Triticum aestivum
  Clone ID: PAT_TA_80941.pep
IVQIRLVRVGKILRVHLIVQIRLVRGGNNPACSSTDVSETRINVVESNEDYMAEEPIEHHNYAEKDVESSDV

SEQ ID NO: 186524 - protein, 107 aa, Triticum aestivum
  unsure (1)..(107): unsure at all Xaa locations
  Clone ID: PAT_TA_80942.pep
RRSARRRPPTAAKMQIFVKTLTGKTITLEVESSDTIDNVKAKIQDKEGIPPDXXRXIFAXKXLKDGRTLAXXKIQKEXTLHLVLXXRXGAKKRKKTSSQEKKKNSSV

SEQ ID NO: 186525 - protein, 80 aa, Triticum aestivum
  unsure (1)..(80): unsure at all Xaa locations
  Clone ID: PAT_TA_80943.pep
GRRRRRAAAKXVSLKLQKRLGPRASSSVARARSXLXPNEVNXXSMXQLPXXIRXXVKXCFXXXGTSKXPLXVFIMGXFGA

SEQ ID NO: 186526 - protein, 112 aa, Triticum aestivum
  unsure (1)..(112): unsure at all Xaa locations
  Clone ID: PAT_TA_80944.pep
GKKKSKKSXETYKIYIXKVLKQVHPDIGISXKAMSIXNSFINDIFEKLAGESPRWPXTTSXPTMTSREIXXSXXXVXPGELAKHAVXEXTKAVTKFTLLDCSCVFLNVTSGC

SEQ ID NO: 186527 - protein, 97 aa, Triticum aestivum
  Clone ID: PAT_TA_80945.pep
VLYIHQLEFFGVNQDLQLCLMSITSLSSFKCHQRLNLGNAFHLLLCTDPSGYTECILYNNSSLSCSAVTTSITDFYHVLNVTGASIWEMICIGPSRL

SEQ ID NO: 186528 - protein, 64 aa, Triticum aestivum
  unsure (1)..(64): unsure at all Xaa locations
  Clone ID: PAT_TA_80946.pep
FDXTHLPFKIRHTPTLHSTPANTTLQVAXIVLIKHTFSIPATTIDGRYAMQACSTRKKKESDAK

SEQ ID NO: 186529 - protein, 116 aa, Triticum aestivum
  unsure (1)..(116): unsure at all Xaa locations
  Clone ID: PAT_TA_80947.pep
PSAFFXFMGEFREEFKQKNPKNKSVAAVGKAAGERWKSLSESEKAPYVAKANKLKGEYNKAIAAYNKGESAAAAAPKKAAAKEVEEEDEEEXDKSKSEINDDDDDEGSDEDEDDDE

SEQ ID NO: 186530 - protein, 55 aa, Triticum aestivum
  unsure (1)..(55): unsure at all Xaa locations
  Clone ID: PAT_TA_80948.pep
VKXNVNRVDNMVIQXXFLLAXLDKDXNXXSXRVRXXYRWXFPELXKIXNEXYXYA

SEQ ID NO: 186531 - protein, 115 aa, Triticum aestivum
  unsure (1)..(115): unsure at all Xaa locations
  Clone ID: PAT_TA_80949.pep
ALQSDXVELVAVNDPFITTEYMTYMFKYDTVHGHWKHSDIKLKDDKTLLFGEKPVTVFGVRNPEEIPWGEAGADYVVESTGVFTDKDKXAAXXKGXAKXVVXSAPSXDSPMFXVX

SEQ ID NO: 186532 - protein, 94 aa, Triticum aestivum
  unsure (1)..(94): unsure at all Xaa locations
  Clone ID: PAT_TA_80950.pep
ASIIRALHDLHEVNICPVQFCASNIVVTYYGRVKIRVACLKKTVSMVRKNYEDASNIIMDTLFADYKPTIIPKDVDHLFSLMKSPIATGTXCDR

SEQ ID NO: 186533 - protein, 144 aa, Triticum aestivum
  unsure (1)..(144): unsure at all Xaa locations
  Clone ID: PAT_TA_80951.pep
IKSMFNKIHNMNNCCGVICTSRIPFGPNCDHEKNGSIQIQVVIDTETRFTSIWLGLADSMTQLSILHDSEIFEVCEKGDWLNGSKLKVGLDESEVGEYIIGDAGYPLLPWLLTPYQEEDLSDSKAEFNRRHSTATTCLXGAGKA

SEQ ID NO: 186534 - protein, 124 aa, Triticum aestivum
  unsure (1)..(124): unsure at all Xaa locations
  Clone ID: PAT_TA_80952.pep
NANLSIHCYFXVSEKXRXQYIPNVCIFTXSHXTKXANSYXLQYXXLPRXXTSXXEAHTSARAEFGTXAAAGFXXXXLRRPSXXSLSGRXPAMXAEXXIGGGRPRXSTTSXXXAXQXLXWTSXAA

SEQ ID NO: 186535 - protein, 47 aa, Triticum aestivum
  unsure (1)..(47): unsure at all Xaa locations
  Clone ID: PAT_TA_80953.pep
YIXXTXYLLLIKLKGXXIXNNNSALSQXNXSNXLDXTHSXXCXQAXG

SEQ ID NO: 186536 - protein, 58 aa, Triticum aestivum
  unsure (1)..(58): unsure at all Xaa locations
  Clone ID: PAT_TA_80954.pep
SFKLHYAIANLLDSDGFTNELXILMLCFXIQTLACVNFGLILDIFNKIPQQNTSIILC

SEQ ID NO: 186537 - protein, 125 aa, Triticum aestivum
  unsure (1)..(125): unsure at all Xaa locations
  Clone ID: PAT_TA_80955.pep
DEDAXFKLCKVRSVXFGQKGIPYLNTYDGRTIRYPDPLIKANDTIKLDLETNKIVDFIKFDVGNVVMVTGGRNTGRVGVIKNREXPKGTFETXXVEXPQGHXXXTRXGXNXFTIXKGXXXGYPPQ

SEQ ID NO: 186538 - protein, 70 aa, Triticum aestivum
  unsure (1)..(70): unsure at all Xaa locations
  Clone ID: PAT_TA_80956.pep
HILIGPQGRACSQTHLITTLPENTGTAEDTAGGGRXQXPIVSVXRVLACFTCDWETWRTHLCLRLPSHWV

SEQ ID NO: 186539 - protein, 158 aa, Triticum aestivum
  unsure (1)..(158): unsure at all Xaa locations
  Clone ID: PAT_TA_80957.pep
KKXCPIXGHRKXMXLKKXEIXCXGAFAQNLGSRPXSCTTAXXTXVGSPSRRYVVFLLRVHISPPPPYLQLPPQPLPLADWSSAPRSPVAGALHSPRGPLAGDLIVAGCSSTSVVAPLACSSRGHFVAALFSSVVGKLNAHCSIPDHHALYCLLHNLLL

SEQ ID NO: 186540 - protein, 106 aa, Triticum aestivum
  unsure (1)..(106): unsure at all Xaa locations
  Clone ID: PAT_TA_80958.pep
VYLAAVLEYLAAEVLELAGNAAKDNKKSRIVPRHLLLAIRNDQELGXLLSGVTIAHGXVIPNINPVLLPKKAAEKAEKAGXXPKSPKKATKSPKKAHQGVDSSAVC

SEQ ID NO: 186541 - protein, 96 aa, Triticum aestivum
  unsure (1)..(96): unsure at all Xaa locations
  Clone ID: PAT_TA_80959.pep
IVGDCGTGKTTFVXRHLTGEFXXKYXPTXGVEGXPLXXTTNWGKXRFYXWDTXGXEKLXGLRDGYYIHGQXAIIXXDXTXRXTYXNVPXXXRDFAG

SEQ ID NO: 186542 - protein, 117 aa, Triticum aestivum
  unsure (1)..(117): unsure at all Xaa locations
  Clone ID: PAT_TA_80960.pep
NSGYKXSSFFRXWVINHISVRELIFLFGVPSSLNYLVAKLHLNHCKGSPCVFNLSFFLSSFYYWSSSWRLYMGVHQGFNSFSKCSSRFLLEEFKYSSFAFQSAIPSTLSLEVALCHS

SEQ ID NO: 186543 - protein, 61 aa, Triticum aestivum
  unsure (1)..(61): unsure at all Xaa locations
  Clone ID: PAT_TA_80961.pep
HXPSNPPPPSTXVRCTDHXPXPGRCXSQTPKVXNMXKKKXPXRPXPQXXSSXTXXSSPAXL

SEQ ID NO: 186544 - protein, 85 aa, Triticum aestivum
  Clone ID: PAT_TA_80962.pep
HRKVLRDNIQGITKPAIRRLARRGGVKRISGLIYEETRGVLKIFLENVIRDAVTYTEHARRKTVTAMDVVYALKRQGRTLYGFGG

SEQ ID NO: 186545 - protein, 92 aa, Triticum aestivum
  unsure (1)..(92): unsure at all Xaa locations
  Clone ID: PAT_TA_80963.pep
KSSERLIGISHDKLHSKRIERSPPASLRFQAICFSTGYLVCSIFSQKNLFCSGFQVFFRKTLNNFXVKNANKYVHNVFGKRNMKNKKKAKKK

SEQ ID NO: 186546 - protein, 75 aa, Triticum aestivum
  unsure (1)..(75): unsure at all Xaa locations
  Clone ID: PAT_TA_80964.pep
TNCWAXQAKNKKTDQIQESLALISIPSLSCYLLQDEVSQIQSYKQKKLYQNLLYDNLPGTTILTVLAHSYLYYIF

SEQ ID NO: 186547 - protein, 72 aa, Triticum aestivum
  unsure (1)..(72): unsure at all Xaa locations
  Clone ID: PAT_TA_80965.pep
SXPXXXSXXXLCRXXXXPGHGLXXRLXXDRPCRRXCRRXPXRPAPSXRPPGSSCTSRSSTDRFLXLLWLGLV

SEQ ID NO: 186548 - protein, 153 aa, Triticum aestivum
  unsure (1)..(153): unsure at all Xaa locations
  Clone ID: PAT_TA_80966.pep
REKETVEYXMLLGILGASMTYQVGLKPPGGLWQXNNNEXFXGYPVLXXXNKHRYAXFFYSNSTSFMASVVXIVLLLPWTTLFQKRKPPLWLMXIXILLDMVGLLVAYXAXSTRKWXASXNVIXLVIPVLAYXGFYXLASVFFREKTLWGFPVV

SEQ ID NO: 186549 - protein, 115 aa, Triticum aestivum
  unsure (1)..(115): unsure at all Xaa locations
  Clone ID: PAT_TA_80967.pep
QQRLIFAGKQLEDGRTLADYNIQKESTLHLVLRLRGGMQIFVKTLTGKTITLEVESSDTIXNVKAKIQDKEGIPPDQQRLIFAGXQLEDGRTLADYNIQKESXLHLVLXRLRGGQ

SEQ ID NO: 186550 - protein, 162 aa, Triticum aestivum
  unsure (1)..(162): unsure at all Xaa locations
  Clone ID: PAT_TA_80968.pep
HWIKVQXHYLLQXKTSKHIKSQEITSTTPREQQRAHHHPASHDHGQEXXCVTTTLSRNNCNTLRVMPNPTLHTSVIVVARNESTALCKGTLVPLMQAERGLVGIHVQHLTKNSLRSFHLLHPILRRIQIDTYLLKRREVFQAQVEIARLMHSIPCSEMQLEN

SEQ ID NO: 186551 - protein, 127 aa, Triticum aestivum
  unsure (1)..(127): unsure at all Xaa locations
  Clone ID: PAT_TA_80969.pep
MAPKAEKKPVXEKAEKTTAAKKTKAEKRPPASKEGGEKKGKKKSKKSVETYKIYIFKVLKQVHPDIGISSKAMSIMNSFINDIFEKLAGESAKLARYNKKPTITSREIQNLRPPSSFPXELAKXAVL

SEQ ID NO: 186552 - protein, 59 aa, Triticum aestivum
  Clone ID: PAT_TA_80970.pep
MAGSAVKAVIRNVSKLAVWETSLLCGVTGEVGFLKDELKRLKCYLRSADAKRRSGDECV

SEQ ID NO: 186553 - protein, 146 aa, Triticum aestivum
  unsure (1)..(146): unsure at all Xaa locations
  Clone ID: PAT_TA_80971.pep
MVSCSRSLSPKPQFRFQNRHPLLLXSHRRKGARQLTSKISPSSTLAHQVLRTISFSLSMQQAALLVQRKWLQPSSLGRTSESFPSTWLGKTRLSLRDGHPLVSEPRSHLVICWDDGTIYNXQYRXLIXRKHGASHTPVXSTAYFCX

SEQ ID NO: 186554 - protein, 95 aa, Triticum aestivum
  unsure (1)..(95): unsure at all Xaa locations
  Clone ID: PAT_TA_80972.pep
XPRSPSXPRPSTXPXSPAGXRLXRGGXRGXAALLQXCQXXPPRLRQVPXXRGQCXAXVRXXQPPXKEXDLRGPEPRPXTXISIMLXDXNSFTXKG

SEQ ID NO: 186555 - protein, 58 aa, Triticum aestivum
  unsure (1)..(58): unsure at all Xaa locations
  Clone ID: PAT_TA_80973.pep
SNSTTPTGEAASPKNTRRRWPXSAXAPXGXGXGXXXKCXCXPAXHXGSFKXRXHRTNS

SEQ ID NO: 186556 - protein, 55 aa, Triticum aestivum
  Clone ID: PAT_TA_80974.pep
GLIYEETRGVLKIFLENVIRDAVTYTEHARRKTVTAMDVVYALKRQGRTLYGFGG

SEQ ID NO: 186557 - protein, 59 aa, Triticum aestivum
  unsure (1)..(59): unsure at all Xaa locations
  Clone ID: PAT_TA_80975.pep
XXLPMXKARASTKIPEKPTPIEPVAAKGKKRKERVKKTIARVLGKASIMEDEEEEEEVA

SEQ ID NO: 186558 - protein, 145 aa, Triticum aestivum
  Clone ID: PAT_TA_80976.pep
AGLIVLEPHGGLMATIPTAATPYPHRSGVLYIIQYIAFWQGDGGTAATTWLGSFYDFMGHYVSSNPRQAYVNFRDLDIGQNAVSDDLSTTSQSGKVWGERYFMSNYQRLASVKAAVDPMDYFRNEQSIPPLRPVPAYNDYNERPK

SEQ ID NO: 186559 - protein, 85 aa, Triticum aestivum
  Clone ID: PAT_TA_80977.pep
SSRAPPNPAKRAKKQAPPARSSSQQAPPARSSSQQASQHTVDRRSRMRSQNRVGSSSQPAPGNSSSIHMQVPTTDRLQWLLTGER

SEQ ID NO: 186560 - protein, 62 aa, Triticum aestivum
  unsure (1)..(62): unsure at all Xaa locations
  Clone ID: PAT_TA_80978.pep
GAHFRAQLGPLPGPQXPVRPSACAWAGPRHFSLDGFRELHVIACTTLGLVDVSSSNEIFQDD

SEQ ID NO: 186561 - protein, 96 aa, Triticum aestivum
  unsure (1)..(96): unsure at all Xaa locations
  Clone ID: PAT_TA_80979.pep
LQARLKSVVSLERMEEAXEKKXQDLAATQKEAHEKTTLADQKLALVGKLEEENAKLKNAISEANREVEQLKKDKENLATEVGGLRDKTGKLESYLG

SEQ ID NO: 186562 - protein, 158 aa, Triticum aestivum
  unsure (1)..(158): unsure at all Xaa locations
  Clone ID: PAT_TA_80980.pep
DAGEKKMITLKSSDGEEFEVEEAVAMESQTXRHMIEDDCADNGIPLPNVNSKILSKVIEYCNKHVQAKPADGAAAGAGAGASDAXPXAPAEDLKNWDAEFVKVDQAXLFDFILAANYXEHQXVLDLTCQTVXXMSGQTPEESERLQIRFPGEGEWLLR

SEQ ID NO: 186563 - protein, 111 aa, Triticum aestivum
  unsure (1)..(111): unsure at all Xaa locations
  Clone ID: PAT_TA_80981.pep
EPTTARTAAARWRRWATSGCLARRREHRRGHGQAPVRARVHGPPTPPSSSSSTCTSPWPADSHXCGRVEYKVYISKQSCWGVAVIQYMYPSNQSAGPXIXTYCLINQVGLS

SEQ ID NO: 186564 - protein, 132 aa, Triticum aestivum
  unsure (1)..(132): unsure at all Xaa locations
  Clone ID: PAT_TA_80982.pep
ALSGAHTIGKAQCSNFRTRIYGGDTNINTAFATSLKANCPQSGGNTNLANLDTTTPNAFDNAYYTNLLSQKGLLHSDQVLFNNDTTDNTVRNFASNAAAFSSAFTTAMIKMGTXRAVTGTQGQIRSVLQGDS

SEQ ID NO: 186565 - protein, 50 aa, Triticum aestivum
  Clone ID: PAT_TA_80983.pep
GINKREASIAKGRRKRKVKGHSNSPPFSTSCVSLHVQASQPSRLISSGIQ

SEQ ID NO: 186566 - protein, 91 aa, Triticum aestivum
  unsure (1)..(91): unsure at all Xaa locations
  Clone ID: PAT_TA_80984.pep
TGAXXWAGALXHXGAPXPPLSXPGPPRPARAPRRTAAMDNQEVQPVVVGVSCERSGAVGTSGEGSGAVGVSCGRSVAAGVSGERSVADGGD

SEQ ID NO: 186567 - protein, 137 aa, Triticum aestivum
  Clone ID: PAT_TA_80985.pep
FFFSTEFFSTRNFSISVVYTRVFTYMNISFKRRVDREQRTDTQPTINPSTPRSTNKASPPRIRCSSVIELPPTPHPTELQKNQCTPSESTERAHEMFRRRRRLGHGRAAVVEAATSSRTFRVDPARAHGIVLARSVC

SEQ ID NO: 186568 - protein, 159 aa, Triticum aestivum
  Clone ID: PAT_TA_80986.pep
GDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGENMHDDGGVVFAYYKEGAADPTFLYFAHGLKEVKC

SEQ ID NO: 186569 - protein, 121 aa, Triticum aestivum
  unsure (1)..(121): unsure at all Xaa locations
  Clone ID: PAT_TA_80987.pep
PXNXKPLSXXCIFYNSVIXXNYNCTSSREASIISLVCVVPVXHSXLKXLSDXTSXHIASXWALQXLVXNPXFXFPVLAFCXVXTAXYLFILVTVXKSYNLXRXWYDPPHXDHIXLXHXGSV

SEQ ID NO: 186570 - protein, 122 aa, Triticum aestivum
  unsure (1)..(122): unsure at all Xaa locations
  Clone ID: PAT_TA_80988.pep
SHLLRFPNIQNQSLLSGFAYCIASCSMILVNKFVLSGYGFNAGIFLMIYQNIVSVTIVSALSLSGVIPTEPLTWKLIKVWLXVNIIFVGMLITSMXSLKYINVAMLTILKMSKCPTASGEPS

SEQ ID NO: 186571 - protein, 78 aa, Triticum aestivum
  Clone ID: PAT_TA_80989.pep
GERRERRRRPTPLQDSAVQRLPKTPQLDASTPAYLLRRTGFLSGGSQATREARLNNLDKLLAIQKLDDHDIIKSNSYV

SEQ ID NO: 186572 - protein, 121 aa, Triticum aestivum
  unsure (1)..(121): unsure at all Xaa locations
  Clone ID: PAT_TA_80990.pep
DLACRHCRRWLAGWTGVRGAGVLQPYISGKTLAKMCACQDSCGSRLIAGADGRWMPARIRRLQPRHPQGGAATITYPTMGXQQFMMFCXXLSLLRKXXXLKXQTTCFLVXXHXIVYYSXPX

SEQ ID NO: 186573 - protein, 40 aa, Triticum aestivum
  Clone ID: PAT_TA_80991.pep
LPHIIQLGNYSLHTHVLPSQTNIKTFESLLYSNLNALILV

SEQ ID NO: 186574 - protein, 161 aa, Triticum aestivum
  unsure (1)..(161): unsure at all Xaa locations
  Clone ID: PAT_TA_80992.pep
IEKQKQIKKQREGSYLGLTYAGPAHLARPSRLALPVVVLLAPEGRGXWPAPAATRRPPPASADVLETSRDATRPPRPPLILXHSPPRLPHSLPRCPCAFLAAVRRRRRRXPPRPSDKQIXCNDALASPPSSLPEAXMRMAVLNWYCGSVMIAXRCPEPXMX

SEQ ID NO: 186575 - protein, 95 aa, Triticum aestivum
  unsure (1)..(95): unsure at all Xaa locations
  Clone ID: PAT_TA_80993.pep
MAAAAPADAKAEAAKMDLLEDDDEFEEFEXDQEWDDKEDGNEAVQQWEDDWXDDDDVNDDFSXQLRKELEGGNTQKSEHPYQTVVHFRCAMVEGF

SEQ ID NO: 186576 - protein, 152 aa, Triticum aestivum
  unsure (1)..(152): unsure at all Xaa locations
  Clone ID: PAT_TA_80994.pep
MSDTDEHHFESKADSGASKTYPQQAGAIRKGGHIVIKARPCKXVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSVMSAMGEEQIL

SEQ ID NO: 186577 - protein, 129 aa, Triticum aestivum
  unsure (1)..(129): unsure at all Xaa locations
  Clone ID: PAT_TA_80995.pep
SDKPLRLPLQDVYKIGGIGTVPVGRVETGVIKPGMVVTFGPTGLTTEVKSVEMHHESLLEALPGDNVGFNVKNVAVKDLKRGFVXXNSKDDPAKEAANFTSQXIIMNHPGSDGNGNAQVXXANLPNCGK

SEQ ID NO: 186578 - protein, 50 aa, Triticum aestivum
  Clone ID: PAT_TA_80996.pep
EEAKRRYEEFVRSKRGRKESKARREVLVDLCCSAVSAVAVLSFLASVVLR

SEQ ID NO: 186579 - protein, 80 aa, Triticum aestivum
  unsure (1)..(80): unsure at all Xaa locations
  Clone ID: PAT_TA_80997.pep
PPKHTSGIPRTRRPPQTYSDERVPEPRCRRRRPRAWPRTAPGRPPGXRPCPRPTASPPPAPGPXCRGGPRPPSAPPPSPG

SEQ ID NO: 186580 - protein, 148 aa, Triticum aestivum
  Clone ID: PAT_TA_80998.pep
MGEEAEPAMQEEAEEEASDEPADDLGRAIADAKRNCASDLEKKLQRMLDDHKKLLYPNCEADKKKLGTTLELLQWKAENGVSDKGFGKLLVMIKNMLPKDNELPESTYEAKKAVRPLGLEVQKIHACPNDCILYRVEYEDLNACPVCG

SEQ ID NO: 186581 - protein, 121 aa, Triticum aestivum
  unsure (1)..(121): unsure at all Xaa locations
  Clone ID: PAT_TA_80999.pep
MARTKQTARKSTGGKAPRKQLATKAARKSAPATGGVKKPHRFRPGTVALREIRKYQKSTELLIRKLPFQRLVREIAQDFKXDFXFQSSAVXALQEAAEAYLVGXFEDXNSGIHAKXLHKEI

SEQ ID NO: 186582 - protein, 59 aa, Triticum aestivum
  unsure (1)..(59): unsure at all Xaa locations
  Clone ID: PAT_TA_81000.pep
MKSGKHGXEGTQEVQHRIRXTLSSKSVXNXEKVSAEXXXGAXENQLKVXGPVXXMPXXV

SEQ ID NO: 186583 - protein, 135 aa, Triticum aestivum
  unsure (1)..(135): unsure at all Xaa locations
  Clone ID: PAT_TA_81001.pep
PPRAFPVPVQVPSKSFRMRHLLLPAPRQRQASLPAPAAQALSPSASPVPRSPLCPWRRGRRRGSSRPPWSSSTAPSTSSPPPSTATATSPQLTSYQQAVCFGNEFCDGGTLTESFSSXNKRDXLQKMAFXGAVGK

SEQ ID NO: 186584 - protein, 152 aa, Triticum aestivum
  unsure (1)..(152): unsure at all Xaa locations
  Clone ID: PAT_TA_81002.pep
KAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPXKATKSPKKTTKVNRRVHVVDVVVFS

SEQ ID NO: 186585 - protein, 73 aa, Triticum aestivum
  unsure (1)..(73): unsure at all Xaa locations
  Clone ID: PAT_TA_81003.pep
KTKQKKRERERPEATYLASPAHLACASHHLPLLVGTGGTPRHRRACHATSLPACRRPRQAMPXNASAXXPXPL

SEQ ID NO: 186586 - protein, 128 aa, Triticum aestivum
  unsure (1)..(128): unsure at all Xaa locations
  Clone ID: PAT_TA_81004.pep
TIDNVKAKIQDKEGIPPDQQRLIFAGKQLEDGRTLADYNIQKESTLHLVLRLRGGAKKRKKKTYTKPKKQKHKHKKVKLAVLQXYKVXXAXGKVTRXLRRECPNAXWXXGXLMANXXDRQXXDKWGLT

SEQ ID NO: 186587 - protein, 68 aa, Triticum aestivum
  unsure (1)..(68): unsure at all Xaa locations
  Clone ID: PAT_TA_81005.pep
XXPQRHXXRLHQXVXTNRHNYVLNISYCLYIQAQRRHVLLQIKKTIXYIIXXHVAFCVSPEHISFCFL

SEQ ID NO: 186588 - protein, 76 aa, Triticum aestivum
  unsure (1)..(76): unsure at all Xaa locations
  Clone ID: PAT_TA_81006.pep
QGITALXFYXLXRNFVWKMTRXCFIFXXLERAXXNQXIYKYXTLGGELMDRPESQLEXXVVXNVXAMXRALVKMLL

SEQ ID NO: 186589 - protein, 90 aa, Triticum aestivum
  unsure (1)..(90): unsure at all Xaa locations
  Clone ID: PAT_TA_81007.pep
AXCXSXACIRTFLXRWXVRSPHVHYSXXPXXXSXDEYARAXXLLXQXXSIRKVQKVXXHKXXXHADRAKRGXVIPVWGASNKSXSELLGG

SEQ ID NO: 186590 - protein, 119 aa, Triticum aestivum
  unsure (1)..(119): unsure at all Xaa locations
  Clone ID: PAT_TA_81008.pep
XXLXMLLXVYXARXSSXXXLXGYFFSFADLTHXXFMRXFMATEHXVXLDVYPHVKAXWEALXARPXVKKVIAGXPPDXGXGAGTYQKAWADARITQPTSNKGSKVVGYERTCAGNVAYQ

SEQ ID NO: 186591 - protein, 45 aa, Triticum aestivum
  unsure (1)..(45): unsure at all Xaa locations
  Clone ID: PAT_TA_81009.pep
NGDXAWXDQWXFWVXPFIGAAIXALYHQTXLRXSXRRYRSFRXXA

SEQ ID NO: 186592 - protein, 67 aa, Triticum aestivum
  unsure (1)..(67): unsure at all Xaa locations
  Clone ID: PAT_TA_81010.pep
TASLIXSNISPFLLLLFXTXLKLHTLXXLXLLXSRLPNNLRXXXLNSXTLXLSHAAAGQLTPXFGEA

SEQ ID NO: 186593 - protein, 56 aa, Triticum aestivum; identical to SEQ ID NO: 134756
  Clone ID: PAT_TA_81011.pep

SEQ ID NO: 186594 - protein, 93 aa, Triticum aestivum
  unsure (1)..(93): unsure at all Xaa locations
  Clone ID: PAT_TA_81012.pep
PPCSXTLLSASSYSHSGRXAXPFSRCPFRPFCGSSXCSGXTXXAXXPGVXDTATIRSLHSSSPDXXLLXRQRYITLHRKVSWIYILERARGPT

SEQ ID NO: 186595 - protein, 78 aa, Triticum aestivum
  unsure (1)..(78): unsure at all Xaa locations
  Clone ID: PAT_TA_81013.pep
MSCCGXXCGCCSXCXFGNGCCGCYMYPDVXAAGSTLLXAATXTHKASSGGMEMAAEDGGCXCTQCKXGTSCGXSCCSG

SEQ ID NO: 186596 - protein, 74 aa, Triticum aestivum
  unsure (1)..(74): unsure at all Xaa locations
  Clone ID: PAT_TA_81014.pep
TXXXXSXSXSIXMNXRXVPXSMLXXSAXIRRVSRKQDSXGXPXSXVHLXLWTFRFSLXSACARRGVXLGXGVRK

SEQ ID NO: 186597 - protein, 50 aa, Triticum aestivum
  Clone ID: PAT_TA_81015.pep
QVMEHVARQVAPYKKVRKVVFVDSIPKSPAGKILRRQLSDHMQPCHVSRL

SEQ ID NO: 186598 - protein, 76 aa, Triticum aestivum
  unsure (1)..(76): unsure at all Xaa locations
  Clone ID: PAT_TA_81016.pep
PDDITXDRHSEQQNARERLVXIXRXLKKQKQRLKVRKTHLKXDGVKYSIQQRSTAVXXPPRATXRGSCYLNSMRRP

SEQ ID NO: 186599 - protein, 59 aa, Triticum aestivum
  unsure (1)..(59): unsure at all Xaa locations
  Clone ID: PAT_TA_81017.pep
VYGXXHNGXVPLSFXYYIAXVXXCVXWIMCRAGIWILILIXSXGKKKKKKXKKKKKKKT

SEQ ID NO: 186600 - protein, 124 aa, Triticum aestivum
  unsure (1)..(124): unsure at all Xaa locations
  Clone ID: PAT_TA_81018.pep
QEKRRAXXKRRRRGXRVAXPPCCRPXXXTWLXSNSSXPSTXQRPPXQSXGIKEGKQKXQXEGKXXGXXTGRLMEAXGPPLXSXGRXXPAXLPXFRPXGAKLWXXSXGXLVXPLRLXFTGHXXPW

SEQ ID NO: 186601 - protein, 76 aa, Triticum aestivum
  unsure (1)..(76): unsure at all Xaa locations
  Clone ID: PAT_TA_81019.pep
XTPRPASPPXSRXRPPXXXQASTKLFXXQRLXXFRLSXNRSXXMLWYSEKSFKTXVMLLSQXLXXNSXFXXXARKX

SEQ ID NO: 186602 - protein, 138 aa, Triticum aestivum
  unsure (1)..(138): unsure at all Xaa locations
  Clone ID: PAT_TA_81020.pep
LSSXSXKLXIPGTXXRXYPSTNMQXTHXDTXTXHNDTXXXQACXARTHERGSPRKRPAYEXQQKKHTHGARXXHANXXRVERPGTHXTHPRMDGSDGAXEVGGALLAAXXKEEGQADGDXELDAENXGLDXGVEAHCX

SEQ ID NO: 186603 - protein, 55 aa, Triticum aestivum
  unsure (1)..(55): unsure at all Xaa locations
  Clone ID: PAT_TA_81021.pep
KEXASWGFVXAMFNXGIXHLXNXDGSXEHGFLGFRDTVXSFXAWVDXMRASXVVP

SEQ ID NO: 186604 - protein, 90 aa, Triticum aestivum
  unsure (1)..(90): unsure at all Xaa locations
  Clone ID: PAT_TA_81022.pep
LQNKATAMALSQSKASYPCKKRSTHSNTCTWSIITKPINLSFCKRLSFXTSASHNLTSWPSSTLWQSSILWHKPAAHPPFGGHISGCHQQ

SEQ ID NO: 186605 - protein, 158 aa, Triticum aestivum
  unsure (1)..(158): unsure at all Xaa locations
  Clone ID: PAT_TA_81023.pep
MQIFVKTLXTGKTITLEVESSDTIDNVKAKIQDKEGIPPDQQRLIFAGKQLEDGRTLADYNIQKESTLHLVLRLRGGAKXKRKKKTYTKPKKQKHKHKKVKLAVLQFXYKVDDATGKVTRLRKECPNADCGAGTFMANHFDRHYXGKCGLTXVYNQKV

SEQ ID NO: 186606 - protein, 180 aa, Triticum aestivum
  unsure (1)..(180): unsure at all Xaa locations
  Clone ID: PAT_TA_81024.pep
SVCKMIRTYCMSPTSRTGWTRVIVEKPFGRDLDSAEXLSSQLGELFEEDQLYRXDHYLGXELVQNLLVLRFANRLFLPLWNRGGYFDQYGIIRXIIQNHLLQVFCLVAMEKPVSLKPXEHIRDEKVKXLQSVNPXKXDKREXLGQXQGHKEDPTVPDDSKTPTVAXXVPRGHKERGEGXP

SEQ ID NO: 186607 - protein, 142 aa, Triticum aestivum
  unsure (1)..(142): unsure at all Xaa locations
  Clone ID: PAT_TA_81025.pep
MAEEKHHHHLFHHKKEGEDFQPAADGASTXYGYSTETVVTATGNEGEYERITKEEKHHKHKEHLGEMGAAAAGAFALYEKHEAKKDPEHAHKHKIEEEVAAAAAVXGAGGFXFHEHHEKKQDHKEAKEASGEXKKHHQFXRR

SEQ ID NO: 186608 - protein, 91 aa, Triticum aestivum
  unsure (1)..(91): unsure at all Xaa locations
  Clone ID: PAT_TA_81026.pep
IYPNDLKFIQFLHIPKLSPSSKLQLSQNIYVSPGSIYILWPDWHIGKXVLSRSLLLPSNFLGTLPYPNHCHMIIFRSIFLVNLSQEISKVS

SEQ ID NO: 186609 - protein, 146 aa, Triticum aestivum
  unsure (1)..(146): unsure at all Xaa locations
  Clone ID: PAT_TA_81027.pep
MQXFVKTLTGKTITLDVESSDTIDNVKAKXQDKXGIPPDQQRLIFAGKQLEXGRTLXDYNIQKXSTLXTLFLRLPGGMQIFVKTLTGKTITLXVESSDTIDNVKGXXXRQGGGFPPGPXVLTFXGKXLEDGWKXGDRKXRRSXLXL

SEQ ID NO: 186610 - protein, 64 aa, Triticum aestivum
  unsure (1)..(64): unsure at all Xaa locations
  Clone ID: PAT_TA_81028.pep
MTVLSTRNTTIPTKKEQGXXTYXDNQPXVXSQVVEGXRTRTRXNNXLXKXEXSXIPXXPRGVXQ

SEQ ID NO: 186611 - protein, 85 aa, Triticum aestivum
  unsure (1)..(85): unsure at all Xaa locations
  Clone ID: PAT_TA_81029.pep
SWGSIWRLDTHRPLQGPFSLRVTNXSGRSXXAEQVIPAXWXPXTVYSSLXQFDLPIHHPCTMHGVETSLVTSVCLRVLTCASRIR

SEQ ID NO: 186612 - protein, 131 aa, Triticum aestivum
  Clone ID: PAT_TA_81030.pep
AWINISASSNSFGGWFSSRTRLTSLFIPIMSREYLRKRLLIHWVPTLAPLTCPLLSIDLLKLLLHMPHSMLVCISLPRLHQGSFHDVPLAHARIIIQHYGSTGYTTLVTVTGLLLLIALLKLLLHMLHSML

SEQ ID NO: 186613 - protein, 74 aa, Triticum aestivum
  unsure (1)..(74): unsure at all Xaa locations
  Clone ID: PAT_TA_81031.pep
LAYCSYCMTFCMCDLXPGQSCXDPRFTGGDGNTFYFXXKKDQDFCIVXDKXXHINXHFXGXHXPGXXKXDFTWV

SEQ ID NO: 186614 - protein, 99 aa, Triticum aestivum
  unsure (1)..(99): unsure at all Xaa locations
  Clone ID: PAT_TA_81032.pep
MKGTKLAAILXLQAVLVMGLLSHVNADFXPKCCNNCRSFSGVDVCDDAHPKCPQGCSACXVVSTSPEMWRCXXMKSTVXXTCGXPCKNTDRFMPYMFLK

SEQ ID NO: 186615 - protein, 108 aa, Triticum aestivum
  unsure (1)..(108): unsure at all Xaa locations
  Clone ID: PAT_TA_81033.pep
KXPYXHLXXSXSEPXACXXLQXNPCVCXRCLEVVMNLQDXXPCRYYPILQXIKYQRSRFQNITXLLENRKHNGEAYALAKAATSLSPGRHVWLSVLPDIICIPMYLNA

SEQ ID NO: 186616 - protein, 50 aa, Triticum aestivum
  unsure (1)..(50): unsure at all Xaa locations
  Clone ID: PAT_TA_81034.pep
ARSLGAAIXYNXXQAWDDHWVXWVGPFIGAALAAIYHXXWIRXIPXXSRD

SEQ ID NO: 186617 - protein, 82 aa, Triticum aestivum
  unsure (1)..(82): unsure at all Xaa locations
  Clone ID: PAT_TA_81035.pep
GDEHEFEAPXDDAYXLXSAETXAGVELPYSCXAGACSXXAXXIEAXAVDQXYGSFLDDAXRGEGYVLXCIXYXKSXXVIHXH

SEQ ID NO: 186618 - protein, 107 aa, Triticum aestivum
  unsure (1)..(107): unsure at all Xaa locations
  Clone ID: PAT_TA_81036.pep
LPXXHXKYXLGQQXXEXKECYRRWRXDASEXXDCCCXVLLGVRAXAXIPGXPVXTGHSPGCCTRHCPXNKILIIYSIKSDXXYVNSSGWNVDGEAFLTRPVAGPPST

SEQ ID NO: 186619 - protein, 52 aa, Triticum aestivum
  unsure (1)..(52): unsure at all Xaa locations
  Clone ID: PAT_TA_81037.pep
SSTTXQNPXXNQXLTMQLFDDXXNAIKLGSKTYXQSVXLPVLLMKMIRTQNS

SEQ ID NO: 186620 - protein, 100 aa, Triticum aestivum
  unsure (1)..(100): unsure at all Xaa locations
  Clone ID: PAT_TA_81038.pep
PAPQAGXQGRXFXNHRXXVGAAAXRGLQLVGPRRGGGXRYXGVDXGRRXSHGERRAQDVRTRXQSQAAALRQFTDEFLATRAAIRLSILILFFXFELDFS

SEQ ID NO: 186621 - protein, 57 aa, Triticum aestivum
  unsure (1)..(57): unsure at all Xaa locations
  Clone ID: PAT_TA_81039.pep
IKRCIAFKESNGIPLRVQTSTEALRFIXSVKKASTPESSSDNKECFCQIQMNLGMKE

SEQ ID NO: 186622 - protein, 65 aa, Triticum aestivum
  unsure (1)..(65): unsure at all Xaa locations
  Clone ID: PAT_TA_81040.pep
KRXXPRXRXTXXIDREXHPTXQXXRXLXLPXKFKXLALDXKCXVVRVMYMVGDVLPFVNSEXYLC

SEQ ID NO: 186623 - protein, 57 aa, Triticum aestivum
  unsure (1)..(57): unsure at all Xaa locations
  Clone ID: PAT_TA_81041.pep
IXIXXLAXVLLSMSSXFXLAWFVXLXFCFYATXYXXLFVGXXXQSPPXLFYYNXRIN

SEQ ID NO: 186624 - protein, 141 aa, Triticum aestivum
  unsure (1)..(141): unsure at all Xaa locations
  Clone ID: PAT_TA_81042.pep
XKGXPSPPFFXXNHXLRXEXXANPFXXXIXQKXVNPFXLXXXNFXXPXXLVXHXHPXTXFIXFXGLXGLAPRTFYLXSEPSXLRCKTNVYTCNLFTKKFQLHCLALYYLELIVQFPVLSHNTLHFTFCLLCSVLGLFILIL

SEQ ID NO: 186625 - protein, 46 aa, Triticum aestivum
  unsure (1)..(46): unsure at all Xaa locations
  Clone ID: PAT_TA_81043.pep
XXDXFFSFFFXXLTSXLTXXGLAINILAXFIFALVXVKIIRAXIDK

SEQ ID NO: 186626 - protein, 80 aa, Triticum aestivum
  unsure (1)..(80): unsure at all Xaa locations
  Clone ID: PAT_TA_81044.pep
SELTMTSVGYAVANIDLMLDGGQNWTLPGASSLVQVNDQTVCFAFVQTDSSVPAHAESPAVILGGHQLEENLXIFXLXRD

SEQ ID NO: 186627 - protein, 71 aa, Triticum aestivum
  unsure (1)..(71): unsure at all Xaa locations
  Clone ID: PAT_TA_81045.pep
MGKMPVRMKAVVYALSPFQQQVMPGXWKDXXXXIHXKVSEXWIXAKFFIXPVVXTTXXVXXKGAGKXFSQK

SEQ ID NO: 186628 - protein, 123 aa, Triticum aestivum
  unsure (1)..(123): unsure at all Xaa locations
  Clone ID: PAT_TA_81046.pep
FDEIDDGNSAVCSYLQLFVMLLDKKQHVHDLRERGVIQGGGLTSSETLLFFICIGKNMRVGRNYLKIMVKVEDFKQKMTCCVKLWLSIKKNRTRIVTVISAIGVVIGILSSLPALKPRKTXRT

SEQ ID NO: 186629 - protein, 82 aa, Triticum aestivum
  unsure (1)..(82): unsure at all Xaa locations
  Clone ID: PAT_TA_81047.pep
RKYFDRXVCRLFLXGLCPHDLFQLTKMDLGPCPKVHSLQLRKDXXEVKXKGXENFDRDLEDMXDRLIXEXXRKIQRALKRLA

SEQ ID NO: 186630 - protein, 119 aa, Triticum aestivum
  unsure (1)..(119): unsure at all Xaa locations
  Clone ID: PAT_TA_81048.pep
EFFFFFFFFXFFLXEPXLXIHFSSDGPFQRXTHKLXEXKXKISQXTKTPIANXTXTPTRXPAXISLFALDXXRNNHHKXINXLHXSQLQGSXLKLAXQLXXWXAHXXFGGXPRTXPWGX

SEQ ID NO: 186631 - protein, 61 aa, Triticum aestivum
  unsure (1)..(61): unsure at all Xaa locations
  Clone ID: PAT_TA_81049.pep
VARTGXKPXPNXVXSSRXQPRTGTNEMPIYTPVPESRAVEYFLFLAGRGEFSGALAHLLCT

SEQ ID NO: 186632 - protein, 100 aa, Triticum aestivum
  unsure (1)..(100): unsure at all Xaa locations
  Clone ID: PAT_TA_81050.pep
VIRRSMAMERFFTALVFPEALLDGYGTSVLSAGAVNRLVSGGGSATKPAVTSKADAEEXFXXGAXKFDSAKARCVRARVRRAQLLRHHCHALXTTSVCXF

SEQ ID NO: 186633 - protein, 155 aa, Triticum aestivum
  unsure (1)..(155): unsure at all Xaa locations
  Clone ID: PAT_TA_81051.pep
REMLFGISYMLFNLWLTAYLIGNMTNLVVHSTSRTRDFRDMVQAATEFAARNQLPRQIEEQMLNHICLRFKAEGLKQQDTTFWGGXDILPKAMRSSISLYLFFPVVQGAYLFRGVSPSFIQQLVTEMXAEYYAPKEDIILQNXYPSDXHLLVTXE

SEQ ID NO: 186634 - protein, 81 aa, Triticum aestivum
  unsure (1)..(81): unsure at all Xaa locations
  Clone ID: PAT_TA_81052.pep
SQIIPSFQTVISMASAIILIADSPLWGGSTYSSYSCVFLPKTSFKFLFPAIIPGVLDACESNLIXXXGPTPRGSFLFQPAI

SEQ ID NO: 186635 - protein, 36 aa, Triticum aestivum
  Clone ID: PAT_TA_81053.pep
VSDKNKFFDVECCSSSHIILFFFIAWTFGLLCDSKQ

SEQ ID NO: 186636 - protein, 156 aa, Triticum aestivum
  unsure (1)..(156): unsure at all Xaa locations
  Clone ID: PAT_TA_81054.pep
DPNEGHYLTASLNFRGSTIRTREVDDQMLQFQKKHSAAFVDWIPNNVKSSVCTVPPTDVPRSGTFLANTTSMQQLFQRVIEQFXLXXPXAMFKRKAFLHNYVNEGLDISELTEAESNIQDLIYEYQXYDAATAADDFESKVRPLMVWSMTLQRKLT

SEQ ID NO: 186637 - protein, 144 aa, Triticum aestivum
  unsure (1)..(144): unsure at all Xaa locations
  Clone ID: PAT_TA_81055.pep
KAGGPRKKSVTRSVKAGLQFPVGRIGRYLKKGRYAQRVGTGAPVYLAAVLEYLAAELLELAGNAAKDNKKSRIIPRHLLLXLGFFXRNDEELGKLLAGVXIAXVXXIPKXKXXVLPKRTXEKXGXGAXVFLRRRPSSPKKTTKA

SEQ ID NO: 186638 - protein, 87 aa, Triticum aestivum
  unsure (1)..(87): unsure at all Xaa locations
  Clone ID: PAT_TA_81056.pep
NQTPHQSRTRTAHRRPRRRREEKXEMEAAAAAAGVQLGTSKPQIATQAEMAEARLPIPYRDQCAHLLIPLXKCRVAEFYLPWGEKKK

SEQ ID NO: 186639 - protein, 94 aa, Triticum aestivum
  unsure (1)..(94): unsure at all Xaa locations
  Clone ID: PAT_TA_81057.pep
YFFKLCFLSIGYLNNKSNNLKIFXYLTHDLHLSIILYNHLGDNMRSRFLVYYIILFKLQXRNKTGSTRRLXVVFALLAHLNCXGPMMATSVHTG

SEQ ID NO: 186640 - protein, 53 aa, Triticum aestivum
  unsure (1)..(53): unsure at all Xaa locations
  Clone ID: PAT_TA_81058.pep
MAFEKIKVANPIVEMDXDEMXRXFWXSIKDXLXFPXXDLXIKYFXLGVLXRXA

SEQ ID NO: 186641 - protein, 59 aa, Triticum aestivum
  unsure (1)..(59): unsure at all Xaa locations
  Clone ID: PAT_TA_81059.pep
TLFLLLCPFYAWRDPYFVVVDECLEDIXWYISHLFEMINLVLNLVASEAYQSLPQVFRL

SEQ ID NO: 186642 - protein, 99 aa, Triticum aestivum
  Clone ID: PAT_TA_81060.pep
SRYGILSVKRQISNMQKPSVLRGSGFSSPIQFSTNSKPCTIVVTDSNVAAVLLQLLAFCLSFCVCGCAGLAQSSRVSRRPGAPAAGGRVRAADLGGKDR

SEQ ID NO: 186643 - protein, 77 aa, Triticum aestivum
  unsure (1)..(77): unsure at all Xaa locations
  Clone ID: PAT_TA_81061.pep
SXAGSRDXXHNDTCWLPPSQPPYRCRDLELAEAWPFAALSLLHSIKVSTVILYHVSLSRKDCNRPSHLCLPAMLVVL

SEQ ID NO: 186644 - protein, 63 aa, Triticum aestivum
  Clone ID: PAT_TA_81062.pep
LIYRSVFYGELAYNQAIHHIIKPSGALHTIPTKSTVSVAPTKQLPAFPQLTAAAFPQLLVAFS

SEQ ID NO: 186645 - protein, 85 aa, Triticum aestivum
  Clone ID: PAT_TA_81063.pep
AEVLELAGNAAKDNKKTRIVPRHLLLAIRNDQELGRLLSGVTIAHGGVIPNINPVLLPKKAAEKAEKPAPPPIAQEATNPPRHQA

SEQ ID NO: 186646 - protein, 94 aa, Triticum aestivum
  Clone ID: PAT_TA_81064.pep
RNGCQSATGASHPTLTRAVRSARSISLSAALSARRTRERTVVFPFGSCGHVFHVCCIAGWVKKDKDSTKTSVRSISRPLGTLPTRFPFSEGPAE

SEQ ID NO: 186647 - protein, 91 aa, Triticum aestivum
  Clone ID: PAT_TA_81065.pep
NNRVTDPNKLSNQFYKNVASGQVLFTSDQTLMDETPTTGNKTAAMVADNAANPIAWMVRFAGAMVKMGGIEVLTGTGPANQKACNTTNNAS

SEQ ID NO: 186648 - protein, 86 aa, Triticum aestivum
  unsure (1)..(86): unsure at all Xaa locations
  Clone ID: PAT_TA_81066.pep
NKGTLNDPSYHLSAWGGASSDLGCYFXFISVPNCQESTMVLGCLRXYGLCFPIGTFLFFEGXLVNSAEIMIALANARRVQCAXVXL

SEQ ID NO: 186649 - protein, 59 aa, Triticum aestivum
  Clone ID: PAT_TA_81067.pep
LTSTLLISQYSIVTKRATIATSYTAKELSFPLPSKRNTHLLGGSSSSSVAKFSRTRPAS

SEQ ID NO: 186650 - protein, 89 aa, Triticum aestivum
  unsure (1)..(89): unsure at all Xaa locations
  Clone ID: PAT_TA_81068.pep
MKGTKLAAILILQAVLVMGVLSHVNADFFPKCCNNCRSFSGVDVCDDAHPKCPKGCSACRLVSTXPEMWRCADMNXXSNGTCXGPCKIR

SEQ ID NO: 186651 - protein, 118 aa, Triticum aestivum
  unsure (1)..(118): unsure at all Xaa locations
  Clone ID: PAT_TA_81069.pep
NKLMLPTAGRLALITSVLYALPVFQILAIEPPRWAVKKFDKRCRGFLWANKDEATGGKCLVNWKQVCLPKXLGGLXGIPCLLQKSEAMRCKWLWFPWDGHYATWAWLTLSNNNSVGLL

SEQ ID NO: 186652 - protein, 119 aa, Triticum aestivum
  unsure (1)..(119): unsure at all Xaa locations
  Clone ID: PAT_TA_81070.pep
CRKTLSVPPKDHLSCWFFSYMAGSKHVSSCTCILIMLVVSSHLASCPCEARRLMAASAKINGDEACMSAGCRAVQGTASGTAEATWKMATTDSRGTAPGHSPGIGNKLHAAXTVTVKRN

SEQ ID NO: 186653 - protein, 186 aa, Triticum aestivum
  unsure (1)..(186): unsure at all Xaa locations
  Clone ID: PAT_TA_81071.pep
MVPSKVALFLALNLVLMAAAHGCGSYCSNTPAIPVPTPPMAMPPPVIPVPTPPTTGGGSGTCSXNTLKLKACANVLNLLKSTSXAGKRGCCPLLXGLADXDAAVCLCTAINANVSGSNSKSCXLVLLLNNAERPRRTAQLITISSLMHQNMISSLMTMLFPWRTLKTPHRIRNKRLNLKFGKKKKK

SEQ ID NO: 186654 - protein, 137 aa, Triticum aestivum
  unsure (1)..(137): unsure at all Xaa locations
  Clone ID: PAT_TA_81072.pep
GXEIVXXFVXVYXVXXXXDAKRXARDXHVPTFXXXLXIGFAVFLVHLSTIPITGTGIXPXRSLSXAIXXNXKXAXXDHGXFWVGXFIXAAXXAIYXXVVIXAIXVKPPINLLYCGHRVFVELLALCFSTPFLLSSSQ

SEQ ID NO: 186655 - protein, 198 aa, Triticum aestivum
  unsure (1)..(198): unsure at all Xaa locations
  Clone ID: PAT_TA_81073.pep
VPRNQDAGLAELPATVAALKNPNSKILYDQYNHERYPPGDPSKRAFAYFVLSGGRFVYASLLRLLVLKFVLSMSASKDVLALASLEVDLSSIEPGSTVTVKWRGKPVFIRRRTDDDIKLANSVDVASLRHXEQDAERVKXPEWLVVMVSHHPGSXPSNSGDXGGWXAVHGPHNLGSQGLPVNLGPLSSEIQIQANIHA

SEQ ID NO: 186656 - protein, 80 aa, Triticum aestivum
  unsure (1)..(80): unsure at all Xaa locations
  Clone ID: PAT_TA_81074.pep
ASSIWTLHRLAWAYDPAVGIFQVSRGTDYSSVYMXSIVRPKAFSASKEVGKTVRPKVGFTVVPGFRLGGTVIQCRVYLES

SEQ ID NO: 186657 - protein, 122 aa, Triticum aestivum
  unsure (1)..(122): unsure at all Xaa locations
  Clone ID: PAT_TA_81075.pep
FVSLRALVRFETCNPLAHVFLSIRTVPVWDVFNEKGYFSGSLCVSEAHAKERTLLILRITMSPGKRLAIPPLXQRXKLSXEXGATRLXXRXFLQRNTTXSSRXXLXRKXXRWFXXKQVKXPF

SEQ ID NO: 186658 - protein, 85 aa, Triticum aestivum
  Clone ID: PAT_TA_81076.pep
YHRGLAVRGNGDSDGRGEGSGGGRGWAQCAVCLSLVKEGEVVRQLPACMHLFHVGCVDTWLHSHSTCPLCRATVEPPSKDQVPPV

SEQ ID NO: 186659 - protein, 149 aa, Triticum aestivum
  unsure (1)..(149): unsure at all Xaa locations
  Clone ID: PAT_TA_81077.pep
MLVYQDKLSGDELLSDSFPYRELENGVLWEVDGHWVVQGAVDVDIGANPSAEGGGDDEGVXDTKAVKVVDIVDTFRLQEQPAFDKKXFISHMKRYIKNSXCQLEGDDLNAFKKNVESATKYPPNKLKDLXXLLXKHHDDAAGVAYTRRC

SEQ ID NO: 186660 - protein, 110 aa, Triticum aestivum
  Clone ID: PAT_TA_81078.pep
GVRLSIAIESADALVYMHSKTNAKIIHGDVKPANILLDDKFAPKISDFGISRLIARDKKHTGSVIGDMSYIDPVYLQTGLLTEKSDVYSFGCCHTGNLLSGQKHILMAAA

SEQ ID NO: 186661 - protein, 162 aa, Triticum aestivum
  unsure (1)..(162): unsure at all Xaa locations
  Clone ID: PAT_TA_81079.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQXELGRLLAGVTXAHGGVXPNINSVLLPKXPAAAEKEASPQEEDTQVPKKKSRERPINRLLINPINRSILYPYS

SEQ ID NO: 186662 - protein, 134 aa, Triticum aestivum
  unsure (1)..(134): unsure at all Xaa locations
  Clone ID: PAT_TA_81080.pep
MSCNCGSGCSCGSDCKCGKVYPDLTEQGIAAAQVAXVXVLGVAPENKAGHFXVAXGHSGXGLQLRXXCXCNPCKLLSCMHSYLYCVKSRKRTSDLMSKGCTAGIAGPQTRPGLWFPNGSPTVEFQFKWGFPNNP

SEQ ID NO: 186663 - protein, 75 aa, Triticum aestivum
  unsure (1)..(75): unsure at all Xaa locations
  Clone ID: PAT_TA_81081.pep
MSCNCGSGCSCGSDCKCGKMYPDLTEQGSAAAQVAAVVVLGVAPENKAGQFEVAAGQSGEGCSCGDNCXCNPCNC

SEQ ID NO: 186664 - protein, 57 aa, Triticum aestivum
  Clone ID: PAT_TA_81082.pep
PPFFLEGVENCRMHKSLNKKLPDLRKEKKILRNARKLKQKTARSQKRKKYCRMRGKH

SEQ ID NO: 186665 - protein, 190 aa, Triticum aestivum
  unsure (1)..(190): unsure at all Xaa locations
  Clone ID: PAT_TA_81083.pep
LAVCNLLSGACHVLPPLRCDWFFDYFGTSAHAVLTGADCCPDDGQRQSPDPASFKVLVAGVSDDRRHYVLRTFSSGDPSWSAPSECFDPVERGIFGPFKRRSAVVSHGTAHWVLWDLVKFHVLDVNAATRHASLQELQTRRRRATPPVRFAASERRTNKGRPVSLVVNQDPSGIGPXDXEXSTRCGXMXP

SEQ ID NO: 186666 - protein, 111 aa, Triticum aestivum
  unsure (1)..(111): unsure at all Xaa locations
  Clone ID: PAT_TA_81084.pep
DSSVSXSPLLFSSLPLVSSLSSSVSLPPSSSLPLVSSLSSPSESDSPSKVSARWLGLAPASFLISAAAALHSEGVASSSSRYILASIQALSISHLSKKLRYILMMKMRPAR

SEQ ID NO: 186667 - protein, 144 aa, Triticum aestivum
  unsure (1)..(144): unsure at all Xaa locations
  Clone ID: PAT_TA_81085.pep
RNWYLGPDFYYAVKIGIVQYMILKPICAILAILLELLGIYGEGKFAWRYGYPYLAVVLNFSQTWALYCLVQFYTATKEKLEPIKPLSKFLTFKSIIFLTWWARYAVAFLFSTGLFNGXLAQSLQTRIQXDYIICLEKGVXAMVI

SEQ ID NO: 186668 - protein, 101 aa, Triticum aestivum
  unsure (1)..(101): unsure at all Xaa locations
  Clone ID: PAT_TA_81086.pep
IARFLKAGKYAERVGAGAPVYLAAVLEYLAAEVLELAGNAARDNKKTRIVPRHIQLAVRNDXELNKLLGGXNIANRGVIPTSTTLLPKKALLQGQRSIRQN

SEQ ID NO: 186669 - protein, 78 aa, Triticum aestivum
  Clone ID: PAT_TA_81087.pep
HQQNASRTLYMPHRGVSRFLIGNKKERTLRSPNYTCHHGQRHHQQWASRGRRQPHPDQRWRRPDSAALLRARQDLGGA

SEQ ID NO: 186670 - protein, 57 aa, Triticum aestivum
  unsure (1)..(57): unsure at all Xaa locations
  Clone ID: PAT_TA_81088.pep
RWXTRHTSXYRXTERYTHYTRTLNHQDKXIXPLLAISKQRKRPTXERXARDETKQWX

SEQ ID NO: 186671 - protein, 75 aa, Triticum aestivum
  unsure (1)..(75): unsure at all Xaa locations
  Clone ID: PAT_TA_81089.pep
XATAFIXSPASHVSXXTXSPXXYDXSAGHXXXCXXSPMXEPYAYPPAVQVPNVGXGMQYQAPRMTYPIYTXLXQL

SEQ ID NO: 186672 - protein, 48 aa, Triticum aestivum
  Clone ID: PAT_TA_81090.pep
FFFLAKQNSFLKTCTTIPVFLRSGEFHEQTGSNMPDDIVNQNPEEKLS

SEQ ID NO: 186673 - protein, 105 aa, Triticum aestivum
  Clone ID: PAT_TA_81091.pep
GGLPCNTDIEENIGDNYSNNPPKLLESLRIDGYTCKGQLLPWLLKDNKLPALVKVTLQNTYLNKGNMEHLAELDNLCCLRLMCRAYTDSRSPSFVLNSKAQVSSR

SEQ ID NO: 186674 - protein, 91 aa, Triticum aestivum
  unsure (1)..(91): unsure at all Xaa locations
  Clone ID: PAT_TA_81092.pep
GKGGAKRHRKVLRDNIQGITKPAIRRLARRGGVKRISGLIYEETRGVLKIFLENVIRDAVTYTEHARRKTVTAMDSLRAQXQGRTXYGFGG

SEQ ID NO: 186675 - protein, 122 aa, Triticum aestivum
  unsure (1)..(122): unsure at all Xaa locations
  Clone ID: PAT_TA_81093.pep
MAPVKLYGATLSWNVTRCVAALEEAGVEYELVPINFGTGEHKXPDHLAKEPFGQVPTLQDGDXYFFXSRXXCKYACRKNNQTXKEGDIKINMVVFCPSGGHIAPTHPSCHPSGDPTKVYKLK

SEQ ID NO: 186676 - protein, 135 aa, Triticum aestivum
  unsure (1)..(135): unsure at all Xaa locations
  Clone ID: PAT_TA_81094.pep
SHPPPTSPSSSPIAADLVPPSPPRISRPPLRTRRSSERPSAPVLAASSHDSPHPSPTRGAPPVVLHAAAGNHQPQLAGASRWCTPPPWTLASPTLQRAAPMPIPPRRSAPPSRXSPKXKRRRCLPPRHGSPASSG

SEQ ID NO: 186677 - protein, 104 aa, Triticum aestivum
  unsure (1)..(104): unsure at all Xaa locations
  Clone ID: PAT_TA_81095.pep
TRGRKKGSKAKKGVETYKIYIFKVLKQVHPDIGISSKAMSIMNSFINDIFEKLAGESAKLARYNKKPTITSREIQTSVRLVSPXLAKHAVSEGXTKAVTNSTSS

SEQ ID NO: 186678 - protein, 169 aa, Triticum aestivum
  unsure (1)..(169): unsure at all Xaa locations
  Clone ID: PAT_TA_81096.pep
TGFRIHGQGWRSMYCTMERDAFCGIAPINLTERLHQIVRWSGGSLEMFFSLNNPLIGGRRIQSLQRVSYLNMTVYPVTSLFILLYALSPVMWLIPDEVYIQXPFTKYVVFLLVIILMIXVIGWLEIKWAGVTWLDYWRNEXFFMIGSTXHTNNRAMVGNPYEGIQTRTA

SEQ ID NO: 186679 - protein, 140 aa, Triticum aestivum
  unsure (1)..(140): unsure at all Xaa locations
  Clone ID: PAT_TA_81097.pep
MAPKAAEKKPVERTPAGKKPKAEKKVPASKEGGDKKGKKKAKKSVETYKIYIFKVLKQVHPDIGISSKAMSIMNSFINDIFEKLAGESAXLAXYNKXPTITSREIQTSXRLVSPASRKHAVSXGTKXSQINSSSPALIQC

SEQ ID NO: 186680 - protein, 123 aa, Triticum aestivum
  unsure (1)..(123): unsure at all Xaa locations
  Clone ID: PAT_TA_81098.pep
MARTKQTARKSTGGKAPRKQLATKAARKSAPATGGVKKPHRFRPGTVALREXRKYQXKSTELLIRKLPXQRLVREIXQDXKNDFAFILRRRLQEARLTGWALPGNSGHPSKGTSCQGINFAAR

SEQ ID NO: 186681 - protein, 43 aa, Triticum aestivum
  unsure (1)..(43): unsure at all Xaa locations
  Clone ID: PAT_TA_81099.pep
LEGTKPXIXTTNKXXFLXYXTPSHLAXPFRXDYFEVXLSLVXC

SEQ ID NO: 186682 - protein, 100 aa, Triticum aestivum
  unsure (1)..(100): unsure at all Xaa locations
  Clone ID: PAT_TA_81100.pep
WQGGLGHRRLSPRWHCATPDSAAWIAMVAALVPGDTTSGVLCGISQVTASACPMAYIATPTRRRNYGDIGLLIPXTXIXLLCXXPKXXRREXNAGFSVXX

SEQ ID NO: 186683 - protein, 134 aa, Triticum aestivum
  unsure (1)..(134): unsure at all Xaa locations
  Clone ID: PAT_TA_81101.pep
KLNYSNFEEFVHCHSENXPDKFALEXAHSEGLGNRIIGPQLGASCQFPEMISVPWRSIYRGDVPFLLNVNHKGVQVFLGNFSSTPTSCEEDYIFLECNQMHMLIMSDQRWHVSAFYKSCKPNRLVVMFKTTCRH

SEQ ID NO: 186684 - protein, 78 aa, Triticum aestivum
  unsure (1)..(78): unsure at all Xaa locations
  Clone ID: PAT_TA_81102.pep
MSCCGGNCGCGTACKCGNGCGGCNMYPEVEAAGATLLVSATATPKASSGGMEMAAENGGCGCTQCKCGTSCXCSCCSC

SEQ ID NO: 186685 - protein, 100 aa, Triticum aestivum
  unsure (1)..(100): unsure at all Xaa locations
  Clone ID: PAT_TA_81103.pep
AXMSXECYXPXTXEXXXAXXVGXXILXHXRWFRGLXGSXVXGGXSAXNDXMXLMFVXVMLPSVXFEIFKIERKGVISNVHXKSXVSKKLKQIYLAKRSSI

SEQ ID NO: 186686 - protein, 135 aa, Triticum aestivum
  unsure (1)..(135): unsure at all Xaa locations
  Clone ID: PAT_TA_81104.pep
AGVGERTREGNDLYREMIESGVIKLDEKQAESKCALVYGQMNEPPGARARVGLTGLTVAEHFRDAEGQDVLLFIDNIFRFTQXANSEVSALLXGRIPSAVXGYQPILATVLGRTARAVTTTKKXXITXSKLLSAC

SEQ ID NO: 186687 - protein, 91 aa, Triticum aestivum
  Clone ID: PAT_TA_81105.pep
SREIRKCSKELCATLQLPTEHKTIMVFMPTIRMYNPANYHYRSTKSTQLLNLYPTLTRNLHQSQRTSQNNPHSSVFLPVCRLKRPTMWGTT

SEQ ID NO: 186688 - protein, 36 aa, Triticum aestivum
  Clone ID: PAT_TA_81106.pep
QGCSACRVVSTSPEMWRCADMKSTVDGTCGGPCKKY

SEQ ID NO: 186689 - protein, 83 aa, Triticum aestivum
  unsure (1)..(83): unsure at all Xaa locations
  Clone ID: PAT_TA_81107.pep
XTMQINTVEGISSAXDDGVLRSNSNRGSTDSNPPSYQQDLQDNTRLDSQRSCVDDEHISPTPPSQVLALTWHYYMWLHVAYDL

SEQ ID NO: 186690 - protein, 93 aa, Triticum aestivum
  unsure (1)..(93): unsure at all Xaa locations
  Clone ID: PAT_TA_81108.pep
FVXGREPMAPMARSMAYFNLLLLDGHRGWCHRSNLLLLMGTGHEVTISIQRQRRCGSSLPRCQWRGSERGPPQPAGSINLCSLAFYRNTGSIL

SEQ ID NO: 186691 - protein, 109 aa, Triticum aestivum
  unsure (1)..(109): unsure at all Xaa locations
  Clone ID: PAT_TA_81109.pep
MGAYKFVSELWRRKQSDVMRFVQRVRCWEYRQQPGIVRITSQPPDKARRLGSRQARVCVYRIRXKXXGXKRXIPKGIVXGXPTQGITQLNFKXKKALKTGPSGCLCQGE

SEQ ID NO: 186692 - protein, 191 aa, Triticum aestivum
  unsure (1)..(191): unsure at all Xaa locations
  Clone ID: PAT_TA_81110.pep
DSTKYRSLVGALQYLTLTRPNISFAVNKVCQFLHAPTIVHLTAAKRIVRYVKNTLNIGLNFSKSSSTLLSAFSDSDWAXCLDDRRSTGGFAVFFGPNLISWCARKQATVSKVQXTKQEYKALANATAEIIWMQSPXXELGVKSKQLXMLRCDNCXATYLXXNLFSCXMKHIELXXFVKMAKTLEFVIQDRF

SEQ ID NO: 186693 - protein, 71 aa, Triticum aestivum
  unsure (1)..(71): unsure at all Xaa locations
  Clone ID: PAT_TA_81111.pep
LRKWDVIXNLIAVGYKIYLVGSTCRRISPVNHYVYXITPGTLRTPXIVKFEXRVQLXCRIIIKFGRXIKDR

SEQ ID NO: 186694 - protein, 75 aa, Triticum aestivum
  unsure (1)..(75): unsure at all Xaa locations
  Clone ID: PAT_TA_81112.pep
XCCFSGTNLYFSFXKCVLNFSSGQGGPLIITQWFQFCHRAKIRGGRHLCICFRDHFKAQPGFHTAPPLDAPSTTL

SEQ ID NO: 186695 - protein, 170 aa, Triticum aestivum
  unsure (1)..(170): unsure at all Xaa locations
  Clone ID: PAT_TA_81113.pep
RLIAGSTWLGFGGRYQDLIGQKGLDAVTLGRAQMAAAVDVLAKHGTTNALEEEEEGVHADPYAVPKTMLAKLVIMVCEGLRFLTVSGRVDREFDMAEVTITEIXGKQVNKWDTISAAVFKWAVDPTAPFPDLVALDVNNKTDAEXRLLVKXKLPGVHRVRKEHIDRCLCL

SEQ ID NO: 186696 - protein, 111 aa, Triticum aestivum
  unsure (1)..(111): unsure at all Xaa locations
  Clone ID: PAT_TA_81114.pep
WWXSXNVCGXXMGVXFSEXXXXDRESDXXXLXEDTGNESAGLQTGTPLIFQHSVRRRRIRRVPRMPXPCLCYLLREXEKTFSWLGLDVIVRPSAKEFLYFLFFLYRFFIPS

SEQ ID NO: 186697 - protein, 95 aa, Triticum aestivum
  unsure (1)..(95): unsure at all Xaa locations
  Clone ID: PAT_TA_81115.pep
FNIFLSGLEKSSDLXKFSFLWEVPXCWIIWXXXKHWXGKNVVKTLGSTHXRQGKDXPAVXRNSFPIRAQDXKPIXSIGSKKWSQNKVIKGVQHPS

SEQ ID NO: 186698 - protein, 95 aa, Triticum aestivum
  unsure (1)..(95): unsure at all Xaa locations
  Clone ID: PAT_TA_81116.pep
LGTGIFKILGSRYNLILIVDSRWVSPVHCVXLRKGGITVVPNDKNELIPQRIITGYRMVIDYRKLNKETRKYHYPLPYIDQMLERLSKHTQFCFL

SEQ ID NO: 186699 - protein, 181 aa, Triticum aestivum
  unsure (1)..(181): unsure at all Xaa locations
  Clone ID: PAT_TA_81117.pep
QRLIFAGKQLEDGRTLADYNIQKESTLHLVLRLRGGMQIFVKTLTGKTITLEVESSDTIDNVKAKIQDKXGIPPDQQRLIFAGKQLXEDGXTLADYNIQKESTLHLXLRLXEDAXFVKTSLGXTITXEVXHPTHRQCXSKVXDKEGFPRTXASISWKXLXDXXPHIRGSTSPWSEHQWKPA

SEQ ID NO: 186700 - protein, 153 aa, Triticum aestivum
  unsure (1)..(153): unsure at all Xaa locations
  Clone ID: PAT_TA_81118.pep
NFQIFHITVVVVHVRRRKQLXAVRESYLSFVIKHALFPPRNHXPSXKLLXFVKGMCPNFIQHVNFLTHHHGGMTXSTKVQCVXXIPKKLELNASXSTIHISVQVRDNMSKIXQXTHWNYSKXSQYDCNXRXHXXKCQLLXEXPKXKACPNSNS

SEQ ID NO: 186701 - protein, 94 aa, Triticum aestivum
  unsure (1)..(94): unsure at all Xaa locations
  Clone ID: PAT_TA_81119.pep
MMXMEPHGGVVGSVXPDSFXPYPHRNGVLYXIXYVAFWWADXGAXXADNGWINGLYGFMEPLXSXNPXXAFVNYRDLDIGXNXVGDGVTPFLPV

SEQ ID NO: 186702 - protein, 174 aa, Triticum aestivum
  unsure (1)..(174): unsure at all Xaa locations
  Clone ID: PAT_TA_81120.pep
PPVSAHLLRLRRRRTHRGSSDSPDQERRAGRKSTYAGGEEMGLTFTKLFSRLFAKKEMRILMVGLDAAGKTTILYKLXLGEIVTTIPTIGFNVETVXEYKNISFTVXWDVXGQGQXKXLWXRHYFKNTXGLILVCGNNDRDXXFLXKDDSNRMLNEDDYSVRLCCQLKCHNANY

SEQ ID NO: 186703 - protein, 199 aa, Triticum aestivum
  unsure (1)..(199): unsure at all Xaa locations
  Clone ID: PAT_TA_81121.pep
LSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLXFFVGESMHDDGGVVFAYYKEGLLINFLYXAHGLKEMLIHVKSSQYFLAQCSHSQVVSYNNVSAKLSMWILEKLVLVC

SEQ ID NO: 186704 - protein, 95 aa, Triticum aestivum
  unsure (1)..(95): unsure at all Xaa locations
  Clone ID: PAT_TA_81122.pep
VDMAQADTDVNLACMAVRMIQCCEIDRLVDPRLGYGSSASETKGTIDMVXXVASRCLKPEQDVRPXIGKVLDVLKQLNHSINREGDLRLLMARVW

SEQ ID NO: 186705 - protein, 129 aa, Triticum aestivum
  unsure (1)..(129): unsure at all Xaa locations
  Clone ID: PAT_TA_81123.pep
IVQVDAAPFKQWYLTHYGVEIGRKKKAAAAAKKDAAEGQESEVAAAATEEAKKSNNVQRKLEKRQQGRTLXDSHIEDIQRWEGCWACISXSRPGTVWXELNGYIXLXRARTGFYMXNSXKKKGKVPHLS

SEQ ID NO: 186706 - protein, 154 aa, Triticum aestivum
  Clone ID: PAT_TA_81124.pep
PILSYARPVAAPPRRPTLPWRWIRAPPPGRTREATNRTSTATLVNGLTNLCTTFTHRAAPRRRLPQIEDDRTAATSCSPGEQPTPLRRVEWHPHPHPCSTFFLLSLHHRGFLHEACSSPPALHRHASRTASLFESSLLCLRAYSVLVIKLEETQ

SEQ ID NO: 186707 - protein, 53 aa, Triticum aestivum
  Clone ID: PAT_TA_81125.pep
IISRHKNGFRLSFCCPSCQDVEHWLNLAVSSWPRLNFRTEVNLAIRVPVQKKK

SEQ ID NO: 186708 - protein, 67 aa, Triticum aestivum
  Clone ID: PAT_TA_81126.pep
FFFFDTCKFLTIGGIDQFSSVQFTWCINFQLFEFLRISPHVCRALRASEQGWLAGELSSSSPSGDGD

SEQ ID NO: 186709 - protein, 170 aa, Triticum aestivum
  unsure (1)..(170): unsure at all Xaa locations
  Clone ID: PAT_TA_81127.pep
MARTKQTARKSTGGKAPRKQLATKAARKSAPATGGVKKPHRFRPGTVALREIRKYQXKSTELLIRKLPFQRLGEGVAQDFKTDLRFHPPPSPPCKRPPILLVGSSTQTLRHPRQRVTSCPKDIQLARRIRGEKAKLCACRRRRLTRCVSGECVLYVVLHGGCMYRCHSCV

SEQ ID NO: 186710 - protein, 78 aa, Triticum aestivum; identical to SEQ ID NO: 106980
  Clone ID: PAT_TA_81128.pep

SEQ ID NO: 186711 - protein, 102 aa, Triticum aestivum
  unsure (1)..(102): unsure at all Xaa locations
  Clone ID: PAT_TA_81129.pep
WHXSVTCVHSHLSTRSLETTVHNLNYSLQXTPSLGHTHARFFYLTYGNESQKVNHLYSTLPLLPQIHMIQSRETIGKPSDNLANHPSASQHPIRVCNHTAVV

SEQ ID NO: 186712 - protein, 193 aa, Triticum aestivum
  unsure (1)..(193): unsure at all Xaa locations
  Clone ID: PAT_TA_81130.pep
KAFRTGFYWPTARADAQDLVQRCVGCXSLLISHMPPTALKTIPITWPFAVWGLDMVGPLKGGTHKHKYLLVMVDKFTKWDRGQPVKTAESGPVIDFISGVVHRFGXPTASSLITHEFTADEVKSGCKNMGINSTTLNLQPQTNGKWNXNGLIMSGSNQIVWSSWDQHHWVRTHSSGLRANDSTFLGTASIFLN

SEQ ID NO: 186713 - protein, 115 aa, Triticum aestivum
  unsure (1)..(115): unsure at all Xaa locations
  Clone ID: PAT_TA_81131.pep
PFGENIFWGSGQSWTAADAVKLWVDEKQNYHLDSNTCDAGKVCGHYTQVVWRKSTRIGCARVVCTGNRGVFITCNYNPRATXNGDRPFAFLTLGRPNLIPIDVIHAYYVRVFLLV

SEQ ID NO: 186714 - protein, 123 aa, Triticum aestivum
  Clone ID: PAT_TA_81132.pep
FFFFPAEGKGTLKSQWFCDGSAGNARYNTRHAIDVLHPGSARPVVPLVMCATWWWWRLCREGISLMLMLPFPCPRAWCMPRPLVRVGEVAVAVRGRAQGEHLGGAHGRTTVILAARVHGGVLL

SEQ ID NO: 186715 - protein, 80 aa, Triticum aestivum
  unsure (1)..(80): unsure at all Xaa locations
  Clone ID: PAT_TA_81133.pep
AGLLSLIHFIHRTATDRILIXLKLYIXNXPSLXXSSILICSGCRGLSVSXISSTAHLGLSTLXTGILVLTEVWLKKICAN

SEQ ID NO: 186716 - protein, 128 aa, Triticum aestivum
  unsure (1)..(128): unsure at all Xaa locations
  Clone ID: PAT_TA_81134.pep
FXADXXVFHVCXICXPXXXAGTXENFAVVSRSQXVXXATLARHPPCLGTCRVCVIPVGECHLDXSVLLDXLTPRTXSPTTXPTMCETLFVPLXTMTLTGGAGVCPEGCPSYPSQKNGPSVKDPLGGMV

SEQ ID NO: 186717 - protein, 136 aa, Triticum aestivum
  unsure (1)..(136): unsure at all Xaa locations
  Clone ID: PAT_TA_81135.pep
MXPIKIXINGFXRIGXLVARVALQSPDVELVAVNDPFITTXYMTYMFKYDTVHGQWKHHEVXVKDSKTLLFGQKXVXVFGCXNPEDIPWAAAGAXYVXESTVFSLTRKXCXSIKGGAKXGXHXGPXKXXPFLSVXH

SEQ ID NO: 186718 - protein, 129 aa, Triticum aestivum
  unsure (1)..(129): unsure at all Xaa locations
  Clone ID: PAT_TA_81136.pep
GFEAGISKDGQTREHALLAFTLGVKQMICCCNKMDATTPKYSKARYEEIVKEVSSXYLKKVGYNPEKVPLFPSLGFEGDNMIXEATNFXWVQGPTFLESLTKLMTXEPQTTPALPFKILKIGGIXTVPV

SEQ ID NO: 186719 - protein, 41 aa, Triticum aestivum
  unsure (1)..(41): unsure at all Xaa locations
  Clone ID: PAT_TA_81137.pep
YXXIFIHKXXLXNNTXYYLNHXGTXXXPVXTTXGLKXGXHG

SEQ ID NO: 186720 - protein, 124 aa, Triticum aestivum
  unsure (1)..(124): unsure at all Xaa locations
  Clone ID: PAT_TA_81138.pep
VPSVLSSTLDLPNRXNLMLAIHRIMTKVRGWHQANAMVVMQVLWQYVSDHRWSAFSQCAYPTPLSCPRNPSPEVYDKTPCLCAQKARILTQTLNHYRSFLLGKPPSSTSHVSTVSFSMKLHLRF

SEQ ID NO: 186721 - protein, 98 aa, Triticum aestivum
  Clone ID: PAT_TA_81139.pep
IMNFFDSLFFFQIYLEIFFPLKGRMVNRSTAAQSTGTGFFLRLVNLGQVNPEQQTRNRAKRSPPSVGRPMRASVCLPPFCFFTSYLIFYSYHESVQSS

SEQ ID NO: 186722 - protein, 93 aa, Triticum aestivum
  Clone ID: PAT_TA_81140.pep
FGACLAKYVARNLVFCRLHVTDTSITSSIVSVSEARDRYAARSHTHTHTPSQSTCCNQSTLRAIRCKWNMAVSCWSDSDGACHASIFPNVNME

SEQ ID NO: 186723 - protein, 92 aa, Triticum aestivum
  Clone ID: PAT_TA_81141.pep
LGKGGAKRHRKVLRDNIQGITKPAIRRLARRGGVKRISGLIYEETRGVLKIFLENVIRDAVTYTEHARRKTVTAMDVVYALKRQGRTSTLRR

SEQ ID NO: 186724 - protein, 133 aa, Triticum aestivum
  Clone ID: PAT_TA_81142.pep
HLLLQGCRKKPSPQVCNSALCLPSPGRLALAAMPPWTGIVASAAATAGCPGRRSGPGGGFRRRHHGNSWVCRRHQTGNRWVQRNHSKGTPEPGTRTVVPREVTPVIPQEAAPEPVVVDEQVAAMPEIAAEEVA

SEQ ID NO: 186725 - protein, 103 aa, Triticum aestivum
  unsure (1)..(103): unsure at all Xaa locations
  Clone ID: PAT_TA_81143.pep
SNSNPIQXAGDRQAQESPRLVSGGGGTFQGTQERSRAALLIQVVASRIYKSAAAAAAAIIIIGITIPSWNPRTPSRGNNPSVHPSSNQSPYFPEPSCHQSPSL

SEQ ID NO: 186726 - protein, 50 aa, Triticum aestivum
  unsure (1)..(50): unsure at all Xaa locations
  Clone ID: PAT_TA_81144.pep
XMNACXXXQNSVHLAKCKEASSPPRVSMKGILSYEWMPPNRGSPSKLRSS

SEQ ID NO: 186727 - protein, 175 aa, Triticum aestivum
  unsure (1)..(175): unsure at all Xaa locations
  Clone ID: PAT_TA_81145.pep
GIXXRLSGREPGXXRRFPLVXQRXVRWXHFCSXEPAGGLPXGRXDEERQIXFGLGVPGXERPXKGEXXXEGIANXNLGXRCVCAXPXGRGNXRREXAPPRRWGRGSLGGXTGREEXIGEKGEMGFPRARVRGRRGWPWAGLALGQMGCGEAALFSLFPFIFLAENNKREEKEREG

SEQ ID NO: 186728 - protein, 130 aa, Triticum aestivum
  unsure (1)..(130): unsure at all Xaa locations
  Clone ID: PAT_TA_81146.pep
MADQLTDDQIAEFKEAFSLFDKDGDGCITTKELXGTVMRSLXRTPLRQSFKDMINEVGADGNGXTIDFLXPPTWMAXKMKDTDSXXEFKEFPPVXTKDQKVXPXELIPXVXDNLGGELTXQSGISVLSWD

SEQ ID NO: 186729 - protein, 148 aa, Triticum aestivum
  unsure (1)..(148): unsure at all Xaa locations
  Clone ID: PAT_TA_81147.pep
MGKIKIGINGFGRIGRLVARVALQSDDVELVAVNDPFITTEYMTYMFKYDTVHGHWXKHSDIKLKDDKTLLFGRRXXTVFXXSRNPEEIPXGXEAGARYFVGXTGCPQLDKDKXLLTXKGGAKKXASLPQXKIPKFVXVXNEDXNLKT

SEQ ID NO: 186730 - protein, 115 aa, Triticum aestivum
  unsure (1)..(115): unsure at all Xaa locations
  Clone ID: PAT_TA_81148.pep
AIRRQAPRGGPRRSRHDRQSDGRCELGGWLVDQTIQSLGQNCLTLTILTASYIDXIILLGTRILAEXPNXNPVILLITTXTMNGGYVXPDVDHPIPFNIPLVLTFCXYIHFSXXG

SEQ ID NO: 186731 - protein, 116 aa, Triticum aestivum
  unsure (1)..(116): unsure at all Xaa locations
  Clone ID: PAT_TA_81149.pep
LDTNAKXNVPIGDXXXAXENGDRDVXXPKGKVAVSGIQSSGSSGTXDAXHXKSHSDASGSSSXQSAAXPPAXSXGSXXLKPXXXGXTSXEVSXXSTDSGFAVHXXSRXXSQQHMSM

SEQ ID NO: 186732 - protein, 118 aa, Triticum aestivum
  unsure (1)..(118): unsure at all Xaa locations
  Clone ID: PAT_TA_81150.pep
MGPXHHSSMXLLSGKAAAXMTPNGTMLPNDNXWXPFXKAFXRLHQPTYGXRHPXXAXFTXENXEKXPPXEEQGLGXNPLTXNFAXLGVXWAETXXTXXGGGXIPPKFXGKFXPLXNFX

SEQ ID NO: 186733 - protein, 119 aa, Triticum aestivum
  unsure (1)..(119): unsure at all Xaa locations
  Clone ID: PAT_TA_81151.pep
MSGRKKTREPKEENVTLGPAVREGEHVFGVAXIFASFNDTFIHVTDLSREGXRSSASTGGMXVKXDXRDESSPLMQLCXASQXCCLXNVXDFXITVRXINXXAXGGXXEKXKSWGPKLP

SEQ ID NO: 186734 - protein, 99 aa, Triticum aestivum
  unsure (1)..(99): unsure at all Xaa locations
  Clone ID: PAT_TA_81152.pep
LTETVFFQXSGWGHXKQVXXVSFPXLXVXVXXTLXCEIXPXGFFYFPXIQGILRXGXRRSKXGTVSLXFWGHXFIIPKGXXQNXFXXLFGICIHPARIV

SEQ ID NO: 186735 - protein, 125 aa, Triticum aestivum
  unsure (1)..(125): unsure at all Xaa locations
  Clone ID: PAT_TA_81153.pep
DXNVARFXQDWAAQRXXDCRLQHSGGPFGXNIFWGSGQSWTAADXVKLWVDEXQXXHLDSIXCDAXXVCXHYTHVXVWRKSTRIGCXRVVCAGNRGVFITCNYXPPGNFNXEXPFXFLXXXAEAK

SEQ ID NO: 186736 - protein, 122 aa, Triticum aestivum
  unsure (1)..(122): unsure at all Xaa locations
  Clone ID: PAT_TA_81154.pep
LILFPVFRLQSNWVAGALSGRIELPSPEEMMLDVMAFYSDMEARGWPKRFTHNLGVGSXTFEYXDWXLAEQCGLEKMETSXRXVIYVAAXSEGVGSGRENYRDEWDDDQLVGQAHINSSTAT

SEQ ID NO: 186737 - protein, 83 aa, Triticum aestivum
  unsure (1)..(83): unsure at all Xaa locations
  Clone ID: PAT_TA_81155.pep
STSSSSTSPSTSASIGICXAXSXLXSIXXNPEVXVNXMGRAAGVLENHXEXQXGXAEHXLKXYVQDKXPEIMXPGINKVHQAR

SEQ ID NO: 186738 - protein, 139 aa, Triticum aestivum
  unsure (1)..(139): unsure at all Xaa locations
  Clone ID: PAT_TA_81156.pep
TNDKGRLSKDDIDXMVQXDXXNXKSEDDDHKNKVDXKNSLENYAYNMXNTIXDDKIASKLXADDKNXIXDXVDXAIHWXDANQLCXVTKFEDNXXDLXGLCNXIXSXMXXXAGADMPXXMDQDSPXASRXAGXKXXEVH

SEQ ID NO: 186739 - protein, 51 aa, Triticum aestivum
  Clone ID: PAT_TA_81157.pep
SGVDVCDDAHPQCPKGCSACRVVTPSPHKTFRCADMKSTVDGTCGGPCKKH

SEQ ID NO: 186740 - protein, 74 aa, Triticum aestivum
  unsure (1)..(74): unsure at all Xaa locations
  Clone ID: PAT_TA_81158.pep
XRDSSHSXXPRLXGSAXIPGFQFKGKLXVRSNLAFVGGPGDLRALRSFARLLLLTSESPESLIGILVSPAPEPS

SEQ ID NO: 186741 - protein, 71 aa, Triticum aestivum
  Clone ID: PAT_TA_81159.pep
EDPALYQFHKRGCLDLISLPKDFNHFSSVHMYDVVIKNRESFPRRPRLRRPPPVQSPHLPTIQAILLLQPV

SEQ ID NO: 186742 - protein, 124 aa, Triticum aestivum
  unsure (1)..(124): unsure at all Xaa locations
  Clone ID: PAT_TA_81160.pep
SPRLAVSPHAAAAXMPFKRFVEIGRVALVNYGKDYGRLXVIVXVVDQNRALVDAPDMVRCQMNFKRLXLXXIXIDIKRIPKNATLIKAMXEAXVKTXWENXSWGKNLLSXRXTSXNDLDRSRHG

SEQ ID NO: 186743 - protein, 148 aa, Triticum aestivum
  unsure (1)..(148): unsure at all Xaa locations
  Clone ID: PAT_TA_81161.pep
MGKIKIGINGFGRIGRLVARVALQSDDVELVAVNDPFITTEYMTYMFKYDTVHGHWEXSDINSKDDKTLLLWREPFXLFGVRNPEEXPWGEAGADYFVXSTGVFTDKDKAAAHXKGGAKKXHLCPKQRSPSLWLGVNEDIHSDLNCPM

SEQ ID NO: 186744 - protein, 76 aa, Triticum aestivum
  unsure (1)..(76): unsure at all Xaa locations
  Clone ID: PAT_TA_81162.pep
LLYHEWDMLSASSCINNWEWALNISLXLHLKRENDDWMNGTGMKAFXLRXISXVDANPKIHHPGMGLTHFYEGVHP

SEQ ID NO: 186745 - protein, 110 aa, Triticum aestivum
  unsure (1)..(110): unsure at all Xaa locations
  Clone ID: PAT_TA_81163.pep
EPKRPSDKPLRLPLQDVYKIGGIGTVPVGRVETGVIKPGMVVTFGPSGLTTEVKSVEMHHESLLGGASLGDNVGFXRQRMLPXKDXLKRGFCCIQLPKDDPAKGGTNSPP

SEQ ID NO: 186746 - protein, 79 aa, Triticum aestivum
  unsure (1)..(79): unsure at all Xaa locations
  Clone ID: PAT_TA_81164.pep
AVSTMSVQMSGSXPGSPILPMKTXMPPNGTXYXYSRAXLXAQACVVXVXLXATTLNHXXHXVSXESFKAFLKEXXXIXR

SEQ ID NO: 186747 - protein, 60 aa, Triticum aestivum
  unsure (1)..(60): unsure at all Xaa locations
  Clone ID: PAT_TA_81165.pep
SHRHNLIIWQWIFWVGPFIGAALAAIYHVVGDPXIPFKPRLSTQHPEWTYRCHLHSLCCG

SEQ ID NO: 186748 - protein, 116 aa, Triticum aestivum
  unsure (1)..(116): unsure at all Xaa locations
  Clone ID: PAT_TA_81166.pep
MATGSDAGKSAEAVLEWPKQDKKRMLHAVYRVGDLDRTIKCYTXECFGDEAAEEKRCPPKENYTNAFPLGYGPXDTXFALXLTYNMVFTSTTFGXGFXHFATPNEDVFNCPETIWL

SEQ ID NO: 186749 - protein, 82 aa, Triticum aestivum
  unsure (1)..(82): unsure at all Xaa locations
  Clone ID: PAT_TA_81167.pep
FFFFGGVIXEIFILNXPHSIPSXGCXSIPGXHDNTYTPXXQGQSXEXGGSKLNPHTXDNLXDPSESDARYSSILFTPITRTT

SEQ ID NO: 186750 - protein, 99 aa, Triticum aestivum
  unsure (1)..(99): unsure at all Xaa locations
  Clone ID: PAT_TA_81168.pep
MAPSQPKSGLFVGINKGHVVTKRELPPRPSDRKGKGTKRVLFVRNLIREVAGLLPNEKRITDFLRLGKDKRALQXXQRXLGTHKETKKKREEIQXPPRK

SEQ ID NO: 186751 - protein, 96 aa, Triticum aestivum
  unsure (1)..(96): unsure at all Xaa locations
  Clone ID: PAT_TA_81169.pep
TRKTMAAIRTAISHVQNLITGVTKGFRYKMRFVYAHFPINASITAANRGIEIRNFLRRKEGKEIDMLDGVTSCGLRXQGXXLLDGNDIXLXXRXAA

SEQ ID NO: 186752 - protein, 153 aa, Triticum aestivum
  unsure (1)..(153): unsure at all Xaa locations
  Clone ID: PAT_TA_81170.pep
KFKLCKVRSVQFGQKGIPYLNTYDGRTIRYPDPLIKANDTIKLDLETNKIVDFIXFDVGNVVXWLLGGRNTGRVGCDSKNREEAXRNFRTIHFEDAQGTIFHPSWHFSXPARTTWVTSPKXKGTHHHRAEPDPLPTAAKPILSFSFAIPFLKV

SEQ ID NO: 186753 - protein, 173 aa, Triticum aestivum
  unsure (1)..(173): unsure at all Xaa locations
  Clone ID: PAT_TA_81171.pep
AQXAPKVAVXXKGDAKAXAAKVAXAXXXGSIXKTAXXIXXXXTFHRPKTLSNARDPIXPRISTPXRNXLXQYXIXXVPAYTESAMKKIXRQXXLVFIXRXLKADSKXQAAVKXMXDIQXXEGNTLIXPDGKRSVRLHKLSRDMVGHSDVILFLVNEVYYTGHHCTPARLALGI

SEQ ID NO: 186754 - protein, 81 aa, Triticum aestivum
  unsure (1)..(81): unsure at all Xaa locations
  Clone ID: PAT_TA_81172.pep
MSGHVQNPFLGVNTIWGSLAIVQDFAIPVXVCLDSGEACTYADCLGLKITDIDRILCVYLGNSKVTTMLVILYIHFKXVNL

SEQ ID NO: 186755 - protein, 121 aa, Triticum aestivum
  unsure (1)..(121): unsure at all Xaa locations
  Clone ID: PAT_TA_81173.pep
FITYCDVAEKXQLGTQDPATPIMEGMIYFHNYLNFYIIFIGIAVCXLLALIVLNFNETVNKTPMKFNHHSLLEMFGTIVPLLVLSLIXYPSFSLIXSFKMIXNXSLXVKLVXHQWILKISR

SEQ ID NO: 186756 - protein, 57 aa, Triticum aestivum
  unsure (1)..(57): unsure at all Xaa locations
  Clone ID: PAT_TA_81174.pep
XCXSTDRSXSXLXSYXQQEAXLXRCAXATWXAKMRWXWRSWSSXSXXRHRRXXTWTT

SEQ ID NO: 186757 - protein, 125 aa, Triticum aestivum
  unsure (1)..(125): unsure at all Xaa locations
  Clone ID: PAT_TA_81175.pep
SIXEKGSCFEVFPGWMKCSQHNQVSAPSXTLYSCILYVRSTYYLLXQDLLTKSGYIRVTCVCRMHVASILIKLLRRRRYCADGRQRPGPETAAEACAARTSARSQHVWGGGGSVADGAGDTTRAR

SEQ ID NO: 186758 - protein, 97 aa, Triticum aestivum
  unsure (1)..(97): unsure at all Xaa locations
  Clone ID: PAT_TA_81176.pep
IRAPDFFGRCCCHLASRCQIHLGRAAAAWVPVILGDANEXLGCRFHRXPYRLLPXPSHPKPNWCXRTXFLVHPMQQTSRKWDNQRPVNGYPXPLLQC

SEQ ID NO: 186759 - protein, 51 aa, Triticum aestivum
  unsure (1)..(51): unsure at all Xaa locations
  Clone ID: PAT_TA_81177.pep
IFVMCENYHXLYGLXXGLSXEMIAMLTQTYIXMXXMRXXVYIXLSXSXSLS

SEQ ID NO: 186760 - protein, 109 aa, Triticum aestivum
  unsure (1)..(109): unsure at all Xaa locations
  Clone ID: PAT_TA_81178.pep
MAPKAAEKKPVEKTPAGKKPKAEXKVXXSMXGGXXXGKKKAKXSVETYKIYIFXVLKHVHPXDIGISXKAMSIMNSFINDIFXNSXAIRQLARYNKNPHHVGRFRLRPF

SEQ ID NO: 186761 - protein, 127 aa, Triticum aestivum
  unsure (1)..(127): unsure at all Xaa locations
  Clone ID: PAT_TA_81179.pep
RIYTDIMMLENQIPWVVVKTILDFMPEPSLWEKFVTAMRAGMTNQMYSKEVPPIDLDPTYKPPHLPALIRFYIRGEQRQHQSRSPHRSGRRQPMSLSISVADLPASVSQSYPRQKVXVSAHDLQKER

SEQ ID NO: 186762 - protein, 90 aa, Triticum aestivum
  unsure (1)..(90): unsure at all Xaa locations
  Clone ID: PAT_TA_81180.pep
SRVDSSFDPLRGPLSVSVSLTNFKLTLILTHLTSRPHLSWDTREGPLXGQVATPPAVDPAXHRXGXPPVCFPGDKWPAXSPPGLGSPDQG

SEQ ID NO: 186763 - protein, 88 aa, Triticum aestivum
  unsure (1)..(88): unsure at all Xaa locations
  Clone ID: PAT_TA_81181.pep
QAKKKXMSKKSKVNQLKWYRLKAKKKMKSPNPEVRIRYKLEKAKRKXEWLIEKLXKYEAPRAPEPVHDPEILTEEENXYLKRTGEKKK

SEQ ID NO: 186764 - protein, 102 aa, Triticum aestivum
  unsure (1)..(102): unsure at all Xaa locations
  Clone ID: PAT_TA_81182.pep
MKSTKLAAILILQAVLVMGILSHVNADYFPKCCNNCRSFSGVDVCDDAHPKCPKGCSACRVGDPTLTNXRCARHEXTVDGTCRRXCKXTDFKVQVKQVCRLK

SEQ ID NO: 186765 - protein, 54 aa, Triticum aestivum
  unsure (1)..(54): unsure at all Xaa locations
  Clone ID: PAT_TA_81183.pep
QXQXLXEXPMTXSXSDAISPLLLRRPWTSKFFFPFXLWXQXVTXXHVSSXXNTH

SEQ ID NO: 186766 - protein, 51 aa, Triticum aestivum
  unsure (1)..(51): unsure at all Xaa locations
  Clone ID: PAT_TA_81184.pep
XRXAFMSRGLXYGDXVXLMXTHXDASNGFSHAVNSXTSXLXPAKXARQXKX

SEQ ID NO: 186767 - protein, 114 aa, Triticum aestivum
  unsure (1)..(114): unsure at all Xaa locations
  Clone ID: PAT_TA_81185.pep
MQNEVGXMXDLYVPRKCXDTNRIIXGXDHXSVHXNIGHIDENGLYDGRITNFALSGFRXRLKXDAXWSXXKXLQXMKSDQPIMLLTLTDLIFPCLNPEVKLAPHLCTWPDYVNF

SEQ ID NO: 186768 - protein, 77 aa, Triticum aestivum
  Clone ID: PAT_TA_81186.pep
LCFQEGEDDEDMATIFTPTAPAAIPNGSTTRACAWQLNYQVLSFLGHVSNVHENVMLPNLDTFVLLTVEARSMGQEE

SEQ ID NO: 186769 - protein, 100 aa, Triticum aestivum
  unsure (1)..(100): unsure at all Xaa locations
  Clone ID: PAT_TA_81187.pep
MSDTDEHHFESKADSGASKTYPQQAGAIRKGGHIVIKARPCKVVEXSTSKTGEAWHAKCHFVAIDIFXMGKNXEDIVLQPNNCDXPHVDRQXXQLIDITG

SEQ ID NO: 186770 - protein, 78 aa, Triticum aestivum
  unsure (1)..(78): unsure at all Xaa locations
  Clone ID: PAT_TA_81188.pep
MSCCGGNCGCGTACKCGNGCGGCNMYPEVEAAGATLLVSATATHKASSGGXEMAAENGGCGCTQVQCGTSCGCSCCSC

SEQ ID NO: 186771 - protein, 87 aa, Triticum aestivum
  unsure (1)..(87): unsure at all Xaa locations
  Clone ID: PAT_TA_81189.pep
LPSHLSPGQSNLIXSNXPLXXLXLTXKFXAHXWMFSLLXELYVHCXAGYYMATXXIRXLTGXNTNLGGGEKXGXXGAKISXGXGXPP

SEQ ID NO: 186772 - protein, 75 aa, Triticum aestivum; identical to SEQ ID NO: 106874
  Clone ID: PAT_TA_81190.pep

SEQ ID NO: 186773 - protein, 79 aa, Triticum aestivum
  unsure (1)..(79): unsure at all Xaa locations
  Clone ID: PAT_TA_81191.pep
MGWINIPPYRGXNPMFKTXPLXRSRDIKXXXGGXGFXQTFFGPCTLPNXHTHXTIRCLKXXSLXKXQGLPQGSYGXRXS

SEQ ID NO: 186774 - protein, 99 aa, Triticum aestivum
  unsure (1)..(99): unsure at all Xaa locations
  Clone ID: PAT_TA_81192.pep
MGGGNAQKSKMARERNLEKLKGGKGSQLEANKKAMNIQCKICMQXFICTTSEXKCKEHAEAXIPKRTPPSPTSKGYLNQMGERDKRERESISTYIMFHD

SEQ ID NO: 186775 - protein, 52 aa, Triticum aestivum
  unsure (1)..(52): unsure at all Xaa locations
  Clone ID: PAT_TA_81193.pep
FFFFKXGSVCYPARVHARYKKFQGRELQELRTQSLWALISDVYYSLYRGDQA

SEQ ID NO: 186776 - protein, 52 aa, Triticum aestivum
  Clone ID: PAT_TA_81194.pep
QSTVVISLTPLPTKPLFGPNGLNSQGSNYKTSKNYICHPNRPYVHYSEPGQE

SEQ ID NO: 186777 - protein, 53 aa, Triticum aestivum
  unsure (1)..(53): unsure at all Xaa locations
  Clone ID: PAT_TA_81195.pep
XCFXXHSLXLXVHSRXXXAPDVILRPXXVIMRIXIWSLGLXXCDQCXLVKXYF

SEQ ID NO: 186778 - protein, 139 aa, Triticum aestivum
  unsure (1)..(139): unsure at all Xaa locations
  Clone ID: PAT_TA_81196.pep
MAPKAEKKPALEKTPAGKKPAAEKRPAAGKTASKEGGXERKGKKKAKKSVETYKIYIFKVLKQVHPGHRASPPKAMSIMNPSSNDIFRELARRSRQAGRYNKXPTITQREXKLRPPVLPGRXAXSLSEQSQFTLLSFNN

SEQ ID NO: 186779 - protein, 97 aa, Triticum aestivum
  unsure (1)..(97): unsure at all Xaa locations
  Clone ID: PAT_TA_81197.pep
AVXTXFVFVXXGMTTACLLLGDYRWHQTPTRMILCWTPRKLVNTELTVSDXIDRDVDVCIYAILLTYFKMTSXDLYIGNKYDXVSISISVKSSMSIT

SEQ ID NO: 186780 - protein, 100 aa, Triticum aestivum
  unsure (1)..(100): unsure at all Xaa locations
  Clone ID: PAT_TA_81198.pep
VLPFSXXVGLYNLYESIFFFAPNRVWXAWKFXPCXNXLVMAXHLLADVCTSMTIIPSDHVWXXGHXCPAXXXSVXPYXTKLKPDGFTXNYSSXGEKPXXS

SEQ ID NO: 186781 - protein, 207 aa, Triticum aestivum
  unsure (1)..(207): unsure at all Xaa locations
  Clone ID: PAT_TA_81199.pep
LIFAGKQLEDGRTLADYNIQKESTLHLVLRLRGGMQIFVKTLTGKTITLEVESSDTIDNVKAKIQDKEGIPPDQQRLIFAGXSSWRMVAPSADYNIQEGSTLHLVLRLRGGSNCLSLPAAAAVPVSPVGAPLFKCFPLCESYCVFNGHHLWLGQTFRTSDLDNQLEVKKGRTNRQMIYTAQGVFNSETGQLTLIPSTIQRRSNARDS

SEQ ID NO: 186782 - protein, 108 aa, Triticum aestivum
  unsure (1)..(108): unsure at all Xaa locations
  Clone ID: PAT_TA_81200.pep
LAAEVLELAGNAAKDNKKTRIVPRHLLLAVRNDQELGRLLAGVTIAHGGVXIPNINPVLLPKXSAAAAREGGTNRPKKKPRQSPQEEXAXAKGYLATTRRSFPIPVFW

SEQ ID NO: 186783 - protein, 142 aa, Triticum aestivum
  unsure (1)..(142): unsure at all Xaa locations
  Clone ID: PAT_TA_81201.pep
XFXFPXGXKXLXXNGXXFQLNRVPSRLXIXAKGCPLXEILFXQFLQESNFCDXRDASDPXSSGTTPRXXSWVXNKPLSFLCLCIVPGSLQYIXQFIVSMGHITQCWFXTLPXTXDGMNSXSVPFYFLDIFCWCKSPWVVIQC

SEQ ID NO: 186784 - protein, 106 aa, Triticum aestivum
  unsure (1)..(106): unsure at all Xaa locations
  Clone ID: PAT_TA_81202.pep
KXDQQHPPSXSTLQAAQPSKQRKRKKSGITLQAKKGKEARKGKGAISCVLAKVVFSRIMEAVGXASNVLNFTQSFPLLMTGKSIRYEHRIRATQMCVNPTVLNYCI

SEQ ID NO: 186785 - protein, 62 aa, Triticum aestivum
  Clone ID: PAT_TA_81203.pep
VVTQVLLYTSSVFSISNSPPSPAFDGEFSSLQQLTTGCHEVYEWCLAELMSSSCCSAAVWAA

SEQ ID NO: 186786 - protein, 121 aa, Triticum aestivum
  unsure (1)..(121): unsure at all Xaa locations
  Clone ID: PAT_TA_81204.pep
VRQYIQHYQTAPKYSQYFKIMWYVKTVVSYTYMLKCCSFQYFGFFKYFTIKTQPKGNRPNDTPPGREPARRSGRYMLLSIPDWXXPLGIIYTVLRXLLFPFFPKVNRXVPDPXXVSRYXXX

SEQ ID NO: 186787 - protein, 133 aa, Triticum aestivum
  unsure (1)..(133): unsure at all Xaa locations
  Clone ID: PAT_TA_81205.pep
QMQSAWKCNYLXRICTFGRCXTKGSIALNAGXHFGDMQXLSHCXTNFVQPVXRILKGTPPSRSTKMSASHFLRERRTGRAHELARLYTCSQLSHPFTNGLLVSPLAGRRILRNCRKKKACCSIKSGSREGYCI

SEQ ID NO: 186788 - protein, 59 aa, Triticum aestivum
  unsure (1)..(59): unsure at all Xaa locations
  Clone ID: PAT_TA_81206.pep
ANEXCCPLLXGLADLDAAVCLCTAIRANILGIKLNVPIDLTLLLNQCGKKCPANFTXPI

SEQ ID NO: 186789 - protein, 144 aa, Triticum aestivum
  unsure (1)..(144): unsure at all Xaa locations
  Clone ID: PAT_TA_81207.pep
KERGXITCXICVCYXMGCQPEXXSXXASPIVCRDVDCEDGLXGAPVGIPLARRLLLPQFVLLLXLCSTLAKLGVAGKSRGLDXRTPNTSSASSXQRSGTAGCSRHSVRTRNRCFPAPNIHREAALHWLAVSRRCGPAPVQRLGD

SEQ ID NO: 186790 - protein, 140 aa, Triticum aestivum
  unsure (1)..(140): unsure at all Xaa locations
  Clone ID: PAT_TA_81208.pep
VECLGVMFLPIMENLLXSSKHKRFPGKTRHCYISCKAIPECFLTVRHXGFSISFWDILFFLXLFXFLPSSKDNYLLLPPKSINLPIVQISQIYVDGADNSTFTTISFIIVITTMPAQMSQKQTVNHRRPLPAIVIRIYLS

SEQ ID NO: 186791 - protein, 154 aa, Triticum aestivum
  unsure (1)..(154): unsure at all Xaa locations
  Clone ID: PAT_TA_81209.pep
MAPKAEKKPVAEKADKTTAAXKTKAEKRPPASKEGGEKXGKKKANKSVETYKIYIFKVLKXVHPDIGISSNAMSIMNSFINDIFEKLXAGEXGKLXRYXRTHHHSKEIQTXSARPPRRLKQPLNKASLTPPNICSVFMMESLVNWSCPGSIFPV

SEQ ID NO: 186792 - protein, 65 aa, Triticum aestivum
  Clone ID: PAT_TA_81210.pep
NNCVDSTGIIQSYFAPFQIIVPQCLLIDHWQSWRHHPCGGSIEHALERLSGPGRRARGGRFGSSL

SEQ ID NO: 186793 - protein, 108 aa, Triticum aestivum
  unsure (1)..(108): unsure at all Xaa locations
  Clone ID: PAT_TA_81211.pep
MSCCGGNCGCGTACKCGNGCGGCNMYPEAEAAGATLLVSATATHKASSGGMEMAAENGGCGCTQXCKCGTSCGAPCCSASLFIMHAPRVHIHTSTTTYHLPLLGLSIT

SEQ ID NO: 186794 - protein, 117 aa, Triticum aestivum
  unsure (1)..(117): unsure at all Xaa locations
  Clone ID: PAT_TA_81212.pep
VRFCDTCPSQAYPFVDCPHXLKCVSIPPLVCXGGXXPSPEXCAXXQTPQCCXSFSRMXQXVDLXYAKVLRPXGTLGEGMEEGDSLEPVEXLLPLXEKDTEEVGAEFDXEGEDGDGGR

SEQ ID NO: 186795 - protein, 98 aa, Triticum aestivum
  unsure (1)..(98): unsure at all Xaa locations
  Clone ID: PAT_TA_81213.pep
GEQXFPQSRCLKLGDPAQLWLPRPAPRVSGPTARCSTAEEPAPAPKARARAGWLREPVRSRFPWMDYYGVHVVRQSTWMHAASEPNSALQVAATIGTK

SEQ ID NO: 186796 - protein, 167 aa, Triticum aestivum
  unsure (1)..(167): unsure at all Xaa locations
  Clone ID: PAT_TA_81214.pep
KAHGGFSVFAGVGERTREGNDLYREMIESGVIKLDDKQSESKCALVYGQMNEPPGARARVGLTGLTVAEHFRDAEGQDVLLFIDNIFRFTQANSXVSALLGRIPSAVXGYQPTLATDXLGRLQGADYHHKKGSNTSVQXIYVPXDDLTXPALLHFAHLDATRASXRF

SEQ ID NO: 186797 - protein, 43 aa, Triticum aestivum
  Clone ID: PAT_TA_81215.pep
VDCILANYVSKFPIRTDIDNLKHTKLFPPFSIYMNLSALIHVV

SEQ ID NO: 186798 - protein, 110 aa, Triticum aestivum
  unsure (1)..(110): unsure at all Xaa locations
  Clone ID: PAT_TA_81216.pep
PWXXFXFLQXXKXKXXKDXRQXFRXXLRHSNVXSFNXATPRYXMQKXXSSRRILKYVXTXQVIRAXACXRXLXXYLCGHVISVLSXYXSLYRSXPLQQIKXCVRFSFXEX

SEQ ID NO: 186799 - protein, 91 aa, Triticum aestivum
  unsure (1)..(91): unsure at all Xaa locations
  Clone ID: PAT_TA_81217.pep
MKGTKLAAILILQAVLVMGLLSHVNADFFPKCCNNCRSFSGVDVCDDAHPKCPQGCSACRVGVDXAPEMWRCAXDMKSTVXGTCXGPCKNY

SEQ ID NO: 186800 - protein, 98 aa, Triticum aestivum
  Clone ID: PAT_TA_81218.pep
LPTYGKYVYDILLYLPSFDFLQLDDATQRTGDKSNMGGFVWAFSIWMWERLPVGRPKKLPRRPWGAYSEVGDEARHPTVAYEWDVVKLYMGLKKTSYK

SEQ ID NO: 186801 - protein, 167 aa, Triticum aestivum
  unsure (1)..(167): unsure at all Xaa locations
  Clone ID: PAT_TA_81219.pep
SDPKPQQQQSSAPQLAVKQEFFMEENQSSTQMKAASHDELQLFTEEKPVTLCRSQSHMLXSEHKPMANMSXMQEAKPDLSKIKXXYGEERCIFPVQPSWGFXKTKKKXPKAVXISSGNFMTSXYLDDXPEWVLLTCCKPSGSVPCVQNAKTLVSEPTSTGSVGPRVT

SEQ ID NO: 186802 - protein, 138 aa, Triticum aestivum
  unsure (1)..(138): unsure at all Xaa locations
  Clone ID: PAT_TA_81220.pep
TTVTYLFIHFSCVYGNQLILFFLFFSFVLRIFFLNNPDIINYDGSLVSLRELADSMWAYQMGYPNGVVXXALIXIRETLPKDXKKSHATQGCCKXNENVVLFTHIRPFFKCVXKTXFNAARFSXISCAEKSNXKQLXT

SEQ ID NO: 186803 - protein, 102 aa, Triticum aestivum
  unsure (1)..(102): unsure at all Xaa locations
  Clone ID: PAT_TA_81221.pep
VKKPHRFRPGTVALREIRKYQKSTELLIRKLPFQRLVREIAQDFKTDLRFQSSAVSALQEAAEAYLXVGLFEDTNLCAIHAKRVTIMPKDIQLARRIRGERA

SEQ ID NO: 186804 - protein, 129 aa, Triticum aestivum
  unsure (1)..(129): unsure at all Xaa locations
  Clone ID: PAT_TA_81222.pep
KNFEGHIHYACAEPLIVTNYLVALLLFSFFFVSIACAQXACFCAXIYCLTCVLXVVIILSLCGVFWFLKCINSCCAKRRLTKNPDWXHSPHARGRLHSQCTSXGXLAXNHLPHGESKXFPDHHANFGLH

SEQ ID NO: 186805 - protein, 56 aa, Triticum aestivum
  unsure (1)..(56): unsure at all Xaa locations
  Clone ID: PAT_TA_81223.pep
EQQDPSDGVWRGAGLDSRWAPPWSSPGVDDPSSSSAVRSVGLSGSXMMIKXFASCN

SEQ ID NO: 186806 - protein, 111 aa, Triticum aestivum
  unsure (1)..(111): unsure at all Xaa locations
  Clone ID: PAT_TA_81224.pep
MATSNTARMEDGGGXLRITIKKWNIIXPVYLNSXKTVAEGRRIAAAXACXXPXCIXIADCXRTSRSPRIXLDKXXPRXFFQVXXXRLNLXKXDGSPXXPAXKTTTNWVIXS

SEQ ID NO: 186807 - protein, 170 aa, Triticum aestivum
  unsure (1)..(170): unsure at all Xaa locations
  Clone ID: PAT_TA_81225.pep
MARTKQTARKSTGGKAPRKQLATKAARKSAPATGGVKKPHRFRPGTVALREIRKYQKSTELLIRKLPFQRLVREIAQDFKTDLRFXSSAVSALQEAAEAYLVGLFXDXNLCAIHAKRVTXMPRNQLARXIRGEGLSLFVVVLPDVSGKCGSFVSGHCARCLMKCASKKKK

SEQ ID NO: 186808 - protein, 81 aa, Triticum aestivum
  unsure (1)..(81): unsure at all Xaa locations
  Clone ID: PAT_TA_81226.pep
NPSCDGTLAISLSARSFCPEPNSXNERLRRELLRKNLPGSIHAKMSVKGWDPYDNRSNMIPXSNQXIHKDNHMIQLIXRXG

SEQ ID NO: 186809 - protein, 150 aa, Triticum aestivum
  unsure (1)..(150): unsure at all Xaa locations
  Clone ID: PAT_TA_81227.pep
QXRTGVVERILTIATLPEHGLQPVGEEVKAGRGAQAGPWGGARQLGCLAFQTNRDAVNGVGSSARRPPCSNEAEEASRALGQQVNGAGRGTAARRRDPARKVAGNGGDGWIHLGSGEAGIHGDGCELRLQPSMAMSWGSCWWWGALATKL

SEQ ID NO: 186810 - protein, 97 aa, Triticum aestivum
  Clone ID: PAT_TA_81228.pep
IIHSYIFITPSIVEIDEAITGTRAHTYTQGHQGQSIGGERASKPHAHAHAPLLDSIRSEGRSLFTYTLTPSHECMQLNSCRGCTCSCRRSCSPRRTG

SEQ ID NO: 186811 - protein, 171 aa, Triticum aestivum
  unsure (1)..(171): unsure at all Xaa locations
  Clone ID: PAT_TA_81229.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKXKLRKECPTRLRAGTYGNTRILRKWAHYSQKKFCNAALTTTDRPMLVLTNSSSITGC

SEQ ID NO: 186812 - protein, 95 aa, Triticum aestivum
  Clone ID: PAT_TA_81230.pep
DDPAPKRLFLARGKLQKLLVEFVPPKLILQKLVELFLKGIQTGVKREVYYWHAYYDKRLPVGASALLKLEEFVAKFMSIHRKSMSHEPKIPEVPQ

SEQ ID NO: 186813 - protein, 63 aa, Triticum aestivum
  Clone ID: PAT_TA_81231.pep
IQTQTVLFHAAQTIIQQHCRKSLGNNAKVYVQLNKQGPHVVSILSLSFKRSVSDHGLLGKKTF

SEQ ID NO: 186814 - protein, 151 aa, Triticum aestivum
  unsure (1)..(151): unsure at all Xaa locations
  Clone ID: PAT_TA_81232.pep
DNFEWIXAATARLXEIKTLQASNPILAAPNAXEPMLLXISXTHXXVSXVXVXERXXDGHXFPLQKLVXYVSXVLTXCKSRYPHXXKIXYAVXMASQKLRHYFQECSITVASXVPLNDXSRXRDATDRIAKWAIELLPFYITYKXRRSNPST

SEQ ID NO: 186815 - protein, 43 aa, Triticum aestivum
  Clone ID: PAT_TA_81233.pep
MPHGVVCCSHHQIFAGLAISSLILLHSCHLNNLIHGNCTCPYT

SEQ ID NO: 186816 - protein, 111 aa, Triticum aestivum
  Clone ID: PAT_TA_81234.pep
SANMISALPVLCYGVTASALQSQSIHQITSSTSPAPAFFKLSRDPSSLTVCSPQIQAIRIQSLRGNQNLKAIEMSEGNRWGSGMKLGCHGHDNWMLHIVSTAYEQPAAFHL

SEQ ID NO: 186817 - protein, 93 aa, Triticum aestivum
  Clone ID: PAT_TA_81235.pep
FFFFGRILKQSILLWLVDPKHKPNQVEAQTFDRFLLPVSKRFSFASRRHIWDPATSPPFTLHSQRLSLLRGAGAHKLHELVQVAVRAATGCHR

SEQ ID NO: 186818 - protein, 50 aa, Triticum aestivum
  Clone ID: PAT_TA_81236.pep
ENLDIVDWELSEEERQRISKIPQRKINQGRRYVSEHGPYKSFEELWDGEI

SEQ ID NO: 186819 - protein, 52 aa, Triticum aestivum
  Clone ID: PAT_TA_81237.pep
ARSHQFIFSRGDGSHSHYGDLRLVSDSRSCNIFVRRIPVGCSVELSIMQCGW

SEQ ID NO: 186820 - protein, 59 aa, Triticum aestivum
  unsure (1)..(59): unsure at all Xaa locations
  Clone ID: PAT_TA_81238.pep
QAEHXNDIVPPXTRLLXYIALRYSEFPPXIMXIXVXDNXFCXRHVVVFXYGSAVLFNSC

SEQ ID NO: 186821 - protein, 111 aa, Triticum aestivum
  unsure (1)..(111): unsure at all Xaa locations
  Clone ID: PAT_TA_81239.pep
PTGGTWSFGLEQFATGLRLRCSKGRSRTQKSLCRTPVSLRVCQAIQXIIPLCXXATLXPVTXRETXPGSXSKLFTVDSHDFWFMGFVSYDKAVHYLVEAVSQRGVATAGGK

SEQ ID NO: 186822 - protein, 101 aa, Triticum aestivum
  unsure (1)..(101): unsure at all Xaa locations
  Clone ID: PAT_TA_81240.pep
XNGAVEFGELAAAIAPLLTTQTHLVDQAQLLEVFRAFDRDGNGYISAAELARSMARIGQPLTFEELTRMMRDADADGDGVISFNEFAAVMAKSALDFLGVA

SEQ ID NO: 186823 - protein, 117 aa, Triticum aestivum
  unsure (1)..(117): unsure at all Xaa locations
  Clone ID: PAT_TA_81241.pep
SPLHTPALLLLCSVIWSGEIGDRTVDSTNMADWGPVVVGVVLFVLLSPGLLCXLPXTHRHXDFGXFHTNGKAIFVQTLXIFFAAFTIXXLALXIHIYSGYAHMLRPSGLAEVSKRTR

SEQ ID NO: 186824 - protein, 65 aa, Triticum aestivum
  unsure (1)..(65): unsure at all Xaa locations
  Clone ID: PAT_TA_81242.pep
TNEYNKHXTTIKXSVYXPSRKQIIXSRSIQRXRMEWSDSFAAWGRXLCSARRSIASSLXQDGETN

SEQ ID NO: 186825 - protein, 114 aa, Triticum aestivum
  unsure (1)..(114): unsure at all Xaa locations
  Clone ID: PAT_TA_81243.pep
TIVLLVKSLLKDHAIVVLWCMPLHLSCYKTHIQNCXGARRRXRSSSSRRRRXAAXHSVLATMAXGLXEAXQXXNAPXHWXLDKLGXAFAPNHLLXLXSQGVLLRFXXXEQAQYA

SEQ ID NO: 186826 - protein, 55 aa, Triticum aestivum
  unsure (1)..(55): unsure at all Xaa locations
  Clone ID: PAT_TA_81244.pep
HIVTREFPQVVIQLSLNHNDMIHHLSLDGWMEYIVSQIIEASTKHRSCHKNXHLP

SEQ ID NO: 186827 - protein, 163 aa, Triticum aestivum
  unsure (1)..(163): unsure at all Xaa locations
  Clone ID: PAT_TA_81245.pep
LQCLGGIWTCFLIFLDAYFFFSQAEKDLQPWIARDDEQGQKMWRVNXRIVKLIAELMRNHDXPEALEIXASASXLLLRAXDGMLVDGETCTLPXLELLEVXARXAVHLNIEWGDQVTIAXGFQTAESSTIAASTKNVAIRPAIEFGTEENRIPTSGQTLKNHP

SEQ ID NO: 186828 - protein, 70 aa, Triticum aestivum
  Clone ID: PAT_TA_81246.pep
GKLRQELPDVPSDARLIFPRYTLDEAETACHYYMRQKIIRRENFSEEKWKKIYYLSNGNGAEMRWLAAFV

SEQ ID NO: 186829 - protein, 110 aa, Triticum aestivum
  unsure (1)..(110): unsure at all Xaa locations
  Clone ID: PAT_TA_81247.pep
LISMKYVXYSVEQIIPTSFRSRVGDGGVAQPNLTIEYSSVIDDLIYHASYTYMTHLGPGRTTSSGCSPCEMGDRMGAWHIAHVKGEHCCQLTATAVSISDXLQVPNISTS

SEQ ID NO: 186830 - protein, 113 aa, Triticum aestivum
  unsure (1)..(113): unsure at all Xaa locations
  Clone ID: PAT_TA_81248.pep
SPRQSPRGGDKSEARKISPSPYPKVPIARVSDLDIVDSSSSNGDTGASKKKTEKSSFRPIAKESLSLXGLQKRRIKLQKASNQRSAKNDIDEESNESVKPQRVGTSFIWFXLM

SEQ ID NO: 186831 - protein, 112 aa, Triticum aestivum
  unsure (1)..(112): unsure at all Xaa locations
  Clone ID: PAT_TA_81249.pep
LTQGQSKRSRKKKLATPTVLDTLKKKTKRAYNKRRNATANTLNTSATATDSITDGTNVQQNPVNEGWQLASTNAPEXFSYGVGEHSFDLSQYNNAPXFQLGLKSTAGSTPLN

SEQ ID NO: 186832 - protein, 64 aa, Triticum aestivum
  unsure (1)..(64): unsure at all Xaa locations
  Clone ID: PAT_TA_81250.pep
GPGARGGRRWRRRFRGGRARRGXSSDNXKGLVLAVSSSAFIGASFIVKKMGLRRAADSGVRAGE

SEQ ID NO: 186833 - protein, 135 aa, Triticum aestivum
  unsure (1)..(135): unsure at all Xaa locations
  Clone ID: PAT_TA_81251.pep
GALVXQVSIEXSXXESPRKRSXEXSAXSLKTXVRPXSGFXXWCPPASXSGRVAPSPSAXAPAAAASPGQXXWSGPRVSPRRATSSWTSSTSXIPNSTAFSLFQRLRVSXSRRSLGRQRTALASARRGHDRLAPXE

SEQ ID NO: 186834 - protein, 90 aa, Triticum aestivum
  Clone ID: PAT_TA_81252.pep
MLLLAVPAVLAGFLKAFRLAFLLWPLNLALPLARDLPRACITVRAIASFYAAGLRGYVAGARRGVLLHARRQLGPAAAARLLLLFLLLRS

SEQ ID NO: 186835 - protein, 192 aa, Triticum aestivum
  unsure (1)..(192): unsure at all Xaa locations
  Clone ID: PAT_TA_81253.pep
KNLTADAQLALLLYHGVAEHYSAQSLKAINGDVSTLASDGSKNNNGYNLTIRADGDTVKISSASASAATVTKTLLXDKAPLSVYLIDAVLLPRXSLTTTRDTLRPPLRRXPRLHMHXLPLRRXRRRLPLYRPRRXRXPSXAMHPXPNCPCPVMHCPKRQRIRITPKGGNARHHDTDLGGGLLSLLRLRLLPW

SEQ ID NO: 186836 - protein, 28 aa, Triticum aestivum
  Clone ID: PAT_TA_81254.pep
QQLLPFNQHALTNPTAFYQQPIIGGALF

SEQ ID NO: 186837 - protein, 56 aa, Triticum aestivum
  Clone ID: PAT_TA_81255.pep
FFFFNLETNFPYHSRAKPNIHIVTRNINIRCHLQLTTTVCGSSNHQVVVDIPPYCF

SEQ ID NO: 186838 - protein, 82 aa, Triticum aestivum
  Clone ID: PAT_TA_81256.pep
NFQFVNFTEIMSKSIAADRKEAEFALSALMEIPTQYKATLDLQLLGRRQRITPRIALPPPTRTAYSRTTSFSQQSGVYSAIK

SEQ ID NO: 186839 - protein, 130 aa, Triticum aestivum
  unsure (1)..(130): unsure at all Xaa locations
  Clone ID: PAT_TA_81257.pep
SHGPIMGVLYLSTVKIAFGSDSPVKYVTEDNKTESSFYKVVLPLHHLRSVTPTASQQNPAERYIQVXVSVDNHEFWFMGFXVNYDSAVKNLXGVCSSCSRGLEVAHHFSSYVGCSMPVVNVFVHGTCLCV

SEQ ID NO: 186840 - protein, 79 aa, Triticum aestivum
  unsure (1)..(79): unsure at all Xaa locations
  Clone ID: PAT_TA_81258.pep
LLREXWAGLRFXLPFQGSDCYANCXSGXCLRLPPLXQPDCLLLADVVINTIITEPXYVXITSTXAHKSYNPISLFFXVM

SEQ ID NO: 186841 - protein, 94 aa, Triticum aestivum
  unsure (1)..(94): unsure at all Xaa locations
  Clone ID: PAT_TA_81259.pep
KKXCSRIDSHIYKQKLRSKWLNPKRIIIQKNLEYRRQEAEPRAKHICPGTKRKQISHLWHIGPQLFSASELASIRIDLVKSIQNQHKHIIDRTT

SEQ ID NO: 186842 - protein, 59 aa, Triticum aestivum
  Clone ID: PAT_TA_81260.pep
QSSKLVPHHKCDLCFLMMFGNGIGGWQLVSLGCFFPACFDTDYCILELRFGNAPAVRFS

SEQ ID NO: 186843 - protein, 106 aa, Triticum aestivum
  unsure (1)..(106): unsure at all Xaa locations
  Clone ID: PAT_TA_81261.pep
PAMQSLSGQNIVAAENMGHLTTGMAPATANAEMVNSDLTSQNQMLSSLPQTDDRLADGIESKSGEDVSHGKSEASAEAIGPQDAQLGTSATKRSATXKTQETICHQ

SEQ ID NO: 186844 - protein, 54 aa, Triticum aestivum
  Clone ID: PAT_TA_81262.pep
EVLNQIVYELPEEHPLSETKPLREILGHTVPQVVAGCILGILMAVVMLLALGRS

SEQ ID NO: 186845 - protein, 111 aa, Triticum aestivum
  unsure (1)..(111): unsure at all Xaa locations
  Clone ID: PAT_TA_81263.pep
VXPIQNVXGXCWAXEIVXHVSKPWKXPGQDXPKIXXRPNXYSFYFXGSKMRXQXNEGKFVIMVQXQGNTHLDFLLAWPIEPSKVQVLVGILXYFILAKFQDTVFFWEKSAH

SEQ ID NO: 186846 - protein, 162 aa, Triticum aestivum
  unsure (1)..(162): unsure at all Xaa locations
  Clone ID: PAT_TA_81264.pep
MLKITTMDDLVKNSMNILEPSPVDATGNNREDVLSSLSPVDLFLLPGQAFDRTGRRLGRGGGYYDTFLLKYQELAKEKGWNQPLLVALSYSVQIMDEGIIPVNSTDVXIDAXVSSSGVIPIIAFRGCNLIGPCFNKHFFSLARANTPLRECFSPRAPPCTLY

SEQ ID NO: 186847 - protein, 62 aa, Triticum aestivum
  Clone ID: PAT_TA_81265.pep
GYCRSCGRLGFETLAAPHNRRFGPLLGLLGRPARLGRCLVRLACRLGCFPGSRIVYFTIFKF

SEQ ID NO: 186848 - protein, 147 aa, Triticum aestivum
  unsure (1)..(147): unsure at all Xaa locations
  Clone ID: PAT_TA_81266.pep
AFPMGKIDQTRMWKVGERVRSTRPQGDLGPLHPFTAGVYVALMMAQIEVLRKKGHSYSEIINESLIESVDSLNPFMHARGVAFMVDNCSTTARLGSKKWAPRFDYILTQQAFVTVDKKAPXNQDSINNSXSDPVHGAIEXCAQLXPL

SEQ ID NO: 186849 - protein, 115 aa, Triticum aestivum
  Clone ID: PAT_TA_81267.pep
GRYAAEIRDPVRKARVWLGTFDTPEQAARAYDAAARRLRGPRATTNYPGDVVREAPCTAPALAASASGSTESSSSSSSRDDGHPPPPLPTAPSSLRPGPRVFPGDGGHPAVPFLR

SEQ ID NO: 186850 - protein, 99 aa, Triticum aestivum
  unsure (1)..(99): unsure at all Xaa locations
  Clone ID: PAT_TA_81268.pep
AAIQAKXXXGFQXLXYKKXQQFXQGDPKXEARTXFVKQHLEFLNHNCKNCEPLVGXHCRSQFMDHLLLPSSKCTIAKEMPFPLVKFTRRENPGLKNNRW

SEQ ID NO: 186851 - protein, 148 aa, Triticum aestivum
  unsure (1)..(148): unsure at all Xaa locations
  Clone ID: PAT_TA_81269.pep
TGAGHERXPRPTGCNHVXAFPPKAKPRSAWASQIPVXLQQRATAAATSATAHSSLALYLHATTRSAARLPRDPLGISSVQSYNRWPSVMSAVMLCTKHRSKRKKRTTTSSPTQTPHKGKLSPHKKPNRDAAQPWGSSSATCTARAAAP

SEQ ID NO: 186852 - protein, 198 aa, Triticum aestivum
  unsure (1)..(198): unsure at all Xaa locations
  Clone ID: PAT_TA_81270.pep
SVENIGLLGLTKVGSRRVIQISTGFMIFFSIFGKFGAFFASIPLPIFAAIYCILFGIVAAVGVSFMQFANKNSMRNIYIIGLSLFLGISVPQYFNGYTSSAGRHGPARTNXGWFNDIINTVFASGPTVALXVAPSWTHAGVGLQGDRGGQAFLPAIRISPQSFQVMSIQTIRKDAYTVSPDLYQPFVRGMEGICLEKV

SEQ ID NO: 186853 - protein, 62 aa, Triticum aestivum
  Clone ID: PAT_TA_81271.pep
KDCTNNEKILSPIQQQSRDDCLITSSKLQKIYRIHLPLHTTFAKSSSSDKLNRMYRNSICSY

SEQ ID NO: 186854 - protein, 65 aa, Triticum aestivum
  Clone ID: PAT_TA_81272.pep
VHSSGRPPTASCGWHHITGSIIISRSSYCRRGGGDAMGELAKVRVELGRAGRQLQGRRGCCCMGS

SEQ ID NO: 186855 - protein, 47 aa, Triticum aestivum
  Clone ID: PAT_TA_81273.pep
FCIHRCLGPTISTTSTTKLFSPKQVGSNCITDLKGFTKMTNYMPFMR

SEQ ID NO: 186856 - protein, 98 aa, Triticum aestivum
  unsure (1)..(98): unsure at all Xaa locations
  Clone ID: PAT_TA_81274.pep
PHAQKHGKIFLLFRDIFLQGAIDGGRATXRNQEQHSRQPLYLSGTTTPGLLIKICPARMALSMALSRWALRVMEVSSATLAANRAASSSWAMDFLEAR

SEQ ID NO: 186857 - protein, 106 aa, Triticum aestivum
  unsure (1)..(106): unsure at all Xaa locations
  Clone ID: PAT_TA_81275.pep
MEGDGTNLDAAIESLLNVEKQMRLAGDVAGTRXKAVIDIVELCYKAGAWKTLNDQIVLLSKRRGQLKQAITAMVQKXMEYIDLTPGIDTSIELIKTLSSVSAGKSS

SEQ ID NO: 186858 - protein, 118 aa, Triticum aestivum
  unsure (1)..(118): unsure at all Xaa locations
  Clone ID: PAT_TA_81276.pep
TREILAAPAXGIPYYPHLGGPSXGAESTRRGAAIAVDVCRCLVPSGCSGSAGHHHHNSHXGPHAHDHRVDRASELPNIIDISAARWAVPCWPGTSPSCFGLQSVGPGQHELLPGRALS

SEQ ID NO: 186859 - protein, 57 aa, Triticum aestivum
  Clone ID: PAT_TA_81277.pep
TFRVHEFCFEKDWMWMDFSNPQINIFRPRNQWTFLHTKMKKKAEKNDSHLKDLQCIT

SEQ ID NO: 186860 - protein, 94 aa, Triticum aestivum
  unsure (1)..(94): unsure at all Xaa locations
  Clone ID: PAT_TA_81278.pep
DIQLHYAAWLRIFDVLGQSELXALLLSKSKSCLTLCPAGVQVIPRCKRXNXFELSIXKSFVWAWTXKKXKXQGAXPXPNEXIPXKALKSYGNRY

SEQ ID NO: 186861 - protein, 96 aa, Triticum aestivum
  Clone ID: PAT_TA_81279.pep
AEYAVARNAALGGAGLAETGVHGWRRPFVTHFTGCQPCSGQRNEHYSGDSCDQGMRRALNFADDQVLRAYGFRHASSLSDDVQPLPFDYPAKAVTS

SEQ ID NO: 186862 - protein, 159 aa, Triticum aestivum
  unsure (1)..(159): unsure at all Xaa locations
  Clone ID: PAT_TA_81280.pep
DVPTILGNLSIISPFYAPVFKLKNPRVIVFIKKLLVKGPQVAQHFESQILSAMDNFIVSSPEDVIFILLNFFKGSKKQIFLCSTDGNHLDSVEKTCKFFESKFSLWIELLDDTAGTGNRSSNQVSEKEAXILWGSFXCYPNMKGVIKIFVTAEEIPALK

SEQ ID NO: 186863 - protein, 73 aa, Triticum aestivum
  Clone ID: PAT_TA_81281.pep
MSSTECGGGGGGAKTSWPEVVGLSVEDAKKVILKDKPDADIVVLPVGSVVTADYRPNRVRIFVDIVAQTPHIG

SEQ ID NO: 186864 - protein, 62 aa, Triticum aestivum
  Clone ID: PAT_TA_81282.pep
TVWKFYIAEKIDGTVAFMSAATNTLHRAYGSVIVVLLITRCTNSRLPTRRQPLRQAPELQLA

SEQ ID NO: 186865 - protein, 137 aa, Triticum aestivum
  unsure (1)..(137): unsure at all Xaa locations
  Clone ID: PAT_TA_81283.pep
MPSTVNSASLDQNLELAKQCSREAALAGFKAAAVATVASAVPTLVSVRMLPWAKANINPAGQALIVSTVAGMAYFIAADKKILSLARQHSYENAPEHLKDTSFXGTAVAPRFFRLERTSNYRLSWTTILGRRSFSSI

SEQ ID NO: 186866 - protein, 65 aa, Triticum aestivum
  Clone ID: PAT_TA_81284.pep
SCRVKLWLFVAYVVSFVCLAGSVGLLVQDALTNKGPSVWTGVAGVLQCVLVLISGLVYWTCHSED

SEQ ID NO: 186867 - protein, 96 aa, Triticum aestivum
  unsure (1)..(96): unsure at all Xaa locations
  Clone ID: PAT_TA_81285.pep
TTYRQRLQTPQLQGLIQEQNPPIDLCGLHISEAIHVLNYELNNRRKIVRSTGRRLQVMIISSARTPARLTAAVEQYLMEHGLLYTXVQPGLLRILL

SEQ ID NO: 186868 - protein, 132 aa, Triticum aestivum
  unsure (1)..(132): unsure at all Xaa locations
  Clone ID: PAT_TA_81286.pep
DDALTARNNGAQGIGLCRTEHMFFASDERIKAVRQMIMAPTLELRQQALDRLLPYQRSDFEGIFRAMDGLPVTIRLLDPPLHEFLPEGNIEDIVSEYCLRRDQQEXMPSRELKAFRINPMLGFRGCSLGNRT

SEQ ID NO: 186869 - protein, 84 aa, Triticum aestivum
  Clone ID: PAT_TA_81287.pep
RNGADMEFLSMALQVASQAVYSLHKTSTREHIKKAALRGFNAISAEVLCELRYNLPRTYKLHKKKEIDIAVDLWRFVPNAQRRS

SEQ ID NO: 186870 - protein, 139 aa, Triticum aestivum
  unsure (1)..(139): unsure at all Xaa locations
  Clone ID: PAT_TA_81288.pep
VAVLDATFIIWIFSSLSRTLEKLQLRRSMAKLELYRKFTNSLAVSVLISIAWIGYELYFNATDPLSELWQRAWIIPSFWNVLSYALLGIICILWSPSRNPTGFAYSEDAXEGADEEXLSPSKCGEKNRRYGKHAYLPGG

SEQ ID NO: 186871 - protein, 66 aa, Triticum aestivum
  Clone ID: PAT_TA_81289.pep
GILDPRKRKAEKKRRKANRFSVLNDMDADYDFKVDYQMEDAADGEDEDAGDEAKEDNEPMTGVDDS

SEQ ID NO: 186872 - protein, 104 aa, Triticum aestivum
  unsure (1)..(104): unsure at all Xaa locations
  Clone ID: PAT_TA_81290.pep
KTIVLGLGRDSDEVCLPSLELLFGRCVMGSLFGGLKPKTHIPVLAKKCMDKELQLDALVTHELGLQDINKAFDLLLQGKSLRCILWMDXDNTKQGRGPILPVSE

SEQ ID NO: 186873 - protein, 74 aa, Triticum aestivum
  Clone ID: PAT_TA_81291.pep
CKHSSLCRKFQNLLGSYCTKKNKVKILILLMQEAASTKLIVMERSHSFRQITANKKKHGYIQTRFLKTITKGHA

SEQ ID NO: 186874 - protein, 74 aa, Triticum aestivum
  unsure (1)..(74): unsure at all Xaa locations
  Clone ID: PAT_TA_81292.pep
HIIPDRFVXTXSLFXKISXNWXTSHSKXPXCNXKMXKXDKGSVNCNFKXVIGXFXXXLFSPGCQIKXXIXIEKK

SEQ ID NO: 186875 - protein, 72 aa, Triticum aestivum
  unsure (1)..(72): unsure at all Xaa locations
  Clone ID: PAT_TA_81293.pep
RELSGASPSIATIVLYGSTRCDAQKLFLGQCCSLQLLTCRTKMVRFHRTYSLLFHQAXSTPNDRWKIQSYFA

SEQ ID NO: 186876 - protein, 65 aa, Triticum aestivum
  unsure (1)..(65): unsure at all Xaa locations
  Clone ID: PAT_TA_81294.pep
FFFLRVEPNDINSVELSSVXNGNCNLTECVGKRPNSQHIHCTIRKIHVHITQSPHHDDATSCIQQ

SEQ ID NO: 186877 - protein, 154 aa, Triticum aestivum
  unsure (1)..(154): unsure at all Xaa locations
  Clone ID: PAT_TA_81295.pep
MEYLNVLSRHGCSPGEKFFRAALAAHLDARQLRGAMNLWDDFVGRRGLVPDMEMYNTMIKLQGSLGHAELIVGYLDDMISNGVFPDXNTYNVVLQXLLKGKXHREAAILRWQEQCWQTRKWSHSMFWYHYGNINPGSWGKGCTLKMKSQTKVKY

SEQ ID NO: 186878 - protein, 82 aa, Triticum aestivum
  unsure (1)..(82): unsure at all Xaa locations
  Clone ID: PAT_TA_81296.pep
WXNSKWXDPSSERSXSRSYIRAALLSSDQRIVNIXIXHIQXLPSMLVYXQIXTXYHNMIDEQNATNTXGXFSNQDXPLRVNX

SEQ ID NO: 186879 - protein, 140 aa, Triticum aestivum
  unsure (1)..(140): unsure at all Xaa locations
  Clone ID: PAT_TA_81297.pep
EXXRTILFRRRIGAARREDAAVRWGEGQHHSRVQRRKKMQQQGCEERDSSSFWREGGAAVRGRRGSAGTQEEEQQQQRAQEEAAAAARVHRRRSSKQFGGRGEVEEQQREEEVGETAGRGAPAGGRGRARHQTTASSRAR

SEQ ID NO: 186880 - protein, 152 aa, Triticum aestivum
  unsure (1)..(152): unsure at all Xaa locations
  Clone ID: PAT_TA_81298.pep
HPCPSPAGNCPVNAVKLAVCADVLDGLIHVVLGQSPPKQPCCSIISGLVDLDAAACVCLAINANVLGINLDVDVDLTLXLLNYCDCKVPKGFPLRLIDRRMAITSSCMRTFAAMHAKHIILPIVLGVWFLINLHPFNGAHYHVMLRAIFLLP

SEQ ID NO: 186881 - protein, 136 aa, Triticum aestivum
  unsure (1)..(136): unsure at all Xaa locations
  Clone ID: PAT_TA_81299.pep
KIADFGLARLLGEGHTHTKTARAVGTLGYMAPEYAIHGRVSPKIDIFSFGVLASEIXVTRRRNSILTIADEVELISDVLGTAGTKGTVXQMITPPLGQHAPKPSITIMHIRLMXSNSDPDDRPYIHHFHVYQGQHI

SEQ ID NO: 186882 - protein, 113 aa, Triticum aestivum
  unsure (1)..(113): unsure at all Xaa locations
  Clone ID: PAT_TA_81300.pep
EEWTNVFNPAFSYYAYYCYANLYTLNKLRESKGMNTIKFRPHAGEVKYLQHSTTFLLCPQYIHMGIQFKESPCASNILYYLXQIGPGNVPSSSNTPCFLGYHPDLFXSFSQRD

SEQ ID NO: 186883 - protein, 143 aa, Triticum aestivum
  unsure (1)..(143): unsure at all Xaa locations
  Clone ID: PAT_TA_81301.pep
RFFXNXYYQTYIQLNLIXXYHNXEFDSRXYQFKCLYFIIQYHWKYIVTGFXTLTQLVSFSFNRKRMQTTESLMYFLVVSPQLSMSLYTQNKHLGTCVYVPNQAVFGAATATQLSTTNTLTSRISSPVVSDHGSCVKNPCGSLG

SEQ ID NO: 186884 - protein, 65 aa, Triticum aestivum
  Clone ID: PAT_TA_81302.pep
GTVTDVLVHDYEREVESLCAREFLCDENRVEGTGTPSLGHYVVRGGAAANREAFCGAPPTAKKAN

SEQ ID NO: 186885 - protein, 180 aa, Triticum aestivum
  unsure (1)..(180): unsure at all Xaa locations
  Clone ID: PAT_TA_81303.pep
AAAVAAADDISEGDTDPLYRACFEECQRTGTMKEDSIKHCVVLTDDQPSGTAWYAHEPLYLKWKEWNCNSEYXYHCMMEREXKREELGLGPVKYHGKWXLKRASVFQDTSTPXPLSALLSALTSSVHSMGWYGFLLAFLQLPPYPXXQXTYYXYTGLWTLSLLGMIVVHYKDALKGRENP

SEQ ID NO: 186886 - protein, 49 aa, Triticum aestivum
  Clone ID: PAT_TA_81304.pep
TCNLARLRAFPTGGAQNNHTPLVDLKKINQPLDHARRQEVVLDREPHLG

SEQ ID NO: 186887 - protein, 153 aa, Triticum aestivum
  unsure (1)..(153): unsure at all Xaa locations
  Clone ID: PAT_TA_81305.pep
LIFAGKQLEDGRTLADYNIQKESTLHLVLRLRGGMQIFVKTLTGKTITLEVESSDTIDNVKAKIQDKEGIPPDQQRLIFAGKQLXDGRTLADYNIQKXSTLHLVLXXRGGMQIFVKTLTGQDITLEVXSSDTIDNXXAKSRTRRDSGHPHLGL

SEQ ID NO: 186888 - protein, 70 aa, Triticum aestivum
  unsure (1)..(70): unsure at all Xaa locations
  Clone ID: PAT_TA_81306.pep
PRRVSFSQRSNQTSMHEIQPQPQATQKMLNDASKLGLXSPGHTYTRVARAIHITIPNLHPLSPSQVTRTP

SEQ ID NO: 186889 - protein, 100 aa, Triticum aestivum
  unsure (1)..(100): unsure at all Xaa locations
  Clone ID: PAT_TA_81307.pep
GGHHDTDVVVEKIDGDVKTEAAPAVPEXEEKKGFLEKIKEKLPGGHKKPEDAAAVPVTHAAPSTKCTPPAPAPEEVSXPXKRRRKGCLGKIMDNCLVKGK

SEQ ID NO: 186890 - protein, 88 aa, Triticum aestivum
  unsure (1)..(88): unsure at all Xaa locations
  Clone ID: PAT_TA_81308.pep
ARPGRPPEPVVTRRPPLAAVPDHHPVCPTKNAPFFPVLLHLLRSCFLSVVMVRDDSTYGISPHGFFLVGIITTARILPLMMIWIXRLM

SEQ ID NO: 186891 - protein, 102 aa, Triticum aestivum
  Clone ID: PAT_TA_81309.pep
AEYLVRSCCASFLRVHRWSPLLLPAPPSPCSCILAWLNRCQMSELEPGWMRGMRGREGERPELGRRGRSLGGKERRGDRRCRGGESGSYRRLCFYRERRRTS

SEQ ID NO: 186892 - protein, 136 aa, Triticum aestivum
  unsure (1)..(136): unsure at all Xaa locations
  Clone ID: PAT_TA_81310.pep
GRIGRYLKKGRYAQRVGSGAPVYLAAVLEYLAAEVLELAGNAAKDNKKTRIIPRHLLLAVRNDQXELGRLLAGVTIAHGGVIPKHQSXLXPKKXPAPPEKXPTNPPQEEXATXPPXRRNRTTKXTPSPYLPLSMDK

SEQ ID NO: 186893 - protein, 93 aa, Triticum aestivum
  Clone ID: PAT_TA_81311.pep
LGYSLNGTMTATITFDNTTRTLEATLHFDYDPSLPTARIKTQLPDRLDDLLPPEVSVGFSAATSNYTELHQIHSWAFKLNYPHPRAKRNTYVG

SEQ ID NO: 186894 - protein, 60 aa, Triticum aestivum
  unsure (1)..(60): unsure at all Xaa locations
  Clone ID: PAT_TA_81312.pep
LKQAKVAEKDYDENDLAYLQKKKDEQKALKELKAKAXKKGALGGSGLKEEWEEMICPPIP

SEQ ID NO: 186895 - protein, 132 aa, Triticum aestivum
  unsure (1)..(132): unsure at all Xaa locations
  Clone ID: PAT_TA_81313.pep
EDALYEKLKDAIMEAGSLRHEAYEETHRRQKADRDLADASMMARDAESSYHGEARRRKEMEENLARERAAMEQEXAGTRRHSRERYGSLMTAAPNSTPVYRLQGALMSDSDVRCPDPAPKLNKLLLINDLGA

SEQ ID NO: 186896 - protein, 126 aa, Triticum aestivum
  unsure (1)..(126): unsure at all Xaa locations
  Clone ID: PAT_TA_81314.pep
GVDFGLGIGYGSESGPQVPAPRSATVNVLKTGMMQNFKSSFVSASSSAPGNSAPLRGAPFVKPALRGFVSGGTIGGDSGAARPAPPAPSFVPASRPAGNTNENGNTNPGNXEGQRREKKAASGWDR

SEQ ID NO: 186897 - protein, 56 aa, Triticum aestivum
  unsure (1)..(56): unsure at all Xaa locations
  Clone ID: PAT_TA_81315.pep
WNLLQPIYSLLKGTAXFNQXFXTEFNXXFPHFDGIRNILTRKFXXQIKYIQXNLYT

SEQ ID NO: 186898 - protein, 128 aa, Triticum aestivum
  Clone ID: PAT_TA_81316.pep
NLRHSSLRVPVERAFASLKRRFKVLDDANPFFPSATQVDVVIACVILHNWVLSQGTDCFIIPEINWKPKLPSPQREQAHDHRHMVEFRQALADKMWEDHQNYHRNDADFLNTPAYYHEMAQSLVMDGF

SEQ ID NO: 186899 - protein, 150 aa, Triticum aestivum
  unsure (1)..(150): unsure at all Xaa locations
  Clone ID: PAT_TA_81317.pep
RVFFFFFFAGYCEQMKRVIASNDGFCRRVTMFFDFDDFTTTELAEILLLKMNSLTDTSLLYGFRLHRSCTRGAVGELIARETTEEWLKQMNGGLVDTLLVNARENLDLRLDFSCNDAETMITITLEDXEAGLRQISRQRHLWGPTIRNIL

SEQ ID NO: 186900 - protein, 44 aa, Triticum aestivum
  Clone ID: PAT_TA_81318.pep
QYGMINCIILRHLPEDTEAVCLAINQVKKYYYINTWDILSQKIK

SEQ ID NO: 186901 - protein, 168 aa, Triticum aestivum
  unsure (1)..(168): unsure at all Xaa locations
  Clone ID: PAT_TA_81319.pep
SLRVPTWRILTCREPDTPQLISTKWCSQQQDEDXQVVGNKARLVAXQGYTQVEGMDYGETYAPVARLDSIRILLAYANHHDITLHQMDIKSAFINGEIEEEVFVKQPPGFVNPKKPDHVYKLHKALYGLKQAPRAWYKCLTKFLIEKGFEIGKIDYTLFTKRVNGELF

SEQ ID NO: 186902 - protein, 143 aa, Triticum aestivum
  unsure (1)..(143): unsure at all Xaa locations
  Clone ID: PAT_TA_81320.pep
DYNIQKESTLHLVLRLRGGMQIFVKTLTGKTITLEVESSDTIDNVKAKIQDKXGIPXDQQRLIFAGKQLXDXRTLADYXIHXESTXXLVLRLRGGSKCLAMELLMSGSQGCLPVSSSIVVSSSGLCLLLPCCGLMRTTFGSNF

SEQ ID NO: 186903 - protein, 131 aa, Triticum aestivum
  unsure (1)..(131): unsure at all Xaa locations
  Clone ID: PAT_TA_81321.pep
LEVESSDTIDNVKAKIQDKEGIPPDQQRLIFAGKQLEDGRTLADYNIQKESTLHLXVLRLRGGIIEPSLPGPRPQSTTKEKMICRNXYAKAASKGLSTARQEEVLAQQPAEAPRRNLRTRLRTLFRFHCPG

SEQ ID NO: 186904 - protein, 115 aa, Triticum aestivum
  unsure (1)..(115): unsure at all Xaa locations
  Clone ID: PAT_TA_81322.pep
XIPDRXGLMXVPXQLTLXFTXDLAQGGXRKVFRWKRHXQXPPFLTXEMKVXFGKCXHKGRXRPPPQVVSHXQQLGTARAASPPATISFAHPHLILALHKIAAKAITEPKAGYPAN

SEQ ID NO: 186905 - protein, 200 aa, Triticum aestivum
  unsure (1)..(200): unsure at all Xaa locations
  Clone ID: PAT_TA_81323.pep
IERSTNLDWYKGPTLLEALDQINEPKRPSDKPLRLPLQDVYKIGGIGTVPVGRVETGVIKPGMVVTFGPTGLTTXEVKSVEMHHESLXEALPGDNVXFNVKNLLXRXXKRGFVASNXKDDLPXXRQXNSQVIIMNXPGQIGTVTHFCLPCRKFPTTKLKGLGLEPAIKPDVNDRLEQPFKKKVWKEKAPSGSGLKRPILE

SEQ ID NO: 186906 - protein, 171 aa, Triticum aestivum
  unsure (1)..(171): unsure at all Xaa locations
  Clone ID: PAT_TA_81324.pep
VESTGVFTDKDKAAAHIKGGAKKVIISAPSKDAPMFVCGVNEKEYKSDIDIVSNASCTTNCLAPLAKVINDRFXIVEGLMTTXHAMTATQXKTVDGLPTKDWEKWKGATSTSSPXXLGAAKLFGRAPPDLNXILLDASXFXXLSSVVDXTLTNHTYINKCYQESELQDLGT

SEQ ID NO: 186907 - protein, 113 aa, Triticum aestivum
  unsure (1)..(113): unsure at all Xaa locations
  Clone ID: PAT_TA_81325.pep
HRFRPGTVALREIRKYQKSTELLIRKLPFQRLVREIAQDFKTDLRFQSSAVSALQEAAEAYLGGPLXEDTNLCAIHAKRVTIMPQGHPTSPRIPEKRPKLHSASMPPLNSLLT

SEQ ID NO: 186908 - protein, 107 aa, Triticum aestivum
  unsure (1)..(107): unsure at all Xaa locations
  Clone ID: PAT_TA_81326.pep
VLEEVSILQSKRLRNKVAGFTTHLMRRIQRGPVRGISLKLQEEERERRMDFVPEKSALDVDXIRVDXETMDMLAFLXMADLPGVERAPXATSAAAPYRQPSKGRGNA

SEQ ID NO: 186909 - protein, 98 aa, Triticum aestivum
  unsure (1)..(98): unsure at all Xaa locations
  Clone ID: PAT_TA_81327.pep
GGIFVXXQEGXVISPFKNXXKNGPXIXECESLGSXXSXIXGVGRFQQVGDRRLGSXXDXTGKRXRRXXFSXGIAIGRQKXXATTFCQMPSXAHTSAPE

SEQ ID NO: 186910 - protein, 140 aa, Triticum aestivum
  unsure (1)..(140): unsure at all Xaa locations
  Clone ID: PAT_TA_81328.pep
KFETTKYYCTVIDAPGHRDFIKNMITGTSQADCAVLIIDSTTGGFEAGISKDGQTREHALLAFTLGSXSKMICCCNKMXDATTPQLLQRPLYEEIVQESLPTXKKSGTTPDKXFLPISWVXXGDNMIXGHQPLQGLPSSP

SEQ ID NO: 186911 - protein, 137 aa, Triticum aestivum
  Clone ID: PAT_TA_81329.pep
ATGGVKKPHRFRPGTVALREIRKYQKSTELLIRKLPFQRLVREIAQDFKTDLRFQSSAVSALQEAAEAYLVGLFEDTNLCAIHAKRVTIMPKGHPLARRIPLAKGPKLLLQSISMRRAFLFMGGNLPPSLLVVPGQG

SEQ ID NO: 186912 - protein, 164 aa, Triticum aestivum
  unsure (1)..(164): unsure at all Xaa locations
  Clone ID: PAT_TA_81330.pep
LFGGVHHERNGSRPAEPRRAQRWRRCPGYVQGQGLCPGRRARHGDPSDAAVQRETENTEYVGHLCQXDLGEGSPRITRSXHPTGSDRKHFGDHPIAINLGPATKLRCRXRNVNVIGPMVSFXETXFXWEKNLRQFPXQIMLRIHGQSPSCTXDXIFLNPXSKXK

SEQ ID NO: 186913 - protein, 58 aa, Triticum aestivum
  Clone ID: PAT_TA_81331.pep
PLINGGSSGGKGLDMMDVSSEVYGSAGTTTAFDLELMESCGLFCGAAGNDMEQLQWDC

SEQ ID NO: 186914 - protein, 185 aa, Triticum aestivum
  unsure (1)..(185): unsure at all Xaa locations
  Clone ID: PAT_TA_81332.pep
RVIERFEKEAAEMNKRSFKYAWVLDKLKAERERGITIDIALWKFETTKYYCTVIDAPGXHRDFIKNMITGTSXADCAVLIIDSTTGWFEAGXSPKDGQTRXHLSLLSLLGVKQMILLLQQDGPNIPNPKRYEKRLPYLKKSVQPLKVPPHGPGYNMIEGHNVGQPAAQLMTKSLLVPSDLKIERC

SEQ ID NO: 186915 - protein, 113 aa, Triticum aestivum
  unsure (1)..(113): unsure at all Xaa locations
  Clone ID: PAT_TA_81333.pep
KESTLHLVLRLRGGMQIFVKTLTGKTITLEVESSDTIDNVKAKIQDKEGIPPDXQQRLIFAGKQLEDGRTLADYNIQEGXTXHLVLXLPLWQLSPWRWLCFLLVRNLCFRTVH

SEQ ID NO: 186916 - protein, 89 aa, Triticum aestivum
  unsure (1)..(89): unsure at all Xaa locations
  Clone ID: PAT_TA_81334.pep
FSQFKKTWGSKHGSDMQGVPVKCRMTPGTKPRPIMDRHVPSSSGKGLLIRPGLSTTGTLVELTRCVIPSWAWHHLTXAWHLRPHKYRFL

SEQ ID NO: 186917 - protein, 84 aa, Triticum aestivum
  unsure (1)..(84): unsure at all Xaa locations
  Clone ID: PAT_TA_81335.pep
SHEIKPRSIPSKXTQACNKRIYDYTIAXNQTLIILLLSLNHHCCCCKETTRPECRATGQVVKRDVTSQYSRSMLLANDCDRRCR

SEQ ID NO: 186918 - protein, 125 aa, Triticum aestivum
  unsure (1)..(125): unsure at all Xaa locations
  Clone ID: PAT_TA_81336.pep
XTXCXRVKGXKLCICIQLIDLYMXSYSSPIVXFTVVXNLQCFVXSTMLXIXPVFSANYMQXCPKACSIDGLXXSAXXSKLSXISTXQLXPFSTDLXNQTTFLXKRRNVDXEVLLHXAGDSPXXVS

SEQ ID NO: 186919 - protein, 84 aa, Triticum aestivum
  unsure (1)..(84): unsure at all Xaa locations
  Clone ID: PAT_TA_81337.pep
HNLEYHVAIFQVVHYEIPNSSELFVHRSGRTARAGKKGIAILMHTYEQSRTVKVIXEXDIGCRFTEVNHGFMFSTDVKNYNSLG

SEQ ID NO: 186920 - protein, 96 aa, Triticum aestivum
  unsure (1)..(96): unsure at all Xaa locations
  Clone ID: PAT_TA_81338.pep
NIYNNXGHYTILNIITLLKFAXEREREREREREREREQQQQQDSNSEKCSSRFEDEEAAAASSKLGAAARHRKQKQGRAAAEGARGGATAVGEEDQ

SEQ ID NO: 186921 - protein, 118 aa, Triticum aestivum
  unsure (1)..(118): unsure at all Xaa locations
  Clone ID: PAT_TA_81339.pep
VEVSTSKTGKHGHAKCHFVAIDIFNGKKLEDIVPSSHNCDVPHVDRQDYQLIDITDDGYVSLLTESGNTKDDLXLPTDDVLLGQFKTGFADGKDLILSVMSAMGEEQXALXXETVGGN

SEQ ID NO: 186922 - protein, 105 aa, Triticum aestivum
  unsure (1)..(105): unsure at all Xaa locations
  Clone ID: PAT_TA_81340.pep
EIRKYQKSTELLIRKLPFXRLVREIAQDFKTDLRFQSSAVSALQEAAEAYLVGLFEDTNXCAIHAKRXTIHAQRTPXXXRXRGERAAAGCNPYHAPFKILNSWLG

SEQ ID NO: 186923 - protein, 79 aa, Triticum aestivum
  unsure (1)..(79): unsure at all Xaa locations
  Clone ID: PAT_TA_81341.pep
EIAKGSSATXKSTKLAVILILQAVLXMGILSHXNADYFPXCCNNXXVLSGVDVCDDAHPXXPXGCXXCRXGDXKPSDFV

SEQ ID NO: 186924 - protein, 104 aa, Triticum aestivum
  unsure (1)..(104): unsure at all Xaa locations
  Clone ID: PAT_TA_81342.pep
GNLVIANNDSVVWSTHNVNNRTQTSSINTTTGAAVLLNSGNLALTVTESPSSSDLPLWQSFDYPTDIFLPGXKFGRNKSPALFHQSISKEEPPWIRVLQYDKKF

SEQ ID NO: 186925 - protein, 101 aa, Triticum aestivum
  unsure (1)..(101): unsure at all Xaa locations
  Clone ID: PAT_TA_81343.pep
MAPVKLYGATLSWNVTRCVXAALEEAGVQLRLLPINFGTGEHKXPDHLAKNPFXXSTFSRXYFYFFRSXXICXYAXPKTSQTCXKEGTSRSNGFCPKLSHH

SEQ ID NO: 186926 - protein, 139 aa, Triticum aestivum
  unsure (1)..(139): unsure at all Xaa locations
  Clone ID: PAT_TA_81344.pep
QIFVKTLTGKTITLEVESSDTIDNVKAKIQDKEGIPPDQQRLIFAGKQLEDGRTLADYNIQKXSTLHLVXSSXGGIHRPPLQALSRXYNQGEDILPQMYRALNPKAVNWPPRRVATQPAKKFKTRVPLSFQWPLIIPFP

SEQ ID NO: 186927 - protein, 97 aa, Triticum aestivum
  unsure (1)..(97): unsure at all Xaa locations
  Clone ID: PAT_TA_81345.pep
KXXPXIYIYXYIYNIYIYIYIYIYIYILXVXLLPGCMEALHWERFFFGDSTGETIRKKVRRFMMTRHVDNITAYCFVIIYIVCVLIMNTCICVYLCP

SEQ ID NO: 186928 - protein, 106 aa, Triticum aestivum
  unsure (1)..(106): unsure at all Xaa locations
  Clone ID: PAT_TA_81346.pep
RIDAPKCTLALPFGDVCSVIHVHLLGXKGEIPLIPSFRVPGVHSPPXPXXPPCFXVDFRLFKYXTPPLDGXRFPGVIXLARLXIIRQLDGPXHLXGLSRPIXPXTX

SEQ ID NO: 186929 - protein, 114 aa, Triticum aestivum
  unsure (1)..(114): unsure at all Xaa locations
  Clone ID: PAT_TA_81347.pep
GSSXFLKRXVCXLXPIXFGXXYWGXINGXGSTLRXNRPGAKXSAVSCYGEIKHLMXXVSRMRSEXEFRENWTPWEDARSXGVTWEGDXNDVXGLHTWGRQVASILILKMNQPGA

SEQ ID NO: 186930 - protein, 151 aa, Triticum aestivum
  unsure (1)..(151): unsure at all Xaa locations
  Clone ID: PAT_TA_81348.pep
FAGKQLEDGRTLADYNIQKESTLHLVLRLRGGMQIFVKTLTGKTITLEVESSDTIDNVKAKIQDKEGIPPDQQRLIFAGKQLEDGRTLAXDYNIQXDPPSTWVLRLKGGMQFSVXTSPARXITLRGQSSDTLTMXKANSRQGGIPPTTLTW

SEQ ID NO: 186931 - protein, 144 aa, Triticum aestivum
  unsure (1)..(144): unsure at all Xaa locations
  Clone ID: PAT_TA_81349.pep
HYPPQHYASPVSNWLPVEPDRELTDDERASRVVFGHMLSTLPVRSRGSKIAFMFLTPGNLPFXEKLWEKSSEGHXGRYTYXHPPREXQEHXIRLLMGXNIHXXQGTXGSNSMVDAEKRFXANAPARIDXHXFVLLSXNCYLCTF

SEQ ID NO: 186932 - protein, 73 aa, Triticum aestivum
  unsure (1)..(73): unsure at all Xaa locations
  Clone ID: PAT_TA_81350.pep
MSCNCGSGCSCGSDCKCGKVYPDLTEQGSAAAQVAAVVVLGVAPGEQGRQFEVAPASRXGCXCGDNCNAPLQL

SEQ ID NO: 186933 - protein, 111 aa, Triticum aestivum
  unsure (1)..(111): unsure at all Xaa locations
  Clone ID: PAT_TA_81351.pep
GTGAANSATSSGDDPAGCHFGLSASGGASKRAAVQPXGGRRPAAAPDDXRTGSPRRRXQPRKQACTNEIELGANATSPXRTXSIPRQQLHQHFFCXKXARPXPKLATTGHL

SEQ ID NO: 186934 - protein, 118 aa, Triticum aestivum
  unsure (1)..(118): unsure at all Xaa locations
  Clone ID: PAT_TA_81352.pep
AASISSPAMSGRGKGGKGLGKGGAKRHRKVLRDNIQGITKPASGGWRKEGAALKRISXGLIYEETRGFLKFFLXXLIRXAXTYTDKPGRKTLTAMALAAKNLLFRYLLPADLFSACAP

SEQ ID NO: 186935 - protein, 69 aa, Triticum aestivum
  unsure (1)..(69): unsure at all Xaa locations
  Clone ID: PAT_TA_81353.pep
TLFLKAYYFREAAVWLLAVKSDTPTPCWDFAXESTDXVGPPNQAGPACPFTLXPPPANPDRHTPATFSX

SEQ ID NO: 186936 - protein, 45 aa, Triticum aestivum
  Clone ID: PAT_TA_81354.pep
ITCWATAIYLFWQIETNKKGQQKVKLHQKSYLSSFSFECSQSAEG

SEQ ID NO: 186937 - protein, 136 aa, Triticum aestivum
  Clone ID: PAT_TA_81355.pep
AARDNKKNRIIPRHVLLAIRNDEELGKLLAGVTIAYGGVLPNINPVLLPKKAAAAATKDPKAGTTNLPRIPPPKKRPTLKPGLPIRPSTSPSSFSLSLVPYHLLSSSSWRPSASLPGCCLFDFACSVHHFPYPINA

SEQ ID NO: 186938 - protein, 102 aa, Triticum aestivum
  unsure (1)..(102): unsure at all Xaa locations
  Clone ID: PAT_TA_81356.pep
NGPIKXGINXYQTIXKRXKTQFSRGTKPKFLFLFNTYTPGXKQLLPTMYQPPWPSALMIFLXTRTRARHPQETYXAAAXGAEEDDEEEEEXEXVRTDXXTXX

SEQ ID NO: 186939 - protein, 111 aa, Triticum aestivum
  unsure (1)..(111): unsure at all Xaa locations
  Clone ID: PAT_TA_81357.pep
XMEXKHLCLVRFKEGVGGGRTSIEDSTKXARGAPHXHLFGXGKXTXLTKRALTXVYPHXSPXIFQSPRDXKFXXXKKPXFSHXLRXVQRGFPIXPLXXKNGTXXXAPIXPP

SEQ ID NO: 186940 - protein, 118 aa, Triticum aestivum
  unsure (1)..(118): unsure at all Xaa locations
  Clone ID: PAT_TA_81358.pep
CFCXQAXGKXEXGXSWGPKSQSPTEIIXNRXRVQRSPKIQXFXYTSTHTXFTHPTYHHXTVXYNAKKKKLPVXTPXVRCMHXQQXCSARXXLTSXGRTVSAXXXDDGAQERRGGLGXX

SEQ ID NO: 186941 - protein, 128 aa, Triticum aestivum
  unsure (1)..(128): unsure at all Xaa locations
  Clone ID: PAT_TA_81359.pep
DERMELNVVEKELQMLSSFDTYDDAEIAASPVRVRHATDNVELDDDAENNLKSSSEKEYLKESXSLHPFPETDDXXDTYQFGDVGPLXTDVQXSAXLIXEKEDPELXMIRPSPNXHXXYXVXELRIGT

SEQ ID NO: 186942 - protein, 117 aa, Triticum aestivum
  unsure (1)..(117): unsure at all Xaa locations
  Clone ID: PAT_TA_81360.pep
XGXAWXXXRXVVXVXGNEVDXSXKGRHSGMWTPAXQRXTPXSPSXSGXPTXXGCXLGYLDLGPLLXXLXAARPPGNXRSECXXPTCCXSPPAQRXAPPASXQXDFFRXCVPVPHVTL

SEQ ID NO: 186943 - protein, 103 aa, Triticum aestivum
  unsure (1)..(103): unsure at all Xaa locations
  Clone ID: PAT_TA_81361.pep
LAKYPKKVIRKDSAKKTAXKSRVKVFLKLVNFTHLMPTRYTLDVDLKEVASGAPDSLTSKDKKVGAAKAAKAKLEERLKTGKNSGFLTKLRFACRPAQGVSPY

SEQ ID NO: 186944 - protein, 71 aa, Triticum aestivum
  Clone ID: PAT_TA_81362.pep
EHFANLTSLRAIDISSNNLKIVLSSDWRPPVTLKYASFGSCQMGPLFQPWLQQLKTTGLDISSNGLKDEFP

SEQ ID NO: 186945 - protein, 87 aa, Triticum aestivum
  unsure (1)..(87): unsure at all Xaa locations
  Clone ID: PAT_TA_81363.pep
MVLQNDIDLLNPPAELEKLKHKKKRLVQSPNSFFMDVKCQGCFNITTVFSHSQTVVVCPGCQTVLCQPTGGKARLTEGCSXFRRKGD

SEQ ID NO: 186946 - protein, 50 aa, Triticum aestivum
  unsure (1)..(50): unsure at all Xaa locations
  Clone ID: PAT_TA_81364.pep
XTRVLRVAPEDLEQDPTSXHLEGNFASLSLRSAGFACIXPSRQLAHAHKL

SEQ ID NO: 186947 - protein, 67 aa, Triticum aestivum
  unsure (1)..(67): unsure at all Xaa locations
  Clone ID: PAT_TA_81365.pep
XFFFFFFFFFFFFFFFXFFFFFCXLXWTLAXIXVAETAHTTATVATKHNTVPLQRMSDTRLSKEGVT

SEQ ID NO: 186948 - protein, 108 aa, Triticum aestivum
  unsure (1)..(108): unsure at all Xaa locations
  Clone ID: PAT_TA_81366.pep
RILQCVITPQPSPLLESISLFHLSVFCEAVSLACLVKAEIVCPPFTGFSSXRDMGNPIVPVSMFPRLKGESQXVTGKXPXINSYKXXKGLFXQVQXXVARXSRGGRYQ

SEQ ID NO: 186949 - protein, 40 aa, Triticum aestivum
  Clone ID: PAT_TA_81367.pep
GKNIVTTVKRTRHYFVLHGKTRLTIMLHVTFKKNVTRHEA

SEQ ID NO: 186950 - protein, 121 aa, Triticum aestivum
  unsure (1)..(121): unsure at all Xaa locations
  Clone ID: PAT_TA_81368.pep
XRYXCSSXXCLGXXPDXLHCPXNRTKYISXXSWCXCLFTXDGPXDPLLGLHFTVLIEVQIKQEFLGSAKXWTAXSFXSMVPWIFRSHSDNFFFFXDVLWSSEXLAACTRKSSIRDIGRLMT

SEQ ID NO: 186951 - protein, 66 aa, Triticum aestivum
  Clone ID: PAT_TA_81369.pep
SHVDKPDIYEGTPLCLVVNLFLIHLYSAFPWSFCNVIFVFCSALRFMQSLVLGRKYCWFVHDFLLG

SEQ ID NO: 186952 - protein, 92 aa, Triticum aestivum
  Clone ID: PAT_TA_81370.pep
KPPPLRAHPAQPAMKYSTTSTIVAVSSPSFVRSSSSIVVSKVFAVSFFAGAGAAAVVIFAPFLKGRGELVLFWGCDSINRLITASFRSSLLC

SEQ ID NO: 186953 - protein, 140 aa, Triticum aestivum
  unsure (1)..(140): unsure at all Xaa locations
  Clone ID: PAT_TA_81371.pep
SRPPMRPPAARARCRYGRRPLTWQPRPSTPQYHIAPSIYRSEHATNYSFAPLVPSTPPPRHRSERQHDRGTSPSAGARPTPDWARARMLPAYYSSSLYAAASSRRRXSGDRDGRXRARCCRRNNGPFVAIXGXPIRRWHV

SEQ ID NO: 186954 - protein, 204 aa, Triticum aestivum
  unsure (1)..(204): unsure at all Xaa locations
  Clone ID: PAT_TA_81372.pep
AAGAEYVVESTGVFTDKDKAAAHIKGGAKKVIISAPSKDAPMFVCGVNEKEYKSDIDIVSNASCTTNCLAPLAKVINDRFGHLLKGXLMTTFNAMTATPRRLFDGLSNKDWEKWKRLPTXNTFPSTLGXPKLFGKVSPKALTEFXGMXFRVPTVSFXLLXLXFXLXKPXTYIKLRCYKEDXRELXGIWVTIRFTTGEVTFIKAG

SEQ ID NO: 186955 - protein, 88 aa, Triticum aestivum
  unsure (1)..(88): unsure at all Xaa locations
  Clone ID: PAT_TA_81373.pep
SSKSIYRLYHGTVYNTDIFIKSGVTTVRSFHQRIKLEHCSPTRGAIWRHTKQHHPLLAKRHGRTEGGIMQRGIHPSKGSPVXSLLKWS

SEQ ID NO: 186956 - protein, 132 aa, Triticum aestivum
  unsure (1)..(132): unsure at all Xaa locations
  Clone ID: PAT_TA_81374.pep
VTLGPAVREGEHVFGVAHIFASFNDTFIHVTDLSGRETLVRITGGMKVKADRDESSPYAAMLASQDVAVRCKELGITALHIKLPFYWVGNKTKTPXPWVLKLRLXXLARFWAMKIXLXEDFTPXPQLTEPAK

SEQ ID NO: 186957 - protein, 77 aa, Triticum aestivum
  Clone ID: PAT_TA_81375.pep
KTRIIPRHLLLAVRNDQELGRLLAGVTIAHGGVIPNINSVLLPKKSPAAAEKEAKSPKKKTATKSPKKKSPPRSSAP

SEQ ID NO: 186958 - protein, 84 aa, Triticum aestivum
  unsure (1)..(84): unsure at all Xaa locations
  Clone ID: PAT_TA_81376.pep
MSSSEVXCTLAALILHDDGIPITSEXIATVVXAAGIXVEAYWPXLFAKLLEKXSVDDLNPSVGFWWEWLQLRLPRLLGPLKKDK

SEQ ID NO: 186959 - protein, 33 aa, Triticum aestivum
  Clone ID: PAT_TA_81377.pep
RLIKVKPNHSIKVSSPLLSHTQQSPYSKGGPGY

SEQ ID NO: 186960 - protein, 116 aa, Triticum aestivum
  unsure (1)..(116): unsure at all Xaa locations
  Clone ID: PAT_TA_81378.pep
MVKAVAVLTGSEGVKGTIFFTQEGDGPTTVTGSVTGTQGRVHGFHVHLFGDTNNGXSTGXNXKPCXHXHGXPEDXNRHAGDLGNVTXGXDGVANTSYWTAYPLTGQICWPVASTVT

SEQ ID NO: 186961 - protein, 138 aa, Triticum aestivum
  unsure (1)..(138): unsure at all Xaa locations
  Clone ID: PAT_TA_81379.pep
FXXFXLGGXLXCLXPXXXFXFXAQENXXPLLLWEIFPPXFKPXPLFLGNXXNXFPFXVXNLVPGPXXXPFGNSPPRGPPEHLXPEFFXGXFGTFGFGFERFSNYPFCXFPFSWSFPXFLFXLCKAEGSLGIAXRRSPX

SEQ ID NO: 186962 - protein, 46 aa, Triticum aestivum
  Clone ID: PAT_TA_81380.pep
GKALFVDVDAILFEHILWLAGCHDRSAVSLLQPDLQDIIDFYSQDA

SEQ ID NO: 186963 - protein, 135 aa, Triticum aestivum
  unsure (1)..(135): unsure at all Xaa locations
  Clone ID: PAT_TA_81381.pep
MGKEKTHINIVVIGHVDSGKSTTTGHLIYKLGGIDKRVIERFEKEAAEMNKRSFKYAWVLDKLKAERERGINPNXXIIALLGKFEEPNQSYYCTXVIDAPGHRXDFIXRNMITGTSQADXAVLIIDSTXGGFEAG

SEQ ID NO: 186964 - protein, 89 aa, Triticum aestivum
  unsure (1)..(89): unsure at all Xaa locations
  Clone ID: PAT_TA_81382.pep
LVLGXSKXSQLAPXCLMTNNQTXSGIVLKDDSPRLDLXFXXGILVFLSTXXDFSXTGKXPGXNISKEPAXLGLXPLNSLVAMHISYXSG

SEQ ID NO: 186965 - protein, 88 aa, Triticum aestivum
  Clone ID: PAT_TA_81383.pep
KVIDRKVLHLLHRAIPPWSQLTTMHSTRYSYPTLVVDSPAYLPDLCALVGFGLGTPQNFFPQKFSNGLLLETSSPNAPAFFAVFCHLL

SEQ ID NO: 186966 - protein, 97 aa, Triticum aestivum
  Clone ID: PAT_TA_81384.pep
EMLEQQHSDKAHIEVSCADKMSEVLYDDNNTLKKNTICGGKVAIECHLALLHNKSSEARSNAISSPMQKRPFACQCHVDGCTMSYDSKNNLAQRPIF

SEQ ID NO: 186967 - protein, 116 aa, Triticum aestivum
  unsure (1)..(116): unsure at all Xaa locations
  Clone ID: PAT_TA_81385.pep
VDDQAVKVVDIVDTFRLQEQPAFDKKQFISHMKRYIKNLSAKLEGDDLDAFKKNVESATKYLLSKLKDLQFFVGESMHDDGGVVFAYYXGGKLAWNSQTFPWYFGNMGGLEKRSKC

SEQ ID NO: 186968 - protein, 58 aa, Triticum aestivum
  unsure (1)..(58): unsure at all Xaa locations
  Clone ID: PAT_TA_81386.pep
RVRRRRLEAQVGRYETRKGERGSXVWMDTWVRVFPFFSCPTSIVGYPTNVQFSLIFWI

SEQ ID NO: 186969 - protein, 154 aa, Triticum aestivum
  unsure (1)..(154): unsure at all Xaa locations
  Clone ID: PAT_TA_81387.pep
KVELASLYGGYSDQLAVVAAFDCWTCAKEKGQEALFCSKYFVASNTMNMLSSMRKQLHSELAQRGFLPADTSACSLNAKVPGIIKCXVLWLAAFNPQMGRERLLPPSGQKMLRRAVVETASXGAKVRLHPXSSNFNLSFNKPLGTTXVFDETPK

SEQ ID NO: 186970 - protein, 109 aa, Triticum aestivum
  unsure (1)..(109): unsure at all Xaa locations
  Clone ID: PAT_TA_81388.pep
EILSAIPCTSSKEKKMIQQYTCHLWTRAHDAPCIQLPHSRSALLQCPPLSPKQAIYERNQTAAHHTEEARVLCSHEQHAPVHVTHPQWLTRLXIYRPLNHPNGQPSCCC

SEQ ID NO: 186971 - protein, 134 aa, Triticum aestivum
  unsure (1)..(134): unsure at all Xaa locations
  Clone ID: PAT_TA_81389.pep
KIQDKEGIPPDQQRLIFAGKQLEDGRTLADYNIQKESTLHLVLRLRGGMQIFVKTLTGKTITLEVESSDTIDNVKAKIQGQGGHPPGTKQAGXSNPFGWGKQAXKGMGRHLGKNYNIQKESTLHLVAPSPKVAK

SEQ ID NO: 186972 - protein, 99 aa, Triticum aestivum
  Clone ID: PAT_TA_81390.pep
EDLCTSLELFNLAIKCARAEEGRLSLLELPAADPEEKKPKAKDAKRKGAAVLAAEPNTKRGRDQPESSKGSRYCMYHDLHTHNTNECQELRAVRHGRVG

SEQ ID NO: 186973 - protein, 141 aa, Triticum aestivum
  Clone ID: PAT_TA_81391.pep
PKVPTVASDLQKTRAAEAKARKRKTKNTTDNASPTKKRKTKKKDRVAPTEPLVVEPISIARPASAQQERRLIVHEPASPEAPEAEDIPAVNPTAAEDIGHQDNVEDDEVLPQIEHNVVSSPILTNSELISIGSSIDANRSR

SEQ ID NO: 186974 - protein, 192 aa, Triticum aestivum
  unsure (1)..(192): unsure at all Xaa locations
  Clone ID: PAT_TA_81392.pep
VWEFLLGCYALSSTTEYRRKLRAARREKYQCLVRQCKSMHPSIGTGELAYAVGSKLMDVRTMPKENDSREEVSTSQRASENAPGSTVENSNLNYDSGGAPQSQSCSKSAEVAGFNAHNDSSVYNSSKFMVSSTVVNSCLSDSGDYNDMGEPRYDSETFTGYPSLPGTNLFANDGXGCHGVDESLVVPXPEDR

SEQ ID NO: 186975 - protein, 80 aa, Triticum aestivum
  Clone ID: PAT_TA_81393.pep
VVSFSQSHRSGNYGKDQLPTAAICLDSSQPNYMISLNKLELILSLHLRYNHERKKIPDRVVYHVMLPAPFSKTGHIAPSI

SEQ ID NO: 186976 - protein, 82 aa, Triticum aestivum
  unsure (1)..(82): unsure at all Xaa locations
  Clone ID: PAT_TA_81394.pep
EMPWXGWTPXPPLGCTXNLEEGAGLRPSPPLLHLYKGRGGRAGRTXKPLXPPLPATPPPPXXCRLAKPYRSSAASTTMPSCC

SEQ ID NO: 186977 - protein, 101 aa, Triticum aestivum
  unsure (1)..(101): unsure at all Xaa locations
  Clone ID: PAT_TA_81395.pep
MKGTKLAAILILQAVLVMGLLSHVNADFFPKCCNNCRSFSGVDVCDDAHPKCPQGCSXFRVVSXSPEMXWRCAGYESTVXGTCGGPCNEXIGSCRNMFRRL

SEQ ID NO: 186978 - protein, 83 aa, Triticum aestivum
  unsure (1)..(83): unsure at all Xaa locations
  Clone ID: PAT_TA_81396.pep
EIAVKKLHPFQGLDDKQFHNEVRNLIKIRHKNVVQLIGYCYESKHKYIEHNKELRXSARTMERVICFEYMEGGSSDKHITGKF

SEQ ID NO: 186979 - protein, 105 aa, Triticum aestivum
  unsure (1)..(105): unsure at all Xaa locations
  Clone ID: PAT_TA_81397.pep
DQKDAXXXDGRAXRXXWKEGDAXRXLGKXXTHCIPLVSVTRVXFLRXVADLLKPSLAGPXXQFCRINXXXIWSXXXNXKIIKCSXXAGQCXSGGWVGCPSVRPRS

SEQ ID NO: 186980 - protein, 102 aa, Triticum aestivum
  unsure (1)..(102): unsure at all Xaa locations
  Clone ID: PAT_TA_81398.pep
MSDTDEHHFESKADSGASKTYPQQAGXIRKGGTHPSSKARPCKVVEAPPXKTGXKHGHAKCHFXVAIGHLLMGKKFEDIVPSXHNCDVPPCLTAKDLQLDWT

SEQ ID NO: 186981 - protein, 141 aa, Triticum aestivum
  unsure (1)..(141): unsure at all Xaa locations
  Clone ID: PAT_TA_81399.pep
MARGAAAAAAAAKGKKKGSVSFVIDCTKPVEDKIMEIASLEKFLQERIKVAGGKAGXLGDSVTVTRDKSKAPSPPTAPSPKRYLKXLXPRITLKKHNVRDWFPVIAANXDATXYDSGYFNIAKWKGEEGDMHCKWYAFELI

SEQ ID NO: 186982 - protein, 141 aa, Triticum aestivum
  unsure (1)..(141): unsure at all Xaa locations
  Clone ID: PAT_TA_81400.pep
NNFARGHYTIGKEIVDLCLDRIRKLSDNCTGLQGFLVFNAVGGGTGSGLGXLFCWERLSVDYGKEAKLXGFTVYPSPQGSTSVVEPYNSVLSXHPSLGHTDVSILPWTMEASMNLPPSPLNPNIHLNSCFPHFAELRLPRS

SEQ ID NO: 186983 - protein, 127 aa, Triticum aestivum
  unsure (1)..(127): unsure at all Xaa locations
  Clone ID: PAT_TA_81401.pep
DVGGQDKIRPLWRHYFQNTQGLIFVVDSNDRDRVVEARDELHRMLNEDELRDAVLLVFANKQDLPNAMNAAEITXDKLGLHPLRQRHWVHPDTWCYNQGRDCLKAWTGVQQHCQQLIPNFRTTFGRD

SEQ ID NO: 186984 - protein, 150 aa, Triticum aestivum
  unsure (1)..(150): unsure at all Xaa locations
  Clone ID: PAT_TA_81402.pep
AARDNKKNRIIPRHVLLAIRNDEELGKLLAGVTIAYGGVLPNINPVLLPKKXAAAAVSKEPKGRHDQSPRPPAKKAARRFPGLPYPVPRPPLPPLCLSCLRTTHLVFLLLASVSDPSLSWFIAACFTCFAWFPHKCITLPRTLIKPLFPF

SEQ ID NO: 186985 - protein, 76 aa, Triticum aestivum
  unsure (1)..(76): unsure at all Xaa locations
  Clone ID: PAT_TA_81403.pep
XXRSIWXHRRPARPLXXRRHTGAAXHQXGARRRQPAQALXQPRXRWXNTLSYIYPRIXLHVFVXWLACNFPFISSL

SEQ ID NO: 186986 - protein, 101 aa, Triticum aestivum
  unsure (1)..(101): unsure at all Xaa locations
  Clone ID: PAT_TA_81404.pep
MSEKKRAPGPRKDEVVTREYTVNLHKRLHGCTFKKKAPNAIKGDQEFAQKAMGTNDVRIDVELXNKHIWSXGIXMSXRXPXQXAPQENDEEDAKEVPPAHC

SEQ ID NO: 186987 - protein, 90 aa, Triticum aestivum
  unsure (1)..(90): unsure at all Xaa locations
  Clone ID: PAT_TA_81405.pep
KVPHAPYMSKGFPPLLSILGKLMMYYSXDYSHISMTSCLPICLIINFCPSISTIVQFFQFGPIFACYHIFFNNXTIFCRFPNRPELGQTY

SEQ ID NO: 186988 - protein, 69 aa, Triticum aestivum
  Clone ID: PAT_TA_81406.pep
GIGKTQFCLKLALLATLPECYGGLNGRVVYIDTESKFSSRRMIEIGQKSFPQIFRQEGLAQKMAGQDPK

SEQ ID NO: 186989 - protein, 171 aa, Triticum aestivum
  unsure (1)..(171): unsure at all Xaa locations
  Clone ID: PAT_TA_81407.pep
FHGDRRQRPRSRKRIEAIVLKHARDGSAFTKLRGVQQGRSHRPHRPAQLQPPLPRYASSLRCISSSSTYSKCIFRFWAGPGGMRXSVWLPPQGPWXRRLGQFWSLIFQLXRLXYFQLYSRLLXSXHFVFXGNVXMLIPTFQPGQNIKKPTXXKRNXXIWXXSLEXXIXXVC

SEQ ID NO: 186990 - protein, 179 aa, Triticum aestivum
  unsure (1)..(179): unsure at all Xaa locations
  Clone ID: PAT_TA_81408.pep
AAFLKKNLNTVDMVALSGAHTIGKAQCSNFRTRIYGGDTNINTAFATSLKANCPQSGGNTNLANLDTTTPNAFDNAYYTNLLSQKGLLHXXDRCSXNNDTTDNTVRNFASXNAGGLXSAFTTAXSKMGNIAXLTGTQGQFRXNCSKVNSWMRRTTLNDKAPMAIHFQSRLCFNAQHQHF

SEQ ID NO: 186991 - protein, 105 aa, Triticum aestivum
  unsure (1)..(105): unsure at all Xaa locations
  Clone ID: PAT_TA_81409.pep
EAHAARVGIPMLTLADAAEIHLSIDGADEVDPDLNLVKGRGGSAPPREDDRRAPGARFVRHRRRSKSSPRLRLHGSVPVRVLPLPAXPTRXAXPAXCFDKLPFRA

SEQ ID NO: 186992 - protein, 149 aa, Triticum aestivum
  unsure (1)..(149): unsure at all Xaa locations
  Clone ID: PAT_TA_81410.pep
MAGRKGGDRKKAVTRSVKAGLQFPVGRIGRYLKKGRYAQRVGSGAPVYLAAVLGVPXRXRSLESPGNAXAKDNKKTPHHPRATWLLARSGNDQEXXQAVXGVNIAQRRFIPNINPXCPQXPPPXAXKEAIPQRRTPPXPKXKPPQGPPQ

SEQ ID NO: 186993 - protein, 172 aa, Triticum aestivum
  unsure (1)..(172): unsure at all Xaa locations
  Clone ID: PAT_TA_81411.pep
SRRCLEIARETLDAKRSVNSERVAGAYTEISMLYESMNEFEMSLCLMKKTLAFLRGCLKGCSTFQGSISARMGFSSLXTKRIDXPVLFLGESCLRSXKNCFWPAHFGXRFAXYKHLGEAXIEMGQXRTTYXSFGLANDTINAXFGLKHEIPWNHQRXXMRXXRXGEXKMPFQ

SEQ ID NO: 186994 - protein, 118 aa, Triticum aestivum
  unsure (1)..(118): unsure at all Xaa locations
  Clone ID: PAT_TA_81412.pep
HHHXKPTKVVHHVLVIGVVLMVNRHVXCGHSITXHVRRAGFKLLKQGSHPWTVWKGSNLSFLEVHAKLGTAAQIYVQQHTWWTLSQDSRKLPKSEFTEKKLMCIQDKLYQKHFIIFCR

SEQ ID NO: 186995 - protein, 150 aa, Triticum aestivum
  unsure (1)..(150): unsure at all Xaa locations
  Clone ID: PAT_TA_81413.pep
EPKRPSDKPLRLPLQDVYKIGGIGTVPVGRVETGVIKPGYGCYLWVPLGLTTXEVKSVXEMHHDLSLGGVPWVDNVXSNVQERLLLRILEAWVLFASQLXKDDPXPKEAATXTPQVXSSMNHPGPDFXNGTPQCLDWHTSHIGCQFPPTW

SEQ ID NO: 186996 - protein, 31 aa, Triticum aestivum
  Clone ID: PAT_TA_81414.pep
VPGPMQGRGFYGCGNWTPSMGAHCSYFTWAD

SEQ ID NO: 186997 - protein, 103 aa, Triticum aestivum
  unsure (1)..(103): unsure at all Xaa locations
  Clone ID: PAT_TA_81415.pep
LGCWCLWYGCWVGHCWLTPGERLRECMAGPSNLGYTAGIPQITHSYRDHHMAIKHXWLKVHCSKYLPSPCLXTANXKKIYKRXXEYXRKKRTYDVQXPXXQPX

SEQ ID NO: 186998 - protein, 120 aa, Triticum aestivum
  unsure (1)..(120): unsure at all Xaa locations
  Clone ID: PAT_TA_81416.pep
MPAGHGLRSRTRDLFARPFRKKGYIPLTTYLRTYKXGEHVDVKVNGAVHKGMPAQXYHGAPSASGRHQXAIRFEFNKQXXNRFIQERFHVRXGQXXPSXCNEIPPXRTQQRQXXAEPXXL

SEQ ID NO: 186999 - protein, 66 aa, Triticum aestivum
  unsure (1)..(66): unsure at all Xaa locations
  Clone ID: PAT_TA_81417.pep
MSCCGGNCGCGSACKCGNGCGGCNMYPEAEXAAGATLLRLXATATHKAXPGGMXEMAAENGGCRLH

SEQ ID NO: 187000 - protein, 62 aa, Triticum aestivum
  unsure (1)..(62): unsure at all Xaa locations
  Clone ID: PAT_TA_81418.pep
SLRKGVNPIPTPKIXFGSXINXHPXGSNTQXXNRTGTFLHXKPXAXPPXSRXEAANXAFXRE

SEQ ID NO: 187001 - protein, 85 aa, Triticum aestivum
  Clone ID: PAT_TA_81419.pep
LNLRNTRINELSEQIGLLVFLQMLDIRGTYVNKLPASVANLRRLVYLLTDTGVIIPDGIAKMQALGDTEAGASSKQSVNFPAKLN

SEQ ID NO: 187002 - protein, 80 aa, Triticum aestivum
  unsure (1)..(80): unsure at all Xaa locations
  Clone ID: PAT_TA_81420.pep
HLLPPRRHLQQPQVEQRPVAEAGRRGRRRAGRGGHVAGEPGDRRERRCRGQDGCGGGAPSRTGGXGRGLACVITLTNHXV

SEQ ID NO: 187003 - protein, 86 aa, Triticum aestivum
  unsure (1)..(86): unsure at all Xaa locations
  Clone ID: PAT_TA_81421.pep
PSKKSFTWARTIVAFSSSVLLYGNFSRGLRGGPYLYCLPPLLAVLLDVGADEAAVAPVFFHACLRSRRRRTTTHRSSWGRRRXLPP

SEQ ID NO: 187004 - protein, 136 aa, Triticum aestivum
  unsure (1)..(136): unsure at all Xaa locations
  Clone ID: PAT_TA_81422.pep
VLXTGSPITVPVXRATLGRIINVIGEPIDHKXGDIKDTTTSLPIQXEAPCFWXNKPQEQQILGNREFKAXXFLAPXQKGXGKIXPLPWVXELGXTGPNKEFXNMFAXAXXGFXRFSPGVETPLKVRLEIIKGPNNK

SEQ ID NO: 187005 - protein, 102 aa, Triticum aestivum
  unsure (1)..(102): unsure at all Xaa locations
  Clone ID: PAT_TA_81423.pep
SAALSRKCAAASALDGEKKQQKLSEIQADVXESESLXKEDXXGGAGAMQPEXVKAGLAGKLXEYNPDXNNXXRARFKESPXXKAQQAPXEXSPPMFNPDHLF

SEQ ID NO: 187006 - protein, 100 aa, Triticum aestivum
  unsure (1)..(100): unsure at all Xaa locations
  Clone ID: PAT_TA_81424.pep
FFFFFFFFFFFFGPTICSFHSLXRPKMFVQKRIRGTLQLIDHLSTSTYQTMTSSXDARGELAVPRSFYLILAAXAAVWDXKNPTXRHLMPAIYCIHXIXV

SEQ ID NO: 187007 - protein, 68 aa, Triticum aestivum
  unsure (1)..(68): unsure at all Xaa locations
  Clone ID: PAT_TA_81425.pep
PSLYPQRVAPHLIVQQQKKQPPQVVRGSPATRLRAGXSPATASDEKHGGSSSRLXTGKQCVFGCLITS

SEQ ID NO: 187008 - protein, 74 aa, Triticum aestivum
  unsure (1)..(74): unsure at all Xaa locations
  Clone ID: PAT_TA_81426.pep
XKLSSRLRFPISXQCHTXXKQLVPGPHXKXLGNQSXXPIXFWXXRRFSVXTLFPVEXPPPLXNFLXRXNNFGSP

SEQ ID NO: 187009 - protein, 153 aa, Triticum aestivum
  unsure (1)..(153): unsure at all Xaa locations
  Clone ID: PAT_TA_81427.pep
KPMALVKKLRKAKKDAPAGEKPEPVRTHLRNMIIVPEMIGXSLIGVYNGKTFXTKVEINLEMIGHYLAXSLLLQPXEHGKPGTVPTSSXSSPXKIYPFPLLKIQLPPGCPPTVPLVLTIPNLVRKFLKVPNKSMRFDPSAFGFFKNQLLVKKK

SEQ ID NO: 187010 - protein, 96 aa, Triticum aestivum
  unsure (1)..(96): unsure at all Xaa locations
  Clone ID: PAT_TA_81428.pep
MPQSTADAXTLINVFXSRNLEPXDLVALSGAHTVXKAXCSSFXNRFSKDXDFARRLPANCSXRPKPXAGLQXXNPHXVGXXFFKNLXEGXGXSPKW

SEQ ID NO: 187011 - protein, 77 aa, Triticum aestivum
  unsure (1)..(77): unsure at all Xaa locations
  Clone ID: PAT_TA_81429.pep
ELQFHEAKGEAHVYFLPKYDSDNAVKELAMVADFVKALLEILLIRPVNDQATKEHTFVIIPXFPRLQICMKFHKQVX

SEQ ID NO: 187012 - protein, 182 aa, Triticum aestivum
  unsure (1)..(182): unsure at all Xaa locations
  Clone ID: PAT_TA_81430.pep
NKINMPTXDNPRIPCTDRFFFYRSATLLRPSKDVNKPSLSQHLPNFRFQLRSISIISNKPTLGSKQTHXNPIPQKNKQSHQXXRTRTQKRHPXTXHMFQMGXGXGPGWXLFXXGPKXGETXGXXPLGTGXTFFPXHSXXFTMSTLXKSPLLSTLXDGPPLGALRIFGKRRFPPPXSGGTXPF

SEQ ID NO: 187013 - protein, 87 aa, Triticum aestivum
  unsure (1)..(87): unsure at all Xaa locations
  Clone ID: PAT_TA_81431.pep
FRLQVAGRCTLNLXEAGQVPRPKSPPLVRPXALRPEEQRRGNFKVARPGQFXAKAAXLPATTANFNPLANWFXXAITPXLWGLKXNL

SEQ ID NO: 187014 - protein, 59 aa, Triticum aestivum
  Clone ID: PAT_TA_81432.pep
MAATTPTLVLLPEWGAGHLMSMLESCKRLLLRGGRAFSITLLVMRPPTAQATSQVEEHV

SEQ ID NO: 187015 - protein, 78 aa, Triticum aestivum
  unsure (1)..(78): unsure at all Xaa locations
  Clone ID: PAT_TA_81433.pep
GPSAPPSSTTKKQAWDDQLGSSGVGPVQSGAALGGHLPRGWVIRAIPXKSRDYPPIKPVPKWXLIAVNLXHSLSXGGG

SEQ ID NO: 187016 - protein, 107 aa, Triticum aestivum
  unsure (1)..(107): unsure at all Xaa locations
  Clone ID: PAT_TA_81434.pep
MAPKAEKKPVAEKAEKTTAAKXTKAEXRSPASXEGGEEEGQEEXKXSVETYKIYIFKVLKQCTRDIGISSKAMSTXMTPXINDIFENSPGSGNSPQELQGQTSGSPT

SEQ ID NO: 187017 - protein, 96 aa, Triticum aestivum
  unsure (1)..(96): unsure at all Xaa locations
  Clone ID: PAT_TA_81435.pep
RLFAKXXMRILMVGLXAAGKTTILYKLKLGEIVTTIPTIGFNVETVXYXNISFTVWDVWGXDKIXXLWXHYFQNTQXSHHCLTIWTRVVSNGITPG

SEQ ID NO: 187018 - protein, 139 aa, Triticum aestivum
  unsure (1)..(139): unsure at all Xaa locations
  Clone ID: PAT_TA_81436.pep
LFAPXKNRGRFKXXLXGXPRGXXNXXXRGSFXPTGKPKRREFXFXQSGXEXLQLVXGKFSXSFNRANHAHQHVKGAXLQITKKGTPYITLYCSRISATSACHGTPLCRPQIPLFLSDQPPRDYVPRYCIKSLSSSSSSS

SEQ ID NO: 187019 - protein, 144 aa, Triticum aestivum
  unsure (1)..(144): unsure at all Xaa locations
  Clone ID: PAT_TA_81437.pep
TNIFXHALVFGTLTXFPXFXSQTKFXREXRYRGVAXPNXXEVYQTVVLERYCFFSGITSXMFSPRGXTLPGGVAQYDPFCPPRGPGRSSFPVDCCESAADKLSSSQPLFSATWIVSGASPISPMLDSTADCVKQVSGSPAELKS

SEQ ID NO: 187020 - protein, 80 aa, Triticum aestivum
  unsure (1)..(80): unsure at all Xaa locations
  Clone ID: PAT_TA_81438.pep
MGHSNVWNSHPKNYGPGSRVCRVCGNSHGLIRKYGLMCCRQCFXASNAKDIGSIKLPFKNNLQRKQGLRKLSNELWVLPS

SEQ ID NO: 187021 - protein, 77 aa, Triticum aestivum
  unsure (1)..(77): unsure at all Xaa locations
  Clone ID: PAT_TA_81439.pep
NERLQIKLHTSMEDTRFAQFTPTTTIQXRTRLPTKITPXLSPGXQXKLRYFWNEXTSXXKGNIHKLKRHKXTIXXHX

SEQ ID NO: 187022 - protein, 77 aa, Triticum aestivum
  unsure (1)..(77): unsure at all Xaa locations
  Clone ID: PAT_TA_81440.pep
MSCNCGSGCSCGSDCKCGKMYPDLTEQGXSAAAEVAAVGLLXGVAPENKXGHFXVAAGHPGXGCXCGDNCNSTPCNC

SEQ ID NO: 187023 - protein, 131 aa, Triticum aestivum
  unsure (1)..(131): unsure at all Xaa locations
  Clone ID: PAT_TA_81441.pep
XGXGSXXGXCNXXYQVSFGQLAXRVXWXLWAKSLCQXESYKMCVLYXXRGYGYMGRDEALWXSIYGVKXPKCRSLXGVIWFPARRXTXEXSLNMQGSPISKPKHPFGCSPMSILRAQQATPSFLSTMGLLK

SEQ ID NO: 187024 - protein, 61 aa, Triticum aestivum
  Clone ID: PAT_TA_81442.pep
TPGLAMAKDSLQPRGPKQSAFVRMCISILLHLVLLLHDDKDDVAMRAHCNMSPVTAPPLRC

SEQ ID NO: 187025 - protein, 141 aa, Triticum aestivum
  unsure (1)..(141): unsure at all Xaa locations
  Clone ID: PAT_TA_81443.pep
SDRHAQLEQEVIERVDIAVRSAEESWAVKFMNFIIGSNQLLFNGMTRELPVIGVVEXSWXVGIIDELRMPMDGISFHPXLXDTKTRFKATIPSGXRXEMGRLHLMCYKYLRGQFISXEIXNREFLHYLDLNXNFLLSNDVX

SEQ ID NO: 187026 - protein, 88 aa, Triticum aestivum
  unsure (1)..(88): unsure at all Xaa locations
  Clone ID: PAT_TA_81444.pep
SVFXVLIGIRNXHYLIFINSVPLFXIFPXILFXLPRTRMYLXSFXSYPLSXNXHIFYXVXSKSQRTSHFFXRFPSYQXTNIKFFEXQI

SEQ ID NO: 187027 - protein, 68 aa, Triticum aestivum
  Clone ID: PAT_TA_81445.pep
DIVWSRFDQEASWPKLLTDNKQTDLKKQSCKITTERWAVPPRCTGWRRLHGTVVLGRGRHCRLRARPP

SEQ ID NO: 187028 - protein, 95 aa, Triticum aestivum
  unsure (1)..(95): unsure at all Xaa locations
  Clone ID: PAT_TA_81446.pep
VCVFATCHCRYVNIGVQCCVFAFNSFCVTRASWATILIHELNMSVMGGSWNWGLRYSPNCPQVLRQSLGKMACPDXLXCFQQQXGPRMXTSEXNP

SEQ ID NO: 187029 - protein, 51 aa, Triticum aestivum
  unsure (1)..(51): unsure at all Xaa locations
  Clone ID: PAT_TA_81447.pep
PRPLPRPWTRPPPPPAPXAPXTPPPXGPPXPPWXXPPXTERAPAADRQIPI

SEQ ID NO: 187030 - protein, 110 aa, Triticum aestivum
  unsure (1)..(110): unsure at all Xaa locations
  Clone ID: PAT_TA_81448.pep
PVAQLRTEEVXRPLLFLTMKXPKNTGECFQTXPYFFXMRVPSNWGQRXNGITYFYKFSXDLFKVTGNNHEXXXQXNVPLTSNIPPNPXXXPGXLPTKXRSSDPYXCXTXI

SEQ ID NO: 187031 - protein, 56 aa, Triticum aestivum
  unsure (1)..(56): unsure at all Xaa locations
  Clone ID: PAT_TA_81449.pep
MGHSNVWNSHPKNYGPGSRVCRVCGNSHGXIRKYGLMCCRQCFRSNAKXLGFIKYR

SEQ ID NO: 187032 - protein, 130 aa, Triticum aestivum
  unsure (1)..(130): unsure at all Xaa locations
  Clone ID: PAT_TA_81450.pep
MGRRPARCYRQIKNKPYPKSRYCRGVPDPKIRIYDVGMKKKGVRRFXHCVHLVSMGEGNVSSXGPLRLPLMLGNXYMTNMPXKGXFHLXVQVXPSXVLPFQQSFXXPGYSPKLDEGSFEPPDPLFPLAAS

SEQ ID NO: 187033 - protein, 81 aa, Triticum aestivum
  unsure (1)..(81): unsure at all Xaa locations
  Clone ID: PAT_TA_81451.pep
PENLLLDENRNLKISDFGLSALAECKRQDGLLHTTCGTPAYVAPELIXKKGYDGAKADIWGLWXHLYVLLXGYLPFSRTRI

SEQ ID NO: 187034 - protein, 134 aa, Triticum aestivum
  unsure (1)..(134): unsure at all Xaa locations
  Clone ID: PAT_TA_81452.pep
KEPFXGYXLILGXMGPGPPPLGXFFXXXAPGGXCPLSFXGGRXRACHSPGXKPKENXGXSPRFVXPRQXFSVLVWLISSNICSXGILGXCLGGLHWMDSSGSGHVPCSFLFSRNMLXRVAXWCXFYNPXXNDQX

SEQ ID NO: 187035 - protein, 152 aa, Triticum aestivum
  unsure (1)..(152): unsure at all Xaa locations
  Clone ID: PAT_TA_81453.pep
AKTRGRKKGSKAKKSVETYKIYIFKVLKQVHPDIGISSKAMSIMNSFINDIFEKLAGESAKLARYNKKPTITSREIQTSVRLVLPGEXAKHAXSXGTKASQTLLNDACIGSRYPLGTVRTYCGDCNLVLLYKNCALEIQQLFPKKKGGRTIP

SEQ ID NO: 187036 - protein, 88 aa, Triticum aestivum
  unsure (1)..(88): unsure at all Xaa locations
  Clone ID: PAT_TA_81454.pep
DDTSGGNASGGGSGNGGGQGGGVAQGPSMGVGSGSGFGGGHTGSTGSFGQGYATGFGGGXGGGTGGSYNGGSGXGGGSGSGGGKRRIH

SEQ ID NO: 187037 - protein, 139 aa, Triticum aestivum
  unsure (1)..(139): unsure at all Xaa locations
  Clone ID: PAT_TA_81455.pep
DKKKKKAKKSVETYKIYIFKVLKQVHPDIGISSKAMSIMNSFINDIFEKLAGESAKLARYNKKPPSRPREIQTXVPPRPPXGESAKHAVSXGTKAVHKFNSSLNTRSLVFLGPFPVGYCGPRTFGVGSNVLIPEKNEFS

SEQ ID NO: 187038 - protein, 137 aa, Triticum aestivum
  unsure (1)..(137): unsure at all Xaa locations
  Clone ID: PAT_TA_81456.pep
RSGVXIKRAGFTHRRIPGSRGXLCCSSRGCLXRGXKVXRSRGXFSGPPRRMKKVSCRXVCLGRAPPANTLKFADAQRARPTCEPPSTAATRNLSPSVASCSPPQSRACLELVVTMAGEHRAPSGARQPLAPLAGGLQ

SEQ ID NO: 187039 - protein, 124 aa, Triticum aestivum
  unsure (1)..(124): unsure at all Xaa locations
  Clone ID: PAT_TA_81457.pep
IFRPPXXXRSPSAXIPXLPYLLXEWVFTRYGVXXFXRRGRMDGTIXHQVXGXNXXASEVGSTTSVPGXGXXDGVPQGPRIRHGHLEGRRRXTSSPTXTPTTKSVEGSNTDYVLPGLIXVWFLPE

SEQ ID NO: 187040 - protein, 127 aa, Triticum aestivum
  unsure (1)..(127): unsure at all Xaa locations
  Clone ID: PAT_TA_81458.pep
FGSKDRCPDMLKQVSNKILKKCGGLPLAIISIASLLANRPLVKDEWERVRRSIGFCIXDKNRSLXGMNNILSLSYNDLSPISKTCLVNLXIYPEDYVIXXNXLXRXWIQKGXSPKXXGQRSXRVPXN

SEQ ID NO: 187041 - protein, 74 aa, Triticum aestivum
  unsure (1)..(74): unsure at all Xaa locations
  Clone ID: PAT_TA_81459.pep
AATAAAAAATAAAVVATAASVVAVTPAASGGTERRGPPVIDLSTISSSSVSKLSSSSCVSQSDXPCVSVDPVVF

SEQ ID NO: 187042 - protein, 46 aa, Triticum aestivum
  unsure (1)..(46): unsure at all Xaa locations
  Clone ID: PAT_TA_81460.pep
FLFFFFFFFFFFFFFFSHXKLIXVPTHSQRFXTGSIIHPXPTLTVX

SEQ ID NO: 187043 - protein, 88 aa, Triticum aestivum
  unsure (1)..(88): unsure at all Xaa locations
  Clone ID: PAT_TA_81461.pep
QDKLSGDELLSDSFPYRELENGVLWEVDGHWVVQGAVDVDIGANPSAEGGGDDEGVDDQAVKVVXDIVDTFRLQXEQPAFDKKHLLST

SEQ ID NO: 187044 - protein, 82 aa, Triticum aestivum
  unsure (1)..(82): unsure at all Xaa locations
  Clone ID: PAT_TA_81462.pep
TDGAIQCHQXDNXSXITRRHPIQYGKYPMDDKXPEGXVCADKSXFLQYXXLHQXLQXVSXAQXKVXLVDNLXVVKTWXAKGX

SEQ ID NO: 187045 - protein, 102 aa, Triticum aestivum
  unsure (1)..(102): unsure at all Xaa locations
  Clone ID: PAT_TA_81463.pep
MKGTKLAAILILQAVLVMGVLSHVNADYFPKCCNNCRXLPGSDVCDDAHPQIAPKGCSGVPAVVSXDPKCGRLRRIMNPTVPTPGGPLARTGFGPCQHDMFP

SEQ ID NO: 187046 - protein, 104 aa, Triticum aestivum
  unsure (1)..(104): unsure at all Xaa locations
  Clone ID: PAT_TA_81464.pep
MAPGLYTDIGKKTRDLLYRDYCTHQKFTLTTCTPEGVAITAAGTRKNESIFGELQTQLKNKNLTVXISKQTQISSLTTFTVDXFATPRAEXILNLVVQDKVKGT

SEQ ID NO: 187047 - protein, 73 aa, Triticum aestivum
  unsure (1)..(73): unsure at all Xaa locations
  Clone ID: PAT_TA_81465.pep
MSDTDEHHFESKADSGASKTYPQQAGAIRKGGHIVIKARPCKVVEVSTSKTGXKHGHAKCHFVAIDIFNGKEL

SEQ ID NO: 187048 - protein, 163 aa, Triticum aestivum
  unsure (1)..(163): unsure at all Xaa locations
  Clone ID: PAT_TA_81466.pep
GVVLLTSQLSDANTNCPSGLTTVQRQEDANLYRDTFVTSLAEIPGLIVSAILVEWIGRKATMWSMLFTCCAFLXPLVLHQDELLTTALPIPVLAHVPWVLHIPSLNAPEXYPTXIRSTXFGPTTSXGKXGGLMPLXAVRMLXXCHKNLWCYPPGWLIPGKPGR

SEQ ID NO: 187049 - protein, 157 aa, Triticum aestivum
  unsure (1)..(157): unsure at all Xaa locations
  Clone ID: PAT_TA_81467.pep
RRGPSSRARIQPGFLIAVSGGPRAEDHLTWPMQRRAGRAPFLSRPRPCSSRDTATSSTRHHHPSLPYRVASRRRVGVALIXKALXTGAXRKDXQLFVPXYAXKTXGXXXGXPXALVKKKFPXPNKXXLLGTXSXXTXXLWNXGYXFXXGXRXFGIFS

SEQ ID NO: 187050 - protein, 148 aa, Triticum aestivum
  unsure (1)..(148): unsure at all Xaa locations
  Clone ID: PAT_TA_81468.pep
MAPKAEKKPVAEKAEKTTTAKKTKAEKRPPASKELXKRKGKEESKKSVETYKIYIFKXCLKXVHPGHRISSQXMSIHESLSSNDILXRTPPAIPPKLARXNKXPXITSXEISTXLXLLLPWRXRQXAXSQGTKDPQTPPQRMSPLHPC

SEQ ID NO: 187051 - protein, 78 aa, Triticum aestivum
  unsure (1)..(78): unsure at all Xaa locations
  Clone ID: PAT_TA_81469.pep
MSCCGGSCGCGSACKCGNGCGGCNMYPEVEAAGATLLVAATATHKASSGGMEMAXXDGXCGCTQCKCGTSCGCSCCSC

SEQ ID NO: 187052 - protein, 152 aa, Triticum aestivum
  unsure (1)..(152): unsure at all Xaa locations
  Clone ID: PAT_TA_81470.pep
MQIFVKTLTGKTITLEVESSDTIDNVKAKIQDKEGIPPDQQRLIFAGKQLEDGRTLADYNIQKXSTLHLVLRLRGGAKKRKKKTYTKPRSKXQAQEVNSPSQFYKSTTHRQVTSQEDAQRRLAGMATDAYAECGSLLRSVVAFTTRSRLTNL

SEQ ID NO: 187053 - protein, 139 aa, Triticum aestivum
  unsure (1)..(139): unsure at all Xaa locations
  Clone ID: PAT_TA_81471.pep
TIKDRISKYLQLRQIFKGCATRPPADFFKSHIKRSNVPSSLQQRSCCRITSATHVLLPDFSATVVFLHFLQLDFCCNFFATRGLLQEKFLXDICCKAYTPHRPLQHYICFKKHTPMQERVRQXWCXTXTGTXQGREVXX

SEQ ID NO: 187054 - protein, 125 aa, Triticum aestivum
  unsure (1)..(125): unsure at all Xaa locations
  Clone ID: PAT_TA_81472.pep
KXAQSKWSKVSLLLGAPXYPSLQRSSRSSRHPRVAVVISGVVWLLEPSSGTLXKKKYRRRRSRTQGQHQSRSLHQACRRXXEARGRPDATSSTTRDDGRGRKSARSRAYSAAPVERMHGDDGVGD

SEQ ID NO: 187055 - protein, 169 aa, Triticum aestivum
  unsure (1)..(169): unsure at all Xaa locations
  Clone ID: PAT_TA_81473.pep
MAPKAEKKPAAKKPLEEEPAAEKAEKTPAGKKPKXAEKRLPAGKSXAAARRAARRRRXPRRAWETYKIYIFKVLKQVHPXDIGISSKGMSIMNPSSNDIFEXLXGEAAXLAKYNKNPPSLPGIXTPSALLPXEXAKXAFSXGQGSQFTLLIITLGVLCLYLIHPSVKRY

SEQ ID NO: 187056 - protein, 137 aa, Triticum aestivum
  unsure (1)..(137): unsure at all Xaa locations
  Clone ID: PAT_TA_81474.pep
FLSXFXQFLGXFXQMIMLPYNXIXNXCXIXTGRXCISSLLSPKEXXRHERKDQKKYHCKVVLQFLILVHKSHPPRAKPPMRCPPVSVKPLMKIDQNFIWAAVRRGRRPSSIPRKERSPWIAGVPGGCNNGAERDWSR

SEQ ID NO: 187057 - protein, 87 aa, Triticum aestivum
  unsure (1)..(87): unsure at all Xaa locations
  Clone ID: PAT_TA_81475.pep
GFXXNXXMGXPFXYXGXXGGXXSFWSGGIXXVTXXFXHGWVASLLMIPPQLTFEXSGVVKIKQISXNWFWGVWRLHTSNSLYSLWAH

SEQ ID NO: 187058 - protein, 169 aa, Triticum aestivum
  unsure (1)..(169): unsure at all Xaa locations
  Clone ID: PAT_TA_81476.pep
NCTEDGRERRPQCWRRFSESYTPHGQPRNMGWLMWAQLFPVSGLRPNGPTLRRKIAKIHCWIRXLTAPPWVPFTNFLRCPTGYGILVSNFPGSSFPXNRRXTPFPXXCQKXFXRIPFWFFAHLNXHLWYCTXCXNXKKLXNMYLXGXREXKXLPNFVPXCPPADVTWAV

SEQ ID NO: 187059 - protein, 64 aa, Triticum aestivum
  unsure (1)..(64): unsure at all Xaa locations
  Clone ID: PAT_TA_81477.pep
PPPLXXPYPPEQVKRVSARQRSRHLRRRWGCRASNCPTSVLFLRPLRREALPILLTAPPRSSWY

SEQ ID NO: 187060 - protein, 122 aa, Triticum aestivum
  unsure (1)..(122): unsure at all Xaa locations
  Clone ID: PAT_TA_81478.pep
QLSFSPHTDSKGIMDLTEFLSPSHVILVHGEKPQMSFLKERIESELGMPCYYPANNETVSIPTTKNLKISATDKFIASCXLLLEIVHRISDLWEPTGQEPTNKKLTGGEFFMGKKDPKILQG

SEQ ID NO: 187061 - protein, 49 aa, Triticum aestivum
  unsure (1)..(49): unsure at all Xaa locations
  Clone ID: PAT_TA_81479.pep
DAKEKKGLLGKIMDKLPGYHKTGEEDKXAAAATGEHKAQRLIAARAEDR

SEQ ID NO: 187062 - protein, 51 aa, Triticum aestivum
  unsure (1)..(51): unsure at all Xaa locations
  Clone ID: PAT_TA_81480.pep
VQSAVCNYAIGERMFKAMKSSCPEKGGXFNXEGPXPNLGNSLDXFXEXNFV

SEQ ID NO: 187063 - protein, 54 aa, Triticum aestivum
  unsure (1)..(54): unsure at all Xaa locations
  Clone ID: PAT_TA_81481.pep
ITSXXLTCSAXXPAMTSCXRQTHDMQQXXLQNYPXEVXXYPSXAXXVXLEGYQP

SEQ ID NO: 187064 - protein, 86 aa, Triticum aestivum
  unsure (1)..(86): unsure at all Xaa locations
  Clone ID: PAT_TA_81482.pep
QGXFSMGYPXXRGTXLXMVQFPGGWARXXTLXFFVVEXXXPIGGXIFHXCXLQLTACPGXTVATLYLKQIDAKXFVLLRSRTLGSY

SEQ ID NO: 187065 - protein, 115 aa, Triticum aestivum
  unsure (1)..(115): unsure at all Xaa locations
  Clone ID: PAT_TA_81483.pep
RNXFXRXXFFXXPXGKFWERLXFDFXEKGLXGLAPLRXFPFCRXQHSXXDSSPLEEGSRISGKXLRXPGNYFXGTPGXFVXKRRWTLRVNVFAMXFVXGGSPPWRILGTGDATTS

SEQ ID NO: 187066 - protein, 95 aa, Triticum aestivum
  unsure (1)..(95): unsure at all Xaa locations
  Clone ID: PAT_TA_81484.pep
NXQPTAXXAAGAGXRXTARTXXELYQGXIGRRPAXGVGLXISQIXGTSLGSXLXPLLDDVARLAAGIGLPSRAGTPARPASCRRRPSCLRLSCRR

SEQ ID NO: 187067 - protein, 97 aa, Triticum aestivum
  unsure (1)..(97): unsure at all Xaa locations
  Clone ID: PAT_TA_81485.pep
KLSWDSPRGLQGKFRATXGGXXGKPKGNXVVILNXGGXGQNGQTGGXXPKVPSQXLERKGVXLVXTNVXTTLPXKGXEXFYXXGGXXGVFXXIPKRX

SEQ ID NO: 187068 - protein, 89 aa, Triticum aestivum
  unsure (1)..(89): unsure at all Xaa locations
  Clone ID: PAT_TA_81486.pep
XLGGXPPXXVXIPLVQIXNLKPXKSFNSPXXHHXXQGPNGPCPGITSAFMCLLVAILTHXELRHPDSPHTSSIGNSKSKVEENMCSLLH

SEQ ID NO: 187069 - protein, 113 aa, Triticum aestivum
  unsure (1)..(113): unsure at all Xaa locations
  Clone ID: PAT_TA_81487.pep
MVKAVAVLTGSEGVKGTIFFTQEGDGPTTVTGSVTGLKEGLHGFHVHALGDTTNGCMSTGTTLQPCWSCAMGHQEDXXRHAGDXGNVTAGXXGVAKSMLTDCPGQINWRLLPR

SEQ ID NO: 187070 - protein, 94 aa, Triticum aestivum
  unsure (1)..(94): unsure at all Xaa locations
  Clone ID: PAT_TA_81488.pep
NPLHPQQSIHPPHPHPPFPSPPRRXXSPSSAMAXASSGXGIHDXCXLRFVELXSXRXXXFIXYXLEMXXEVIVDXXGEXEATXEDFXXTXXRTL

SEQ ID NO: 187071 - protein, 100 aa, Triticum aestivum
  unsure (1)..(100): unsure at all Xaa locations
  Clone ID: PAT_TA_81489.pep
VXLMFFVXNGVXSFYXSIXXFXSGXFLHXQVVLLLXFXHRWNXNXVAKXXQFWYMALLAXTVVXXXGSFAFSGQXFHRFILXXQDCXLXXFFSVXXXNRV

SEQ ID NO: 187072 - protein, 100 aa, Triticum aestivum
  unsure (1)..(100): unsure at all Xaa locations
  Clone ID: PAT_TA_81490.pep
FGEWSGPLXXXVTLXPXENLXPPDXCHXXSGWLXSNLGFLSPSLDCHCLVKRRXENXWWEEEAIXCKDXFLLGLRXXLXLVXXXCLXILFXLLDGLIRDE

SEQ ID NO: 187073 - protein, 73 aa, Triticum aestivum
  Clone ID: PAT_TA_81491.pep
NQPCSGRQCSCCNPGLCLINRACVFKYCVHPQFPFCICVICAHWRVSGSAPVNLYLYLCCLGNTRWVSDQKKK

SEQ ID NO: 187074 - protein, 112 aa, Triticum aestivum
  unsure (1)..(112): unsure at all Xaa locations
  Clone ID: PAT_TA_81492.pep
SDVAKLLCGXXKQLSTSNNNVAACGICKIXLWXISFQLXICKQXXRTRVXXMGDLLIXLLGIXHGTMFGXRXXXLXEKENTNDHMGXQXPDQIVSXEWXXRIXFSTEXTXQN

SEQ ID NO: 187075 - protein, 65 aa, Triticum aestivum
  unsure (1)..(65): unsure at all Xaa locations
  Clone ID: PAT_TA_81493.pep
HTHISIRPSTHLCSYAYIPSQMPMALTSDTAPGALVLPDXHSXIYLDIRSRGIISPGDPELVKKK

SEQ ID NO: 187076 - protein, 210 aa, Triticum aestivum
  unsure (1)..(210): unsure at all Xaa locations
  Clone ID: PAT_TA_81494.pep
XYGTDXITPCLLDLYLWIFXVXXATXVILRFLXMRXMSPCANDWTXCIFTFCHSAVNYSXTSTHHQIFKGYPSSVFXGTKLKNKFQRRSNPPQNEVQRXQGGQYYRMVESLREEGDLNVFWRRSVLDGAQMMGGDPFLLVGALPCGRRVVRVRWKKVAVQGEEGRGGRGRSSWRQGEGLSAGIPSGSFRGHPWHDDKASGGVLHQRPFPH

SEQ ID NO: 187077 - protein, 151 aa, Triticum aestivum
  unsure (1)..(151): unsure at all Xaa locations
  Clone ID: PAT_TA_81495.pep
NLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNNLVSWQXYAQVLDCTLQLLSC

SEQ ID NO: 187078 - protein, 155 aa, Triticum aestivum
  unsure (1)..(155): unsure at all Xaa locations
  Clone ID: PAT_TA_81496.pep
DPXXXPPTKVGLSFHLEISXAYXSNPSKRDDAKHHLCHVCHSCQTLGFPLGXXDRVLESTTIEVNHMLSPPLFXDPSSCSPLYLVLCVKSLSIDCILSLDETTRSEESNPREDLSMAIAIRNEATADRSDHHMDQHRRQSTSPMSAFWPKRALSR

SEQ ID NO: 187079 - protein, 42 aa, Triticum aestivum
  Clone ID: PAT_TA_81497.pep
MTFKRRNGGRNKHGRGHVKYIRCSCRRWCCPWSSCSPCGALI

SEQ ID NO: 187080 - protein, 90 aa, Triticum aestivum
  unsure (1)..(90): unsure at all Xaa locations
  Clone ID: PAT_TA_81498.pep
SQSPHIPIHFFNPHFFFQIAISKDRERPGKRSHLDCSRPAPSIDFPXLKFXVGXIVSRGYXLFFKGGQGRLIVXLFFXKACCLDPXGSXH

SEQ ID NO: 187081 - protein, 115 aa, Triticum aestivum
  Clone ID: PAT_TA_81499.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGIRRLSSGEANPTRTC

SEQ ID NO: 187082 - protein, 86 aa, Triticum aestivum
  unsure (1)..(86): unsure at all Xaa locations
  Clone ID: PAT_TA_81500.pep
APVSXTPPPLKMWGXXRKAGXDXCKXLQPHRDVLDXQNVVPLAXIGTRTSTXGSRHXFRXKGQIXVNQXIRTVNXPXTGNGSXRXK

SEQ ID NO: 187083 - protein, 62 aa, Triticum aestivum
  Clone ID: PAT_TA_81501.pep
DDLSYQMDCHAVECESKLEAKKLAHAMMEAFKKTFHSMKSDGRIHRNSSSEEVSHGFESDDG

SEQ ID NO: 187084 - protein, 125 aa, Triticum aestivum
  unsure (1)..(125): unsure at all Xaa locations
  Clone ID: PAT_TA_81502.pep
VXYLGVSYWLKPAGVFHSGXQDXHTKSRYNTLQGVLFLTGSHSLSLKYRKVLNFTTNILLLNTSNAHFFAVTSRERICMFSICMFTKSYENVFLSHKCRQLFTPILWLPVFPLYVVKDVFLTFYW

SEQ ID NO: 187085 - protein, 75 aa, Triticum aestivum
  Clone ID: PAT_TA_81503.pep
LVPNGYGWPKHRGGPMFYASIVGLPNILTKLQKYSEIHPDVPQLRPSAFLKKLVAMGNPPLNDWMSYLHRQSNKL

SEQ ID NO: 187086 - protein, 147 aa, Triticum aestivum
  unsure (1)..(147): unsure at all Xaa locations
  Clone ID: PAT_TA_81504.pep
MRGVLVTLAVLFLTGTQARSFWQHDEPQTPLDRIRDMVDVYLETVKASGKDAIAQFESSAVGKQLDLKLADNLDTLXAAXAXLXXDMAPYYXEVREMWLKDTXALRAEXTXDLEEVKENIXPSWTVLXHWTXELXXYAAAKDGQATS

SEQ ID NO: 187087 - protein, 164 aa, Triticum aestivum
  unsure (1)..(164): unsure at all Xaa locations
  Clone ID: PAT_TA_81505.pep
RPTESNPFPRXXCLXKREQVKCIWLXPYTEIYIKKLQSRRYPKGEGEEGXETKNQERVRAGSKGPGWAGGSCTEVFLHGSHVVGSLEVLTPGERRQPSRKWLAPAQGTARLLVGKKKICCRLLGWFFSCVFVCDFVGFSFKLFVCFFGVFCFLKEKYSEDTKQT

SEQ ID NO: 187088 - protein, 190 aa, Triticum aestivum
  unsure (1)..(190): unsure at all Xaa locations
  Clone ID: PAT_TA_81506.pep
VQWDFCDVSPCSGTDEERQEQEDEMFKTCGQPESQRGLRRIYGGTKTTAGKHPWMVSLQRKSSRRVTHFCGGVLIKSCWVLTAAHCVEHGARKSPSGPGKAKLKRREHQEQIFDVEKSSCITRYRLGDDDVHXDIXLLKLKPIDGXCAIEXKFVKTAFANLNPVGLAHSGWANKVHSLNVQCNYSKHHHV

SEQ ID NO: 187089 - protein, 156 aa, Triticum aestivum
  unsure (1)..(156): unsure at all Xaa locations
  Clone ID: PAT_TA_81507.pep
GDKATAGAVSCHEQEPSGKTLSSEEEGEGEEESCDITWKKSQKLANGLMRFSTDLLREVQQESNGNNVILSPLSIALALSNLALGAANQTEKRLLEAMHLESVPCLHHMLSSLRXXLAXATLSLASRVYLQKGYXVKEDSXRSRRNSWGKPVTLLG

SEQ ID NO: 187090 - protein, 160 aa, Triticum aestivum
  unsure (1)..(160): unsure at all Xaa locations
  Clone ID: PAT_TA_81508.pep
MSFTGKYELQSHENFEPFMKALGLPDDQIQKGKDIKSISEIVQNGNKFKITVTTGSKVMTNEFTIGEECEMELLTGEKAKCIVNMEGNNKLVANLKGLKSVTELNGDTITHTMXXGRLTYKRITRDLETCMHLSFTCKMFNKVNLYKTSHNKLLRCIKKK

SEQ ID NO: 187091 - protein, 164 aa, Triticum aestivum
  unsure (1)..(164): unsure at all Xaa locations
  Clone ID: PAT_TA_81509.pep
VSCVLGCPYEGNISAAKVAEVSKKMYSMGCYEISLGDTIGIGTPGSMKEMLAAVMKEVPVGALAVHCHDTYGQALANILVALQMGVSVVDASVAGLGGCPYAQGASGNVATEDLVYMLNGXGIHTGVDLQXLMDTGTLXQCSEQKNNSKVSKPHAAVITEGGCS

SEQ ID NO: 187092 - protein, 138 aa, Triticum aestivum
  Clone ID: PAT_TA_81510.pep
WGENVCNHVEDASVECSETDISEIGPVRLVDGPNQCAGRVEVFHENRWGSVCDDNWDMKDAKVVCKQVGCGSPLSALGSARYGRGPDVIWLDDVNCEGTEESIFDCKARPWGEHNCYHGEDASVFCTVNKNLEETETS

SEQ ID NO: 187093 - protein, 166 aa, Triticum aestivum
  unsure (1)..(166): unsure at all Xaa locations
  Clone ID: PAT_TA_81511.pep
DVFSAIMELNYLGTISLTKHVLNHMIERRRGKIVTVSSVMGIMGAPLASGYCASKHALQGFFNSLRTELTDYPEISIINICPGPVQSKIIQNVFTEKLDKSIENSGDQSHKMPTERCVRLTLVSXSNDLKEXWXSDNPTWQSATLAVAPTGVADNKMARGESDFRD

SEQ ID NO: 187094 - protein, 80 aa, Triticum aestivum
  Clone ID: PAT_TA_81512.pep
HHTLSIIEYQKTKLAREQTCINVGRKKKGHRLSTVGHLGPSGNFHLGWKKLHLFFELVSWVTVPSFLTSSQFSEIAGICL

SEQ ID NO: 187095 - protein, 99 aa, Triticum aestivum
  unsure (1)..(99): unsure at all Xaa locations
  Clone ID: PAT_TA_81513.pep
GLKSYEQSKGSTLFHLQYNTACAGLLGIWRNRSSVIFEHSLXSSFGFLASTQSTLEENGMFQNNFQFSKWQXSKXNVIXGQMERMEPNFSPWKXXKSXP

SEQ ID NO: 187096 - protein, 156 aa, Triticum aestivum
  unsure (1)..(156): unsure at all Xaa locations
  Clone ID: PAT_TA_81514.pep
PVCGSDSFTYDNECGICAYNAEHHTNISKLHDGECKLEIGSVDCSKYPSTVSKDGRTLVACPRILSPVCGTDGFTYDNECGICAHNAEQRTHVSKKHDGKCRQEIPEIDCDQYPTRKPLGGXKLLVRCPRILLPVCXKTVYLXNEXXICANNANMD

SEQ ID NO: 187097 - protein, 52 aa, Triticum aestivum
  unsure (1)..(52): unsure at all Xaa locations
  Clone ID: PAT_TA_81515.pep
KGDLKGNXFVHCEMNXIXHDSQGPTCIKKELVKKKKKPLFVSFXEANLLRCQ

SEQ ID NO: 187098 - protein, 80 aa, Triticum aestivum
  Clone ID: PAT_TA_81516.pep
LNVSQFPKHWLFPEPKFTLISKMQSIKLERLPCFNYLNMARNRAKSNKKFDPINQNTLNPLGQVSGIISYKIAHFCTDQL

SEQ ID NO: 187099 - protein, 76 aa, Triticum aestivum
  unsure (1)..(76): unsure at all Xaa locations
  Clone ID: PAT_TA_81517.pep
KCHVSNCPISGNTAAXSRHFXQPVCXAITIQDKHKTSVLSLETGDTPANTRXNXNTYRKXVRXLSDIHNIKGELTV

SEQ ID NO: 187100 - protein, 77 aa, Triticum aestivum
  unsure (1)..(77): unsure at all Xaa locations
  Clone ID: PAT_TA_81518.pep
IGSELFRYICIKLLLPAVXHSVEELLVFGSIWLIQAFSIAVMRAAPKVMLPNLLCWPVMSEADGGMAVEVEPSLQYS

SEQ ID NO: 187101 - protein, 140 aa, Triticum aestivum
  unsure (1)..(140): unsure at all Xaa locations
  Clone ID: PAT_TA_81519.pep
AGITIIHLTFLHESGSNNPLGISSDSDXIPFHPYYSFKDILGLTLILTPFLTLALFSPNLLGDPEXFTPANPLVTPPHIKPEXYFLFAYAILRSIPNXLGGVLALAASVXILFLIXFLXNSXQXSITFRXXSQTLFXLLV

SEQ ID NO: 187102 - protein, 102 aa, Triticum aestivum
  Clone ID: PAT_TA_81520.pep
VKFAELVTKIDRRSGKELEALPKFLKNGDAGIVKMIPTKPMVVETFATYPPLGRFAVRDMRQTVAVGVIKGRWRRRTPPGAKVTKGCHQRRMMLLPNYPTKF

SEQ ID NO: 187103 - protein, 91 aa, Triticum aestivum
  unsure (1)..(91): unsure at all Xaa locations
  Clone ID: PAT_TA_81521.pep
YAEAGHPMPLRDQLKQLVELHKAAEQAMKGLIVRLWPKEAMLGSYFGLVRRLVDACPWVEVIKHSACIXGWVSGPLPAQRCTGAKWMPKNL

SEQ ID NO: 187104 - protein, 75 aa, Triticum aestivum; identical to SEQ ID NO: 106874
  Clone ID: PAT_TA_81522.pep

SEQ ID NO: 187105 - protein, 62 aa, Triticum aestivum
  unsure (1)..(62): unsure at all Xaa locations
  Clone ID: PAT_TA_81523.pep
XKRFATKLADEQDSVTGLYRATREAMGAIIRKRMSHXRDQLVGLQACSILGFVSQYWSNRCL

SEQ ID NO: 187106 - protein, 124 aa, Triticum aestivum
  unsure (1)..(124): unsure at all Xaa locations
  Clone ID: PAT_TA_81524.pep
FRXXRVIXGMLXRKXFLRHVXIKVEKEEXDGLYXTXLPXNLXGXHGARDPXSGADCRHIYLSVFRTXPYCYLPLEFASLLCVVSPFTPTLDRSSTGCHTTRLLGTDCRCPLIWVVRSSIFLYNL

SEQ ID NO: 187107 - protein, 145 aa, Triticum aestivum
  unsure (1)..(145): unsure at all Xaa locations
  Clone ID: PAT_TA_81525.pep
AIKFNGGGHVNHSIFWKNLKPISEGGGEAPHGKLGWAIDEDFGSIEKLIKKMNAEGAALQGSXXWVWLALXDKEAKRLSVXXTTPNQDPXLVDXRVKTXIPLLGIDVWEHAYYLXYKNXRPXXLTNXWKXVNWKYXGXEYXKVLA

SEQ ID NO: 187108 - protein, 56 aa, Triticum aestivum
  unsure (1)..(56): unsure at all Xaa locations
  Clone ID: PAT_TA_81526.pep
HKHKQLDRTSFAARPAPXQMAMAPRALLLLAVGLMVXAXGXXXGXNGXCXRDGXKV

SEQ ID NO: 187109 - protein, 70 aa, Triticum aestivum
  unsure (1)..(70): unsure at all Xaa locations
  Clone ID: PAT_TA_81527.pep
WXKPXXXDAXXSSXCXXXXMCVFNAVVXXVCVXXALMISLXSCHXPQCSASHPSSCSXAHFRXPCTLNFD

SEQ ID NO: 187110 - protein, 172 aa, Triticum aestivum
  unsure (1)..(172): unsure at all Xaa locations
  Clone ID: PAT_TA_81528.pep
HGIQPDGQMPGDKTVGGGDDAFNTFFSETGAGKHVPRAVFVDLEPTVIDEVRTGXTYRQLFHPEQLISGKEDAANNFARGHYTIGKEIVDLCLDRIXKLAXNCTGPXGFLVFNAVGGGTGSXGLGXLPLERSPFDYGXNPTWFVSNPVSLTGLSPTPTMRPLKWALLRLMPT

SEQ ID NO: 187111 - protein, 171 aa, Triticum aestivum
  unsure (1)..(171): unsure at all Xaa locations
  Clone ID: PAT_TA_81529.pep
SYHIVDPSPXPIFGAAAALLTTSGLIIWFHYSSTTLLTIGLLSILLVMLQXXQDVVRESTFQGHHTPTVQKGLRYGIILFITSEAFFFLGFFXAFFHSSLAPTPELGGQWPPTGVKPLNPLEVPXTKYSILLTSGVTLXGSHRSQKETETSNQALSNLQDHSPTALIMSSS

SEQ ID NO: 187112 - protein, 88 aa, Triticum aestivum
  unsure (1)..(88): unsure at all Xaa locations
  Clone ID: PAT_TA_81530.pep
MSEAAFQKAAEEVKQLKSQPTDQEMLDVYSHYKQATVGDVNTDRPGMLDFKGKAKWDAWNALKGMSKEDAMKAYVXAKVEELKGKYGI

SEQ ID NO: 187113 - protein, 61 aa, Triticum aestivum
  Clone ID: PAT_TA_81531.pep
CVRELYSIRQPSHVEVTNMGNYLMLSFVHWLAKAVAFLIDQSMRRSHFFDPLQKSYIFSRS

SEQ ID NO: 187114 - protein, 136 aa, Triticum aestivum
  unsure (1)..(136): unsure at all Xaa locations
  Clone ID: PAT_TA_81532.pep
VGVVCLGPHCSTAGVVPVAGCTSVGVAAGDKCSWSGSPLKFGIEAEVSSSSSAVRLPCQNDYVXRWGCVVWVRRVMPCSVVCNMLGGAPLFSLCTXRRPAVQLTTQSIVCQCIRSTASPSHVTQXPXLAVAKTPNF

SEQ ID NO: 187115 - protein, 126 aa, Triticum aestivum
  unsure (1)..(126): unsure at all Xaa locations
  Clone ID: PAT_TA_81533.pep
KSFVDRIFGGELTSTIMCEECRTVSLVHESFLDLSLPVLDDQKIKNTNERNVKKIKGRESEEEEEDKNNDYYIKQRDEPPGTSKHLQKKAKKQAKXQAKSQRRQQKLQGKVLQLTDICATEDQKML

SEQ ID NO: 187116 - protein, 193 aa, Triticum aestivum
  unsure (1)..(193): unsure at all Xaa locations
  Clone ID: PAT_TA_81534.pep
GPLRLVGGPNRCAGRVEVLHEEQWGSVCHDEWDINDAQVVCKQLGCGDAVLAPIAAKFGRGTDTIWLDDVNCTGSEASLSECQARPWGDHNCYHGEDAXSAICSXRGXSISTSVXRLVGGPNRCSGXXKVLHNNVWGTVCXDNWXLRKLKWCQQLGCGKPYPAGSNMGRKGKLLTILTGQRSHFNKWESNMNH

SEQ ID NO: 187117 - protein, 151 aa, Triticum aestivum
  unsure (1)..(151): unsure at all Xaa locations
  Clone ID: PAT_TA_81535.pep
HTVPIYEGYALPHAILRLDLAGRDLTDHLMKILTERGYSFTTTAEREIVRDVKEKLSYIALDYDQEMETSKTSSSVEKSYELPDGQVITIGSERFRCPEVSSNHPSLGMXEAAXIHETTYNSIMXCDVDIXKXLYGTLSLMGGHYVPWTDR

SEQ ID NO: 187118 - protein, 98 aa, Triticum aestivum
  unsure (1)..(98): unsure at all Xaa locations
  Clone ID: PAT_TA_81536.pep
MASIAGSAVSFAKPVKAINTNSLSFSGARRGNAFLRLQPVPMRFAVCCSAXXDTXVEKVCEIVXKQLLFLXGTGSLRYTNFPDLGADPLDTXXIVMGL

SEQ ID NO: 187119 - protein, 85 aa, Triticum aestivum
  unsure (1)..(85): unsure at all Xaa locations
  Clone ID: PAT_TA_81537.pep
LLVXPXNTNESKRFNCXIXLDCXGLXXENYWSXIRLKKLNPLXXXGFXYKXXIXXEGDCVFCTXKFIQVFARKPLYFXALAMWVK

SEQ ID NO: 187120 - protein, 172 aa, Triticum aestivum
  unsure (1)..(172): unsure at all Xaa locations
  Clone ID: PAT_TA_81538.pep
ERISDMTNGDVAANSYHLYEEDVKALKDMGMKVYRFSISWSRILPDGTGKVNQAGIEYYNKLINSLIDNDIVPYVTIWHWGHPSKHWEDKYGGFLXRQIVDDYKHSAEVCFKXFGDRVKELVTFNDHIHIGCSXYGEGSXPWEGSPGDXXPSQXEXLKRPYXAGHKSPTQAR

SEQ ID NO: 187121 - protein, 100 aa, Triticum aestivum
  unsure (1)..(100): unsure at all Xaa locations
  Clone ID: PAT_TA_81539.pep
HXXQAXXFSIRXXXGKXRVSFDDLRKNIVRRTXLCLFLYXGSLWLARLMXILSKLHSLXVDTIFRLXVWFXNALXXNLHYDSXRHCYNXXXTPPXIXXNA

SEQ ID NO: 187122 - protein, 126 aa, Triticum aestivum
  unsure (1)..(126): unsure at all Xaa locations
  Clone ID: PAT_TA_81540.pep
MLVYQDKLSGDELLSDSFPYRELENGVLWEVDGHWVVQGAXDVDIGANPSAEGGGDDEGVDDQAVNVVDIVDTFRLQEQPAFDKKXFIXHMXRYIKNLSAKLXXDDLXLSIXMFSXATXYLLSSRT

SEQ ID NO: 187123 - protein, 71 aa, Triticum aestivum
  unsure (1)..(71): unsure at all Xaa locations
  Clone ID: PAT_TA_81541.pep
HCFHTCPLYGKKQYRYQLKSEKTVXFLNVSNGTTCLNDVQREILNMHILEKVITEVITVKVGTINHPLIAT

SEQ ID NO: 187124 - protein, 61 aa, Triticum aestivum
  unsure (1)..(61): unsure at all Xaa locations
  Clone ID: PAT_TA_81542.pep
KRYTPVWVSLSLSFVCKILCLISLCLAQLYTVLLHKLIVYQDPGYINAXXMTEFXTXTWNK

SEQ ID NO: 187125 - protein, 154 aa, Triticum aestivum
  unsure (1)..(154): unsure at all Xaa locations
  Clone ID: PAT_TA_81543.pep
QNCKIIYVARNAKDNLVSYYHFHRMNKVLPDPGTIEEFTEKFMNGEVLWGSWYDHVKGWWKAKDKHRILYLFYEDMKENPKREIQKIMKFLEKDLDEEVLNKIIYNTSFEIMKDXPMTNYTKXFVGVMGHSVXPIMRKDRXGLEELFXVALNKN

SEQ ID NO: 187126 - protein, 192 aa, Triticum aestivum
  unsure (1)..(192): unsure at all Xaa locations
  Clone ID: PAT_TA_81544.pep
STNHKDIGTLYLIFGTWAGIAGTALSLLIRAELGQPGTLLGDDQIYNVIXVTAHAFRHNFXLIVIPIMIGGFRKXLIPLYXSGAXDIAFPXRINNIXFLTLPPSFXLLPTTSSYRLXXGAGKRWXXYPLLXXPTXAXAXINLHXFINLQSSIPRHFTHTHITPSNQNHLVAHTHHISLRHGSTATNHTSNIV

SEQ ID NO: 187127 - protein, 67 aa, Triticum aestivum
  Clone ID: PAT_TA_81545.pep
NSHNLLKITSFFFLLIFRALCIFFFMHFSSLQFILAAALCKVDEDEWTKSSVRAKLAFLHFKQLEIV

SEQ ID NO: 187128 - protein, 78 aa, Triticum aestivum
  Clone ID: PAT_TA_81546.pep
TDKHFYFNKTKGFPCLKKAEGSSKPHCLGKTKGRTHPDIDQEVVQRLRDFYRPFNMKFYQMTGQDFGWGLKAGVGNPL

SEQ ID NO: 187129 - protein, 131 aa, Triticum aestivum
  unsure (1)..(131): unsure at all Xaa locations
  Clone ID: PAT_TA_81547.pep
DVITMTRFVMEEGRRAKGTGEFTQLLNSLCTAVKAISTAVRKAGIANLYGIAGSTNVTGDQVKKLDILSNDLVINMLKSSFSTCVIVSEENKDAVIVEADRRGKYIVCIDPPGWXSNIDCPVSNWDIFGIL

SEQ ID NO: 187130 - protein, 92 aa, Triticum aestivum
  unsure (1)..(92): unsure at all Xaa locations
  Clone ID: PAT_TA_81548.pep
TFCXGGSXSIXNYRCSQRKLRIQDLLYFXEPRKEGTVLELHSTADAFHLLVINSYISPQDPYLTQNYFLALHGCTISSLLFPSHQCCVTYQC

SEQ ID NO: 187131 - protein, 153 aa, Triticum aestivum
  unsure (1)..(153): unsure at all Xaa locations
  Clone ID: PAT_TA_81549.pep
MAVLGYWDIRGLAHAIRLLLEHTGTPYEDKLYSCGEAPDYDKSQWINEKEKLGLDFPNLPYFIDGDVKLTQSNAILRYIARKHNMCGDTEEERQRVDVLXENQVMDXRMSLXMVCYSPDFEXEPGYLEQLPGKLRSSRXFLGDRKWLQGELTS

SEQ ID NO: 187132 - protein, 119 aa, Triticum aestivum
  Clone ID: PAT_TA_81550.pep
SPEAKMPFGSCLLWRMLFFVSLAGFLSDLSETGAFASESDCDSTTVDNVIQSLQKYSTCFPEVAKKDGRDLLNRLIWILKDTLNLLQPVQDKFCKHLPQCPQPIAPKNGWDSVHHYWEH

SEQ ID NO: 187133 - protein, 179 aa, Triticum aestivum
  unsure (1)..(179): unsure at all Xaa locations
  Clone ID: PAT_TA_81551.pep
HYFLXSSIXPSSSTFLHLYILYISYTLFSVSVRNVNSKRKGXGKKKGRKEKAAXTXIYGIVHLAEAMGFGIGNSXVCKCACVGLSXRSSAXLPGLGRDRVVGTGNRNCKVEDTGFFNIPKNYCSINTPPPPPRKQRRGSDGGSSVSEGNLSKITQPGRLWGPLPQLSVLPQIMTRVIYT

SEQ ID NO: 187134 - protein, 134 aa, Triticum aestivum
  unsure (1)..(134): unsure at all Xaa locations
  Clone ID: PAT_TA_81552.pep
ENTGGKNKADWAKNLQMDDFELLCTDGRRANVMDYRECNLAEVPTHAVVVRPEKANKIRDLLERQEKRFGVNGSEKSXFMMFDLKTKXLLFKDLTKCLFKSREGTTYKDSLGDXFIPXDSNLKTCNPSDTSFTP

SEQ ID NO: 187135 - protein, 58 aa, Triticum aestivum
  Clone ID: PAT_TA_81553.pep
KLYSILITELQIKAIRSLLFSADATSLSTIARTVLLTIETQKSRDTVNRRKFKTLDNM

SEQ ID NO: 187136 - protein, 150 aa, Triticum aestivum
  unsure (1)..(150): unsure at all Xaa locations
  Clone ID: PAT_TA_81554.pep
LLGAASVVLLVCVACLLSIVQWRKRTGKGKMPEGPTPLPIVGNILEVKPKNLAKTLEKLAEKYGPVFSVQLGSTPVVVLSGYEAVKEXLIDRADXFAAXGHMPIXGDRANKGLSIXFNNNXGWLHVRRLLSHLALDGEKGFRGSRGTDTA

SEQ ID NO: 187137 - protein, 87 aa, Triticum aestivum
  Clone ID: PAT_TA_81555.pep
HAQMQFSTFDRDQDHWEESCAEVYGGGWWYNSCQAANLNGIYYPGGHYDPRYNVPYEIENGVVWIPFRASDYSLKVVRMKIRPLETL

SEQ ID NO: 187138 - protein, 101 aa, Triticum aestivum
  unsure (1)..(101): unsure at all Xaa locations
  Clone ID: PAT_TA_81556.pep
KTGNWSTKPSCKEPCKIPVKKAVVLYEGEKKRVQSDLKEGIMHGETISFYCKNKEKSCAYTVPVQCVNGNLTLPFCFKERGFFSXLVKXDPSDMKPCEDLK

SEQ ID NO: 187139 - protein, 133 aa, Triticum aestivum
  unsure (1)..(133): unsure at all Xaa locations
  Clone ID: PAT_TA_81557.pep
MVKSSLQRILNSHCFAREKEGNKSTIMPAVLSLSTGQSSSRVPFNCCSNLGPGPRWXCPDVPHPPLKXIQGGRGEYQRDHNLSXANLFYPDNPAECXTEELTSNXRTRILNXQSRLTDXKHISWRHADNNNSI

SEQ ID NO: 187140 - protein, 80 aa, Triticum aestivum
  Clone ID: PAT_TA_81558.pep
MIPSPVACHTESMLDKKQLYLQFGPHAAILTEKESSVSNLLLKKFRASSFTAYSARCLCKAAMLLVVIRDESLYETNTET

SEQ ID NO: 187141 - protein, 164 aa, Triticum aestivum
  unsure (1)..(164): unsure at all Xaa locations
  Clone ID: PAT_TA_81559.pep
FGINRRTEAIELIKKGYTQQLAYRKEDGSFAAFTTRPSSTWLTAYVAKVFAMAINMVDIKPEVVCGAIKWLILEKQQPDGLFQEDAPVIHKEMVGGYHGAEPXVSLTAFVLSALQESQKICKNYVKXWMGHCKASDYSPXEIQSLTRPTGLTPPGLTGNQQREI

SEQ ID NO: 187142 - protein, 121 aa, Triticum aestivum
  unsure (1)..(121): unsure at all Xaa locations
  Clone ID: PAT_TA_81560.pep
MLLLISVLFGTQALCSWAASPPARELPSVLLSPTCHDAAVEEAADLALRQINADRTEGYILSLYRIFSVREHPQEXLGSVFYLILGXVXDTECHVXSKQLWENCTVRXLIQLLWQCKQLST

SEQ ID NO: 187143 - protein, 88 aa, Triticum aestivum
  unsure (1)..(88): unsure at all Xaa locations
  Clone ID: PAT_TA_81561.pep
RERERDIFTIREVSFQPTGESDWKDTNYTLNTDSLDWALYDHLMDFLADRGVDNTFADELIELSTALXEHQEYIKFLXEDLKSFVKCQ

SEQ ID NO: 187144 - protein, 72 aa, Triticum aestivum
  unsure (1)..(72): unsure at all Xaa locations
  Clone ID: PAT_TA_81562.pep
SITGSCLGXDGTPWCTVSSQKKXMPTGALTTGCGXLIVXXIIXXVAFTXYSQKQRXNNXGKIXIREEXXDXE

SEQ ID NO: 187145 - protein, 94 aa, Triticum aestivum
  unsure (1)..(94): unsure at all Xaa locations
  Clone ID: PAT_TA_81563.pep
NKLGGVLALAASVLILFLIPFLHKSKQRTITFRPLSQTLFXLLVANLLILTXIGSQPVEHPFIIIGQIASLSYFTILLILFPTIGTLENKILNY

SEQ ID NO: 187146 - protein, 125 aa, Triticum aestivum
  unsure (1)..(125): unsure at all Xaa locations
  Clone ID: PAT_TA_81564.pep
LVPLEASNRLVLQRAALHELPGQYGVKTHGQGCALVQVTLRYNIPPPPSAGTFNLHVETEPKTCTSDASTHFRLLLRAQYXGKRAATNMVVIXAKMPSGYIPRQDSVVELKRQKLGEEVEVQSDK

SEQ ID NO: 187147 - protein, 134 aa, Triticum aestivum
  unsure (1)..(134): unsure at all Xaa locations
  Clone ID: PAT_TA_81565.pep
MPAGHGLRSRTRDXFARXFRKXGYIPLTTYLRTYKVGXHVDVKVNXAVHKGMPHKFYHGRTXRXCNVTKRXIXVXXNKXVXXRXIXXRXHVRXEXXNHPRXNXDXSKRKLNXXNLXXVPRQVQEGAGVMHTSNK

SEQ ID NO: 187148 - protein, 125 aa, Triticum aestivum
  unsure (1)..(125): unsure at all Xaa locations
  Clone ID: PAT_TA_81566.pep
RLFDAIVSGCIPVIISDELELPFEGILDYSKIALFVSSTDAVQPGWLVKYLRGIDAKRVRDMQSNLLKYSRHFLYSSPAQPLGPXDLTWRMIAGQAGGTSSCIFSGHGVWSENQEAYHVSVNPGH

SEQ ID NO: 187149 - protein, 43 aa, Triticum aestivum
  Clone ID: PAT_TA_81567.pep
ARGGYGGQRGGGGYGGGGGGYGGGGGGYGGQRGGGDSGGQWRN

SEQ ID NO: 187150 - protein, 127 aa, Triticum aestivum
  unsure (1)..(127): unsure at all Xaa locations
  Clone ID: PAT_TA_81568.pep
LSLDRSIGIGRLCISSPTVRRFSFSPHRDKQGIVTCQELLVQDVPCLERLILHDSHIGPATIRITGAPKLGAIGVVVSRHIYTQSLETQFSRKTIDVSLTXIMHKVKIWVVDSIGPIXDQLLANQLF

SEQ ID NO: 187151 - protein, 104 aa, Triticum aestivum
  unsure (1)..(104): unsure at all Xaa locations
  Clone ID: PAT_TA_81569.pep
VSGXRQVEDGCXRRSLXAVWTLXCRRRCMNGKWRXGESQTLVRASLEMGKVTNLSPIKISDITSVGDRTVISHXTNICRXLFRVRRGCFAXHGWRPQCMNGADR

SEQ ID NO: 187152 - protein, 91 aa, Triticum aestivum
  Clone ID: PAT_TA_81570.pep
SGNCCLHSDHLKRQETPTTEYYLEAMLTWLPLLARPKETQEGLIYSQDQESGPNETLIDARPRSCRDGIVRVSSLGRRRVVVVVVVGPEAA

SEQ ID NO: 187153 - protein, 56 aa, Triticum aestivum
  Clone ID: PAT_TA_81571.pep
PEEVVRVVPACGHFFHAACDADRWIRARRTCPLCRGALWPRPPTRAAAAAVVVVVA

SEQ ID NO: 187154 - protein, 127 aa, Triticum aestivum
  unsure (1)..(127): unsure at all Xaa locations
  Clone ID: PAT_TA_81572.pep
QRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLXGGCKSLSRPHWQDITWS

SEQ ID NO: 187155 - protein, 94 aa, Triticum aestivum
  unsure (1)..(94): unsure at all Xaa locations
  Clone ID: PAT_TA_81573.pep
XGGGXXYGGXXXGYXGGRSGGGGGYGXREGGGXYXSGGXGYGGSXGXSGGGNWXXMVGPLASYPSIRFYSTKNVISRSLSIHLSPTFDAVTSAV

SEQ ID NO: 187156 - protein, 163 aa, Triticum aestivum
  unsure (1)..(163): unsure at all Xaa locations
  Clone ID: PAT_TA_81574.pep
GFGPVYLGRLEDGQEVXVKRLSKKSSQGVEEFKNEVRLIAKLQHXNLVRLLGCCIDDDXRLLVYXFMRNNSLXTFIFDDXXRKLLXWSKRFEIILGIXRGLLYLHXDXRVXIIHXDIXAINXLLDRNMAPXYPTSDREMFXGXHTXRTPGMGYCPHRSPSIHI

SEQ ID NO: 187157 - protein, 64 aa, Triticum aestivum
  Clone ID: PAT_TA_81575.pep
GSDCKCGKMYPDLTEQGSAAAQVAAVVVLGVAPENKAGQFEVAAGQSGEGCSCGDNCKCNPCNC

SEQ ID NO: 187158 - protein, 47 aa, Triticum aestivum
  Clone ID: PAT_TA_81576.pep
NIVKEGCGVEGLCVCSDDSHCAPEQGYFCRPGKVHDEARVCSTSVNP

SEQ ID NO: 187159 - protein, 90 aa, Triticum aestivum
  unsure (1)..(90): unsure at all Xaa locations
  Clone ID: PAT_TA_81577.pep
MKGTKLAAILILQAVLVMGVLSHVNADYFPKCCNNCRSFSGVDVCDDAHPKCPKGCSACRVXVRRPPKCXRCAGYETTVDGTCGGPAKXY

SEQ ID NO: 187160 - protein, 160 aa, Triticum aestivum
  unsure (1)..(160): unsure at all Xaa locations
  Clone ID: PAT_TA_81578.pep
EKKPKAEKRLPAAKEGGGGGGSDKKAKKKAKKSVETYKIYIFKVLKQVHPDIGISSKAMSIMNSFINDIFEKLAXEAAKLARYNKEPTITSXREIQTSVRLVLPRRLAKHXVSEGTKASQIHSPRPLPALSLSPFDDLLAKDACNCFCKMTWIMDPTIGA

SEQ ID NO: 187161 - protein, 91 aa, Triticum aestivum
  unsure (1)..(91): unsure at all Xaa locations
  Clone ID: PAT_TA_81579.pep
RSSRRNGGRNKHGRGHVKYIRCSXNCAKCCPKGQGYQSVSLVKEHPWSKLAVKNVQGGXCXMMVFLSXSCYPKVHNCVSLVPPFSLFRSPF

SEQ ID NO: 187162 - protein, 147 aa, Triticum aestivum
  unsure (1)..(147): unsure at all Xaa locations
  Clone ID: PAT_TA_81580.pep
PXGKXFXXXRXPXKXWXXXPNGPRXPGWXRKXRLXXRRXKGXALGVXXAVXXVHXTAGLLXRTGGSHSPFSWQFWXASCXFSYYASWXRGLLQGXSWVXQVSQSGRVXXASEAVIXSYRGIGYRAPPXFFKMNGIFYMFGINIQRAR

SEQ ID NO: 187163 - protein, 85 aa, Triticum aestivum
  unsure (1)..(85): unsure at all Xaa locations
  Clone ID: PAT_TA_81581.pep
AEVAAAATEEAKKSNNVQRKLEKRQQGRTLDSHIEEQFSGGRLLACISSRPGXQCGRADGYILEGKELXFYMRNSQKKKGKGATA

SEQ ID NO: 187164 - protein, 89 aa, Triticum aestivum
  unsure (1)..(89): unsure at all Xaa locations
  Clone ID: PAT_TA_81582.pep
AAGRLRRRRGAVGHPGRHAVREPGVVVGDRWIDGMDGSVEPLVVFGWAPSDAPDGSTTIARFGQVXGGGSGQLPFXAAQCTMGGKSGPR

SEQ ID NO: 187165 - protein, 78 aa, Triticum aestivum
  unsure (1)..(78): unsure at all Xaa locations
  Clone ID: PAT_TA_81583.pep
QRSLEHHLFFRGGCAPLSWEQRLKIAIGAARGLAFLHASEKKAMYRDFKASKIXLDAHYNAELSDSGLANLXQSGIPL

SEQ ID NO: 187166 - protein, 82 aa, Triticum aestivum
  unsure (1)..(82): unsure at all Xaa locations
  Clone ID: PAT_TA_81584.pep
RAVSPXAADAKMPFKRFVKIGRVALVNYGKDYGRLVVIVDVVDQNRALXVDAPDMAXAKMNFKLLSLTDXKIDIQAYPKETD

SEQ ID NO: 187167 - protein, 173 aa, Triticum aestivum
  unsure (1)..(173): unsure at all Xaa locations
  Clone ID: PAT_TA_81585.pep
LEVESSDTTDNVKAKIQDKEGIPPDQQRLIFAGKQLEDGRTLADYNIQKESTLHLVLRLRGGMQIFXVKTLTGKTITLRXDSDTIDNVKAKFKDKEGIPPGTSSALXXLGKQLEDGVPSQDYNIQEGXTXQLVLPCXGGSXFREDLNXKTSGVETPTHQFKASQDKEDPRTTR

SEQ ID NO: 187168 - protein, 147 aa, Triticum aestivum
  unsure (1)..(147): unsure at all Xaa locations
  Clone ID: PAT_TA_81586.pep
PLLQSAQLKPDVSVTSAGEDGESDDDGVETITLGDKRIGIRTSLLEEKATACSMLCCYADDSKEGFSHGIDXVATTPGYLSLQXYFHDEXKKXXXXMPXLLRXTKLAVXKSQXQXRNSLPXXLPDYIVPXLXXLCHKNLDTHVFQTG

SEQ ID NO: 187169 - protein, 134 aa, Triticum aestivum
  unsure (1)..(134): unsure at all Xaa locations
  Clone ID: PAT_TA_81587.pep
EGDNMIERSTNLDWYKGPTLLEALDQINEPKRPSDKPLRLPLQXDVYKIGGIGNCANGAVFXTGIIXPXGMVVTFGPXTGLTTEVXPFXXHHDLSLGAFPGXDNVRXNVQNXAXKVSKPGYFASNSQRHLRSCI

SEQ ID NO: 187170 - protein, 71 aa, Triticum aestivum
  unsure (1)..(71): unsure at all Xaa locations
  Clone ID: PAT_TA_81588.pep
MGRKFFVGGNWXKCNGNCPTGKKXIRXNTLNAGQFASYXCCPRLSVNPAYXSFPTVQGXLRQNSISVQNCW

SEQ ID NO: 187171 - protein, 64 aa, Triticum aestivum
  unsure (1)..(64): unsure at all Xaa locations
  Clone ID: PAT_TA_81589.pep
AFGALXVXAGLFMAXNQVGGDTAHGIFFMVLGIVMFIPGFYYTXIAYYAYXGYXGFSFSNIPPI

SEQ ID NO: 187172 - protein, 125 aa, Triticum aestivum
  unsure (1)..(125): unsure at all Xaa locations
  Clone ID: PAT_TA_81590.pep
EVRIMRRLRHPNIVLFMGAVTRPPHLSIVSEYLPRGSLYKIIHRPNCQIDEKRXIKMALDVAKSMNXLHTNXVPTIFXRDXKTTNLXVDHNWXXKPXDSXFXRXEHIXFLXTKTHGRTPDGMDKP

SEQ ID NO: 187173 - protein, 62 aa, Triticum aestivum
  unsure (1)..(62): unsure at all Xaa locations
  Clone ID: PAT_TA_81591.pep
GIRILXLAIIRIRRVTRLASKEXCIQSWCIKQPLDXSLPVGCXIEKHMXSISAWHSLAWGER

SEQ ID NO: 187174 - protein, 52 aa, Triticum aestivum
  unsure (1)..(52): unsure at all Xaa locations
  Clone ID: PAT_TA_81592.pep
XGNXXGIVRCTCVHCTRSAXGGVDGGPSQTAQTAVDRYTLTQSKWPPGPTCK

SEQ ID NO: 187175 - protein, 93 aa, Triticum aestivum
  unsure (1)..(93): unsure at all Xaa locations
  Clone ID: PAT_TA_81593.pep
MGRKFFVGGNWKCNGTVEQVXSIVNTLNAGQXPPTDVVQVFLXPPXFLLPNRXRVXAPRIQLLSKRWVKKGXALTGEFNAESCNSGFPGNLGI

SEQ ID NO: 187176 - protein, 100 aa, Triticum aestivum
  unsure (1)..(100): unsure at all Xaa locations
  Clone ID: PAT_TA_81594.pep
KFVVKXSXKKXIHXIKXGLGXTSXXXGQNLXKTWSFVPCYXXLRMNSWGXXLRKPPVXTRTLXFHLRVPLCRHHQEGCLFPSSKTAPSSRELWPPARLSG

SEQ ID NO: 187177 - protein, 81 aa, Triticum aestivum
  unsure (1)..(81): unsure at all Xaa locations
  Clone ID: PAT_TA_81595.pep
AVPAITVPQVTLPPMPAVPALTVPKVTLPPMPAVPAVTVPKVTLPPMPAVVVPKVTMPPXACNPSISIPKVALPPMPSIPL

SEQ ID NO: 187178 - protein, 135 aa, Triticum aestivum
  unsure (1)..(135): unsure at all Xaa locations
  Clone ID: PAT_TA_81596.pep
FFFXTNPFXGXFLXXGNAGNKXFVXHFTWDIXFSWSHHQXFLXNVNXKNGXPSMWQIXGIXLPFXGNXKXFSLSLVEXYPVPKKXCVPGSKLPFCQXPIRLDVSCWFVVGCTIXCLWDNTPHLFFLVEQQRSNXI

SEQ ID NO: 187179 - protein, 122 aa, Triticum aestivum
  unsure (1)..(122): unsure at all Xaa locations
  Clone ID: PAT_TA_81597.pep
LGGTKYMVIQGEPGVVIRGKKGTGGITIKKTGMALILXGIYDEPMTPGQCNLVVERLXGDYLVRAXFPNPPWICCYLGLGTNLLLLWVCTHLLTDIAMILLGGPGDSKGEKGYFLFKFGTLR

SEQ ID NO: 187180 - protein, 118 aa, Triticum aestivum
  unsure (1)..(118): unsure at all Xaa locations
  Clone ID: PAT_TA_81598.pep
ATSPSSSSLLWAVATASGCRQPSPRREDHRHRRRRHRRETXVDGVCRCPCGRGRGARRKRLVGSXNGLTDLFGRCXXLXVLRXSNPWCLFLPFXNQFDSSPGCNXFPXTDTISKIXKX

SEQ ID NO: 187181 - protein, 128 aa, Triticum aestivum
  unsure (1)..(128): unsure at all Xaa locations
  Clone ID: PAT_TA_81599.pep
AVLFWCHHIAKNAVQFGDGGLALWFDARGGAVCPQGSCVFFCQFFLCLMMSQAPSTSSTNSDLEQLSSDILYGFQARSVQFGSHLIHVIFVFLFLCCVISMCSTKCYVHFIXKSXKDIPQEFTPFXMQ

SEQ ID NO: 187182 - protein, 190 aa, Triticum aestivum
  unsure (1)..(190): unsure at all Xaa locations
  Clone ID: PAT_TA_81600.pep
FETNSKGVEIFWKSWLPREGTPTKAALFFCHGYGDTCTFFFEGVAKRIAAAGYAVYAMDYPGFGLSYGLHGYIASFDGMVDHVIEQYARIRGRKDVQGSHTFSWGQSXMGGAVALKVHLKQPKRMGWMLLLRLCARFQEDVTPPALVLKXLSIYHPXPRSKLFRKXHRRLGSRIXEKKICEYNGYIMTDR

SEQ ID NO: 187183 - protein, 122 aa, Triticum aestivum
  unsure (1)..(122): unsure at all Xaa locations
  Clone ID: PAT_TA_81601.pep
MARLNSKAVVSAVVLAAVVLMMAAKXKATALSCGQVDSKLAPCVSTXXGKXPSIXKECCSGVQGAETAWPAXSPXDRMIXCRCLKXLATSNQSINXGKVSGXPGXXGVSVPFPSAQQLEQCH

SEQ ID NO: 187184 - protein, 158 aa, Triticum aestivum
  unsure (1)..(158): unsure at all Xaa locations
  Clone ID: PAT_TA_81602.pep
YFGCYRFNVQLCHLDAGFNMVGRTFHYIAVPAQSEEVCGMDECPGYTICHRVRXRGRGPPXDQGASGQQKQKQKQXSRASRRGXLKLPCXCPMXCSGXGNXELXEHGHEALEALVPEVLXXQPLAPXVXRPVMVVEHHVARGHXLXVVVPVPLVHGXR

SEQ ID NO: 187185 - protein, 86 aa, Triticum aestivum
  unsure (1)..(86): unsure at all Xaa locations
  Clone ID: PAT_TA_81603.pep
XTYXHXTPGKHTVHXEKKERKGGKEXTXLPGFALCTLNNLDREVNGGXTIPWFSLLLAXMDGAAVWGHPEYPWCTTVCMFAAGCCG

SEQ ID NO: 187186 - protein, 45 aa, Triticum aestivum
  Clone ID: PAT_TA_81604.pep
EEGCLYSYTSSTLKLAEKRVEEQAEKRREREDRRKRRQEKEKREE

SEQ ID NO: 187187 - protein, 111 aa, Triticum aestivum
  Clone ID: PAT_TA_81605.pep
APDVRTLASLRTTGNHRTSDACVLISCWAEAHVPLRPLRLYIDLLLLFSRVSVVIAHIRDRASLIHIGIYSLREDRGPSTEKISLGFKTPFWVAPSRPPLEKNRLPCIVPC

SEQ ID NO: 187188 - protein, 70 aa, Triticum aestivum
  Clone ID: PAT_TA_81606.pep
RAQTHSLCHNQTSKARIRRYNHCQIQTRQGDKITHYRDRNHLVQLQRYIHVVLHTKTYFSWVYCCTILCR

SEQ ID NO: 187189 - protein, 50 aa, Triticum aestivum
  Clone ID: PAT_TA_81607.pep
SSQSTADSLIPTFQHSSFSSIPFIYFSKLYLKSQASCSMFFLLQKFNNYS

SEQ ID NO: 187190 - protein, 61 aa, Triticum aestivum
  unsure (1)..(61): unsure at all Xaa locations
  Clone ID: PAT_TA_81608.pep
YKLVXSPGLQAPSXRRXXPLLGPXSPDXAXXXSTSXSSXTPXXSPTCSWXXAMFXFXSCIM

SEQ ID NO: 187191 - protein, 174 aa, Triticum aestivum
  unsure (1)..(174): unsure at all Xaa locations
  Clone ID: PAT_TA_81609.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMEXKDVMTKNVSIYKAQASALEAHAAPNCKVLVVANXXKHNALXLKEFAPSSLRKHTCLTAHTSSKWVNFDKIGNTL

SEQ ID NO: 187192 - protein, 182 aa, Triticum aestivum
  unsure (1)..(182): unsure at all Xaa locations
  Clone ID: PAT_TA_81610.pep
EEITLGWLYSSETDLWTEFASVHRPNANYFSNMDAPGVLVGDALYFNIDGVIECQLGTLSLSTLEKPIDGNGTLMMAEDGRLGYAAVVDVTDLTLWSREAGPEGAMGWTKLXVIDLKTLLPDGALFITTQYGISRSPRSLMISGIQRAPSFCNTWVGIWRQVWASKMPSGNLRNRSLHEHSR

SEQ ID NO: 187193 - protein, 94 aa, Triticum aestivum
  unsure (1)..(94): unsure at all Xaa locations
  Clone ID: PAT_TA_81611.pep
FDAVMNKGXFFHGYSFITLLMILNHALSGIAVSMVMKYADNIVKVYSTSVAMLLTAIVSVFLFGFNLSLAFFLGSTVVSISVYLHSVGKPQQQK

SEQ ID NO: 187194 - protein, 68 aa, Triticum aestivum
  unsure (1)..(68): unsure at all Xaa locations
  Clone ID: PAT_TA_81612.pep
TKKKNVSSAPRAAGASSNKSTLRLVRPRAERPAGHFLGVAKVSLLAFLYFTKLVDCRINNVIXTLLSV

SEQ ID NO: 187195 - protein, 159 aa, Triticum aestivum
  Clone ID: PAT_TA_81613.pep
QLPHLLHRPAALAPRRRPPGQVGPMQRADDVCMPATVLLLLATSARCAALQADAAATLCKLLQMPLLLAHCPSLLLTAPRCCWPWPSASCQHVRVVCVFGSTIAKRGRPSELDPQERRAQARPRPRRAGHGHGHGGDRARAWLPGARGGHMGNWKLQRP

SEQ ID NO: 187196 - protein, 166 aa, Triticum aestivum
  unsure (1)..(166): unsure at all Xaa locations
  Clone ID: PAT_TA_81614.pep
SYHPGGMYHESNIAPHHITQTWHQNGKCPENTIPIRRTKEEDVLRANSIKRYGKKRPQSIANLDSINKPSNIQXSTGHQVDNCHGTKASFNLWKPTIARADDFSLTQLWIIGGSYSGNDLNTIEAGWQVYPGLYMDRNTKXFIYWTXRDAYXNTGCYNLHGQGSPK

SEQ ID NO: 187197 - protein, 84 aa, Triticum aestivum
  Clone ID: PAT_TA_81615.pep
MCSIPAKQKDSMCSIPLGVASYKDWTRKRRLCSRPLEVHFLSFKKSNTQDTTTLLIDLLQQFLDGTMAKDQGGETYILILQHLH

SEQ ID NO: 187198 - protein, 87 aa, Triticum aestivum
  unsure (1)..(87): unsure at all Xaa locations
  Clone ID: PAT_TA_81616.pep
LAVLXLLAGGSXCAAKLPPPPCSRSCXMLNCDSVGIRYGKFCGVXWSGCXGXDPYDDLDACCREHXSCLXKKVFLLCXLXXKKKIRS

SEQ ID NO: 187199 - protein, 47 aa, Triticum aestivum
  Clone ID: PAT_TA_81617.pep
GGYLQRVFSLFPQKAYDVDTGIRFVQYAGLAWSVVDLVPVIFTHLNL

SEQ ID NO: 187200 - protein, 124 aa, Triticum aestivum
  Clone ID: PAT_TA_81618.pep
NSRWSPRVLIHEDWPPINRIDLESIPGSCGRGGSVTGRRGRSNLTNSTTEQILRNPYQSLVLVVWYVFLPQSTSPPRGGEQETLPELGEEERWAAGPCGAGGKGRQGGKQDVGVTAVRRPSREG

SEQ ID NO: 187201 - protein, 141 aa, Triticum aestivum
  unsure (1)..(141): unsure at all Xaa locations
  Clone ID: PAT_TA_81619.pep
MAPKAAEKKPVEKTPAGKKPKAEKKVPASKEGGDKKGXKKAKKSVETYKIYIFKVLKQVHPDIGISSKAMSIMNSFINDIFEKLAGESAKLARYNKKPXITSREIQTSVRLVXPGELXKHAVSXGTXRHKTRLLGLILVPL

SEQ ID NO: 187202 - protein, 126 aa, Triticum aestivum
  Clone ID: PAT_TA_81620.pep
VGGPSWTVSLGRRDSDTASEALANRDLPAPSLGVTDLITRFAAKGLNHTDMVALSGAHTIGRAQCKNFRTRLYSEENIDPAFATSRMATCPQLTGSGDNNLAPLDDTTPDSFDNAYFVNLKLNKGS

SEQ ID NO: 187203 - protein, 67 aa, Triticum aestivum
  unsure (1)..(67): unsure at all Xaa locations
  Clone ID: PAT_TA_81621.pep
SFILPPQFSCEMYIDYCSLFPRKPVQSKPLFYEKLCSFQTLCTLTMVLVSQPLREPVLTERXCNHSK

SEQ ID NO: 187204 - protein, 127 aa, Triticum aestivum
  unsure (1)..(127): unsure at all Xaa locations
  Clone ID: PAT_TA_81622.pep
SXXXLKLTGQXWTQQTGFGXSEEXXASRRRXXRLGSXGLITXGGSRLGRTRXVXGGAVELRLAVYSXFWCLHLTSILRLAFLXDAGAITEYTNTSIFVPERSKDGEEVPPEWFXMNPDYGEDXAEVI

SEQ ID NO: 187205 - protein, 85 aa, Triticum aestivum
  Clone ID: PAT_TA_81623.pep
GVGEVQWGTPFNRALNIFKGLLVDTRPSYGRVHSVGGAMWKKYYRETTEERKERWRLTEENIDKKVEIAVEKKSAETVTTAVAAA

SEQ ID NO: 187206 - protein, 145 aa, Triticum aestivum
  unsure (1)..(145): unsure at all Xaa locations
  Clone ID: PAT_TA_81624.pep
MXLIAGEEFXHILRVLNTNVDGXXKIMFALTSIKGVGRRFSNIVCKKADIDMNKRAGELSSDXEMDRLMAVVHXPRQFXXXDWFLNRKKDYNDXRXSXVXSXAVXMKLXDDLRXKKITNHRGLXHXWGVLSVVSTSLPARLLGLR

SEQ ID NO: 187207 - protein, 176 aa, Triticum aestivum
  unsure (1)..(176): unsure at all Xaa locations
  Clone ID: PAT_TA_81625.pep
MSGRKKTREPKEENVTLGPAVREGEHVFGVAHIFASFNDTFIHVTDLSGRETLVRITGGMKVKADRDESSPYAAMLASQDVAVRCKELGITALHINSRATGXGNKTKIQGPGAQLRLNXLALLGMKIGRIEDVXPVPTDXTRRXGGKEEGAVIMLVQDGKYKLSISASTVRHSLWM

SEQ ID NO: 187208 - protein, 70 aa, Triticum aestivum
  Clone ID: PAT_TA_81626.pep
ALIFVEECGLTSLLTPDQFLNERESMLQGISSSCAPGENALSVTPLLMILLWFVFVSDGVKLQLSVVWGS

SEQ ID NO: 187209 - protein, 82 aa, Triticum aestivum
  Clone ID: PAT_TA_81627.pep
ASQWWFPRLLPLQPVRRGGSFSWWWAPRLLPNQPVCRGANLLGVNTMDKKLDEQEALHLEATIVCHQDSNVDLVLNGQCLLK

SEQ ID NO: 187210 - protein, 164 aa, Triticum aestivum
  unsure (1)..(164): unsure at all Xaa locations
  Clone ID: PAT_TA_81628.pep
ANRLKKEGKELESTRLYFEAALKFLHVASLLEPPGIDGLKQGDAAQSMYSDTAKLCNFVGHEYERCKKMAAAALAYKCVEVAYLKAAYYKYPIASXDRQVLQAVVQTTPGESPSSSASXDIDNLXNNGLSXDGPSXKDANXPKLLGTFILAVRNQHTDKVLXIK

SEQ ID NO: 187211 - protein, 160 aa, Triticum aestivum
  unsure (1)..(160): unsure at all Xaa locations
  Clone ID: PAT_TA_81629.pep
AERLHKLRKAPRQVQGKLALFSWGKRNKLAPAETPPIESSSSTRNVVTYIDRLTPRGHPAKKKKTPRGQSFELDDLLRRSAEVLGXGTVGTTYKTTLDGGYETVFKRLXGCGLAEVYFXQHMRMILPSGTSTFAMXRYYXXTDXKMXXXIXPMGXLPYPG

SEQ ID NO: 187212 - protein, 178 aa, Triticum aestivum
  Clone ID: PAT_TA_81630.pep
PRPDETDSGLIWVVLPRSTSGHGTYISRFPFSPYEPPLSGDSHVSGLPVRDIPHRFCSPSIPRPKLSTILGRAPRSWKRNCESYFCVFHLDLELWVDAAAMHFSGPTMIWIEKGGFTLCNLTWESFCSLVCDQFERNEFSSLLRQLFHLRQIDSVLAYVTQFNELMHSLLAHSSSWDP

SEQ ID NO: 187213 - protein, 58 aa, Triticum aestivum
  unsure (1)..(58): unsure at all Xaa locations
  Clone ID: PAT_TA_81631.pep
FRLXLTXVSXTVWXFSXGHIFIXIXXSCLVTVLLXTYXXXSQXGXAMXYNMFKXXAQL

SEQ ID NO: 187214 - protein, 153 aa, Triticum aestivum
  unsure (1)..(153): unsure at all Xaa locations
  Clone ID: PAT_TA_81632.pep
ASSLLKASSQSLARHHPPRKGGCLAAAATAGAAPAASAATAAAGARCSPTWRPPPAPPPWSCPPPPTRGAPAGSRWPAGRPAAATAPPASAAPPAAAPAAAATEPAPXRPAARGEHEDEENKHITIYNNRIIWLQPLHPRARNKRFHLIIRSL

SEQ ID NO: 187215 - protein, 41 aa, Triticum aestivum
  Clone ID: PAT_TA_81633.pep
LVNQRAVDWRPGGFVRPFYGEVHMWAGGLDLVQSRDDPRDP

SEQ ID NO: 187216 - protein, 73 aa, Triticum aestivum
  Clone ID: PAT_TA_81634.pep
HRFRVLAPPPKPVFCLICIVLFLLCFILILKEFHIFYGTTYMHMNVQFQINLKLEPKRIQEEYTIYIQYQKKK

SEQ ID NO: 187217 - protein, 92 aa, Triticum aestivum
  Clone ID: PAT_TA_81635.pep
LLIYIIDQMASTLKVAILVAALLFLSSGVQAAADLTGCVTTCAGGCVARADVKECQARCASSSDMGCTTYCETLLAGCLGRLHHLELPLLLA

SEQ ID NO: 187218 - protein, 110 aa, Triticum aestivum
  unsure (1)..(110): unsure at all Xaa locations
  Clone ID: PAT_TA_81636.pep
TPWXGIDXLRXLVPAPLLPAHLVQXCRATSFPYRNXERSTEFLRARVLVSDIQDLQRVGHYTIPEEXDDVCRWSAXGSAXTDLVEESSASVILRVRACDAVASLVAYSRV

SEQ ID NO: 187219 - protein, 178 aa, Triticum aestivum
  unsure (1)..(178): unsure at all Xaa locations
  Clone ID: PAT_TA_81637.pep
ITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEXSSYLKKXGYNPEKFPLFPSLGFEGDNMIERXTNLDWYKGPTFXXSXQVNXPKRPQTALRLXSGFTRWWHGLSVG

SEQ ID NO: 187220 - protein, 64 aa, Triticum aestivum
  Clone ID: PAT_TA_81638.pep
VLKSSEIEIYFRMWNFICYSIKKLHRAYIQCLTYNCYCSLGQYGFTPLVTVIPSSKIAFALVIT

SEQ ID NO: 187221 - protein, 162 aa, Triticum aestivum
  unsure (1)..(162): unsure at all Xaa locations
  Clone ID: PAT_TA_81639.pep
VLSHANFIANVAGQDLGVKFYPSDVYISYLPLAHIYERTNQIWLVHRGAAVGFYQGDNLKLMDDLNTLKPTVFASVPRLYNKIYAAITNAVKESGGLKERLFHAAYDAKRQAIINGXSTPVWDKLXFXKIXLXWGGRVRLCLKCFPLSQMYGSSDLGVNLAR

SEQ ID NO: 187222 - protein, 61 aa, Triticum aestivum
  Clone ID: PAT_TA_81640.pep
IHVLVSVLLLRSQNISSSDLIFWVGGTNILMKKKVEQRSEVEGHVLLEFIAVRPSTARKKK

SEQ ID NO: 187223 - protein, 85 aa, Triticum aestivum
  unsure (1)..(85): unsure at all Xaa locations
  Clone ID: PAT_TA_81641.pep
VPVPWRRERGREGXEGXTXGRGVFTPSLPPPSSFTGELVFVLSLXLVHGXQELXXIIEXLCXSXIXLXXQXLRXXNXFXXIXXQQ

SEQ ID NO: 187224 - protein, 81 aa, Triticum aestivum
  unsure (1)..(81): unsure at all Xaa locations
  Clone ID: PAT_TA_81642.pep
GVIXPIAIGFIVXANILAGXXFDGXSXNPAVSFGPAVXTGVWENHWVYWXGXFXXAAIAALVXXICFIGXRPHEELSXADY

SEQ ID NO: 187225 - protein, 142 aa, Triticum aestivum
  unsure (1)..(142): unsure at all Xaa locations
  Clone ID: PAT_TA_81643.pep
RVAVXLSXNHXGCSDDTCCSFLVGPVVAFGGRRRGNDGGARPTGAVLGDSGRRRVARRSARARRALNMGAMGDEHEVVEEGFRRTPTWRTKCRISGSGRPLRFEVWGAHEDLSPTNSRLEVSQGIYARRKNTQGTRRLYWFR

SEQ ID NO: 187226 - protein, 163 aa, Triticum aestivum
  unsure (1)..(163): unsure at all Xaa locations
  Clone ID: PAT_TA_81644.pep
DNLACFLRLQPPVFSSSTEPIVADDWLRRIGRELTTTGCTDAEKLCFAAHWLDGPAASWWENYTITYRIATVTXGQFQQAFRTAHVSTGAMXMKKHEFHNLRQGELYCGSSTVDEFSKLSRYAPDDVATDAQKQENLXXXLNDEMSMQFMGGNIQQXQEXGHL

SEQ ID NO: 187227 - protein, 67 aa, Triticum aestivum
  unsure (1)..(67): unsure at all Xaa locations
  Clone ID: PAT_TA_81645.pep
FFXFFFFXNSMAXLTFXQLXVXGSPTDGQXFXFXYHTAXIXLRSLKKLLXRXWFPLPXXCTXLPCXT

SEQ ID NO: 187228 - protein, 84 aa, Triticum aestivum
  unsure (1)..(84): unsure at all Xaa locations
  Clone ID: PAT_TA_81646.pep
QLHGFFLFLLSSVHNVFLSIMKLTNVVFPPPSEISRKINTEADAPGLVGFILLDGHAMDLVTASATNCKPSYSXGXVASLXSQH

SEQ ID NO: 187229 - protein, 56 aa, Triticum aestivum
  unsure (1)..(56): unsure at all Xaa locations
  Clone ID: PAT_TA_81647.pep
PXFXPNXPQSAVVXPLXVPSCLIXXXGLEIKGFLYKRTSXCFILSCXXGRSLXNNL

SEQ ID NO: 187230 - protein, 171 aa, Triticum aestivum
  unsure (1)..(171): unsure at all Xaa locations
  Clone ID: PAT_TA_81648.pep
GGYIEGEITVSGYPKKQETFARISGYCEQNDIHSPHVTIYESLVFSAWLRLPAEVDSERRKMFIEEIMDLVELTSLRGALVGLPGVNGLSTEQRKRLTIAVELVANPSIIFMDEPTSGLDARAAAIVMRTVRNTVNTGRTFLHHQQPIIDIFXXXMXFXEKXGKYWAWQNQ

SEQ ID NO: 187231 - protein, 80 aa, Triticum aestivum
  Clone ID: PAT_TA_81649.pep
RARALVTTLYSQFKNRDKRPLPTGTNGFFSTSDIAPSYQPEPERVHEHDHDHCPVTLPLSGAALCKYFPSYVHCSLYFPH

SEQ ID NO: 187232 - protein, 106 aa, Triticum aestivum
  Clone ID: PAT_TA_81650.pep
QRVGTGAPVYLAAVLEYLAAELLELAGNAAKDNKKSRIIPRHLLLAVRNDEELGKLLAGVTIAHGGVIPNINPVLLPKKTAEKEGKAPNPPRRPPIAQEGRHPEEA

SEQ ID NO: 187233 - protein, 110 aa, Triticum aestivum
  unsure (1)..(110): unsure at all Xaa locations
  Clone ID: PAT_TA_81651.pep
GSHSKMHYSDSGSATHPMHXGLHXXWVVXXXGNXNXLSCXCDAEAHQPNXXXIRSRPYXXXGKTVXSWLSXXXAIAVXLXFKFXXKLNSHKXFWXVNXSXGKGXXGXHPS

SEQ ID NO: 187234 - protein, 122 aa, Triticum aestivum
  unsure (1)..(122): unsure at all Xaa locations
  Clone ID: PAT_TA_81652.pep
LVYQDKLSGDELLSDSFPYRELENGVLWEVDGHWVVQGAVDVDIGANPSAEGGGDDEGVDDQAVKVVDIVDTFRLQXEQPAFDKKXFTPHMKRYIXKNLTANLEGDDLDFSKEDVDSATXNF

SEQ ID NO: 187235 - protein, 65 aa, Triticum aestivum
  Clone ID: PAT_TA_81653.pep
VIRAANGRTATATVVDECDSKHGCDEEHNFEPPCANNIVDGSPAVWKALGLDTDDGVVPVTWSDA

SEQ ID NO: 187236 - protein, 149 aa, Triticum aestivum
  unsure (1)..(149): unsure at all Xaa locations
  Clone ID: PAT_TA_81654.pep
AARKSAPTTGGVKKPHRYRPGTVALREIRKYQKTTELLIRKLPFQRLVREIAQDFKTDLRFQSHAVLALQEAAEAYLXVGLFEDTNLCAIHAKRVTIMPKDIQLARRIPLAKRAKLPLRTTVWFGMIDSVVLVLMLSKSNFCVRIWLLV

SEQ ID NO: 187237 - protein, 131 aa, Triticum aestivum
  unsure (1)..(131): unsure at all Xaa locations
  Clone ID: PAT_TA_81655.pep
KDKSTSPRRREEKRSEKMSGRGKGGKGLGKGGAKRHRKVLRDNIQGITKPAIRRLAXRRGGVKRISGLIYEETRGVLKIFLENVIRDAVTYTDTPRQDLTAMDSXLPLKRQGRTLYGSGXPHNNKIRTTHV

SEQ ID NO: 187238 - protein, 39 aa, Triticum aestivum
  Clone ID: PAT_TA_81656.pep
LVSKVLPVVKKSKKYGGIMLWSRFYDGKTGYSDKVKPSL

SEQ ID NO: 187239 - protein, 74 aa, Triticum aestivum
  unsure (1)..(74): unsure at all Xaa locations
  Clone ID: PAT_TA_81657.pep
MSCNCGSGCSCGSDCKCGKMYPDLTEQGSAAAEVAAVVVLGVAPENKAGXFEVAAGQSGEGXCGDNCKCNPCNC

SEQ ID NO: 187240 - protein, 154 aa, Triticum aestivum
  unsure (1)..(154): unsure at all Xaa locations
  Clone ID: PAT_TA_81658.pep
ENCHKQSEESLENHPTVDNTIKDISKEHKKLANDLNLFQKELERLKNENSSPLLPLDINLIDPSLSGLERALSQLDMANEHLRSIFPSFKELPGSGKCXWERVLAXGAWSWAEALQAKKKTDXVFQELILKQHNDESTVSKASRDIXELIQDTS

SEQ ID NO: 187241 - protein, 84 aa, Triticum aestivum
  Clone ID: PAT_TA_81659.pep
RRAVQRRRPGLQPTLSLRYPLSRTALRMGVNATCKSATSCTAQIRPRSTHAFHRSMFCFRFHFHLACMSIRCRCYRKQQRYLEI

SEQ ID NO: 187242 - protein, 91 aa, Triticum aestivum
  unsure (1)..(91): unsure at all Xaa locations
  Clone ID: PAT_TA_81660.pep
VRLPVDFDKDHAAGAVNVPYYLAVTPQGKEKNPKFVEEVAALYGKEHHLVVACRTGVRSKLATADLRXAGYENARSLQGGYVAFLQERSRG

SEQ ID NO: 187243 - protein, 49 aa, Triticum aestivum
  Clone ID: PAT_TA_81661.pep
VDGEPAVVIGGKQLENNLLVFDLEKQVLGFSMLLSVQLSGCRSSYFFRN

SEQ ID NO: 187244 - protein, 80 aa, Triticum aestivum
  Clone ID: PAT_TA_81662.pep
MWSLVLFAPRHLITLFRSRHRSCPLHAKVNRRPAGAACVYYSGGVWSIVIFSTVMDDACICQRFCVINDPDLPLVLQKKK

SEQ ID NO: 187245 - protein, 132 aa, Triticum aestivum
  unsure (1)..(132): unsure at all Xaa locations
  Clone ID: PAT_TA_81663.pep
PKMNKLLIALPILALLSLGAVFVLSQKNLEASTITIQQWEGCRKNAKICDNMTTAEQGKDQSNLYACYAAAGKVNAIYNPESETITESCKAGKRLQERYCSRFLPDAYSPVHRCNPAXNGSLIXQNIFKPSK

SEQ ID NO: 187246 - protein, 171 aa, Triticum aestivum
  unsure (1)..(171): unsure at all Xaa locations
  Clone ID: PAT_TA_81664.pep
QQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRXGGMQIFVKTLNGQNITXEVDPQDTIDNVKAKFXDKXXTPRTPDLAKQSMAPGKSGSPQL

SEQ ID NO: 187247 - protein, 141 aa, Triticum aestivum
  unsure (1)..(141): unsure at all Xaa locations
  Clone ID: PAT_TA_81665.pep
SAVVHLQSAIKFNGGGHVNHSIFWKNLKPISEGGGEAPHGKLGWAIDEDFGSIEKLIKKMNAEGAALQGSGWVWLALDKEAKRLSVETTPNQDPLVTKGSNLHPLXGIDVWEHAYYXQYKNVRPDYLXNIWKXXNWXMLKI

SEQ ID NO: 187248 - protein, 176 aa, Triticum aestivum
  unsure (1)..(176): unsure at all Xaa locations
  Clone ID: PAT_TA_81666.pep
TDAPDAAPPPAADAGASSSSSRKPGKRFEIKKWNAVALWAWDIVVDNCAICRNHIMDLCIECQANQASATSEECTVXAWGVCNHAFHFHCISRWXKXRQVCPLXDNSEWXSKKYGTNTSSRALLAYYHPPKKLLFRNYSAITLDLTRFDICIKSSMHKLRISQGSPLIPAWTWRAF

SEQ ID NO: 187249 - protein, 63 aa, Triticum aestivum
  Clone ID: PAT_TA_81667.pep
MSKQGGKAKPLKQAKVAEKDYDENDLAYLQKKKDEQKALKELKAKAGQKGALGGSGSKKSGKK

SEQ ID NO: 187250 - protein, 39 aa, Triticum aestivum
  Clone ID: PAT_TA_81668.pep
TYSGYKYTVQQLPNPKYSVVINLFTSVYATVAQSKIYRC

SEQ ID NO: 187251 - protein, 139 aa, Triticum aestivum
  unsure (1)..(139): unsure at all Xaa locations
  Clone ID: PAT_TA_81669.pep
MDPDSVSKAFVQHYYHTFDSNRAALVGLYQDGSMLTFEGEKFGGPAAIAGKXGSLPFQQCQHKIXTPSDCXPPGPXGGSSSSVSRTITNRPRXXPLKXSXRFPFLPTGGXLXCKTMFRPELWLKEGDPPGKLFQGFKFQ

SEQ ID NO: 187252 - protein, 91 aa, Triticum aestivum
  Clone ID: PAT_TA_81670.pep
MSCNCGSGCSCGSDCKCGKMYPDLTEQGSAAAQVAAVVVLGVAPENKAGQFEVAAGQSGEGCSCGDNCKCNPATVNCMHPTYVCWVRVYVE

SEQ ID NO: 187253 - protein, 162 aa, Triticum aestivum
  unsure (1)..(162): unsure at all Xaa locations
  Clone ID: PAT_TA_81671.pep
TLEVESSDTIDNVKAKIQDKEGIPPDQQRLIFAGKQLEDGRTLADYNIQKESTLHLXCSAFRGGMQIFVKTLTGKTITLEVXPPDTIRQCXRRNPKTRXAFPPDQQXLIFWVRTFRMAHLGGYTSKKPPSIGCPSFVAIAWQWTFLQKPPSSNVLFVLLFKN

SEQ ID NO: 187254 - protein, 133 aa, Triticum aestivum
  unsure (1)..(133): unsure at all Xaa locations
  Clone ID: PAT_TA_81672.pep
VRXQXGXRXFXSXVLLNMRPGNLGXPGGEFRWHYFXDXRIEDLNPGRXXRVRIXFFERRIXGRKRERFIRXHPYIVQXDTHFEPXGFPWQRCTWTVFPGKVVINFLTADRVHLRLFELLFLGVPNYKSRLHQF

SEQ ID NO: 187255 - protein, 74 aa, Triticum aestivum
  unsure (1)..(74): unsure at all Xaa locations
  Clone ID: PAT_TA_81673.pep
INGTYPNMLPSQVGWEFMWVILFGTPICRGQVLMQVYKYIQQKTDHMLTNTPSEDHYLGPNSIXKNKHQIXEIF

SEQ ID NO: 187256 - protein, 168 aa, Triticum aestivum
  unsure (1)..(168): unsure at all Xaa locations
  Clone ID: PAT_TA_81674.pep
ADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSXKNMMCAADPRHGRYXKASAMFPWKMTQXVDXQMLNSKNKXPPTIPTCESSCPPKGLNSHFVIHSSR

SEQ ID NO: 187257 - protein, 79 aa, Triticum aestivum
  unsure (1)..(79): unsure at all Xaa locations
  Clone ID: PAT_TA_81675.pep
KVTGYSNRCIFNIIPHIIRQVVHLIHLGXYGFPTLVIPXGSCKIAXWNTCXKXXXHXCYNSXLGXLFXGAKNXDRSGKS

SEQ ID NO: 187258 - protein, 143 aa, Triticum aestivum
  unsure (1)..(143): unsure at all Xaa locations
  Clone ID: PAT_TA_81676.pep
LTYREVQSILMQRHIMVDGKVRTDKTYPAGFMDIISIPKTGENYRLLYDTKGRFRLHSVRDEDANSTLQGQVCPFGQKGIPYLNTYDGRTIRYPNLSSKANDTIXSXLGDQQIVDFIXFDVXNVXMVTGXPTLGVLCDRTRRT

SEQ ID NO: 187259 - protein, 47 aa, Triticum aestivum
  Clone ID: PAT_TA_81677.pep
RKSTRIGCARVVCAGNRGVFITCNYNPPGNFNGERPFAFLTLGAEAK

SEQ ID NO: 187260 - protein, 142 aa, Triticum aestivum
  Clone ID: PAT_TA_81678.pep
DTNLFFVLRKSSTAHTQLPRTVFGRSFKVDQVTMDTWTTNNHPPICWMLVLGNRLLLVAQNGVDCLQHRRHNDERNHGGERDGHPGRREEVKYQVPTPSARPPRPVPRHPERRDVLLDVEPALVLQVPQERQLGLVVEGEAT

SEQ ID NO: 187261 - protein, 162 aa, Triticum aestivum
  unsure (1)..(162): unsure at all Xaa locations
  Clone ID: PAT_TA_81679.pep
MARTKQTARKSTGGKAPRKQLATKAARKSAPATGGVKKPHRFRPGTVALREIRKYQXKSTELLIRNSPSKRLVREXSXDFKDRPEVQESAVSALQGGARGVLVRRSKDTTXRIKPASHHPKESTRRRIRRDALSFHADMRISCVLVVGVICCLCVLIWMNEE

SEQ ID NO: 187262 - protein, 62 aa, Triticum aestivum
  unsure (1)..(62): unsure at all Xaa locations
  Clone ID: PAT_TA_81680.pep
TLAIALVLXXFHEGKRXVCLXIVVNEWQYIIHSRCYIIHQLVSSCAILMESEFRIMLSLFIA

SEQ ID NO: 187263 - protein, 56 aa, Triticum aestivum
  Clone ID: PAT_TA_81681.pep
PLITPPYTTLLHVQNLTKLVRTILCNNTKYDENLLDRSSIHTYGRVGRSSGPSPAC

SEQ ID NO: 187264 - protein, 141 aa, Triticum aestivum
  unsure (1)..(141): unsure at all Xaa locations
  Clone ID: PAT_TA_81682.pep
VIVRVFEEGTRDRPYGHCLVAGLAKYPKKVIRKDSAKKTAKKSRVKVFLKLVNSPTSCPPRYTLXDVDLKEVAPGXRSLTSXGQEXGPAKAAKANSEERSKTRQKLQPACSRPRKLSLRYTDRLILTASLGPPVLDPFKWF

SEQ ID NO: 187265 - protein, 152 aa, Triticum aestivum
  unsure (1)..(152): unsure at all Xaa locations
  Clone ID: PAT_TA_81683.pep
PLPLLPHTRPSSRSEGDHRHRRHGRRLPRAHRPPLGLGPCSGDRLRPSASSAPKNASTAPPHRLNRPHPPHGCCWRSSSDPAMPDAPKLSTGPRVPTQCWSPGARRHLRQRLLLHRXCLLLRAARCRRPXIVYEDPSXRLHSSXCIPICVXL

SEQ ID NO: 187266 - protein, 78 aa, Triticum aestivum
  unsure (1)..(78): unsure at all Xaa locations
  Clone ID: PAT_TA_81684.pep
XRPTXXXWRXRXRXXPFPFFLSXCXXLFXCSFXXYVFXDLFLXFLXLNXFLVXSPXQXXPXPKKKKKKKKKKKKKKKK

SEQ ID NO: 187267 - protein, 88 aa, Triticum aestivum
  unsure (1)..(88): unsure at all Xaa locations
  Clone ID: PAT_TA_81685.pep
PDIXXXVLFLKXLXGXLGLXQPWXXFPRNFXFLGIRAGFLXXEDRDRNLXILLWVXPWKXTXXFXLLGSXHGKSTILEGAXDAPRIKH

SEQ ID NO: 187268 - protein, 145 aa, Triticum aestivum
  unsure (1)..(145): unsure at all Xaa locations
  Clone ID: PAT_TA_81686.pep
MAPKAEKKPAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGXAAKLARYNKKPTXSREIQTSVRSPPGEQAAVRGTRPHKSLS

SEQ ID NO: 187269 - protein, 168 aa, Triticum aestivum
  unsure (1)..(168): unsure at all Xaa locations
  Clone ID: PAT_TA_81687.pep
RTLADYNIQKESTLHLVLRLRGGMQIFVKTLTGKTITLEVESSDTIDNVKAKIQDKEGIPPDQQRLIFAGKQLEDGRTLADYNIQKESTLHLVLKLRGGMQDICEDLTGKDITXGXGSXXHIDNVXAKXQDKEXIPPGXERLIFAGNSXGWRTWGAKLHLTWCPSPWQ

SEQ ID NO: 187270 - protein, 140 aa, Triticum aestivum
  unsure (1)..(140): unsure at all Xaa locations
  Clone ID: PAT_TA_81688.pep
REPKDAFLSRWHFEKKLHQGISLGMDEAFAMFSEGCMPYDPFWDRYLEYWKESLARPREVMFLRYEEIMSDTPKVIRKLASFLGVPFTREEESGGVVEXVADLCGFTSLSSVPIRVNLLKLSMELTLVLLRCLRKGKGDG

SEQ ID NO: 187271 - protein, 71 aa, Triticum aestivum
  Clone ID: PAT_TA_81689.pep
LLIEDAQKQVDLFFCSVAEYLIPSGWKVLPVFSAVHLNPSLHGNAQQFQPCRWEVCLISIPCARASIFVVK

SEQ ID NO: 187272 - protein, 96 aa, Triticum aestivum
  unsure (1)..(96): unsure at all Xaa locations
  Clone ID: PAT_TA_81690.pep
LTLEXTYEACGKMIYKXRKNIWIEVAVCHFFNKNVNLNYIYFPKAPTPILXNDYKIDGKKLLXITXXLPXGNMXXRLSIHIIGTCMXTEVHGGEXG

SEQ ID NO: 187273 - protein, 71 aa, Triticum aestivum
  Clone ID: PAT_TA_81691.pep
GGSGGGRVHQEVLRPTAQAAEPRRRHPGVRLRGSGRRRRVLGATLAYVPIETSMHIGVSYFPRACIFPFQV

SEQ ID NO: 187274 - protein, 87 aa, Triticum aestivum
  Clone ID: PAT_TA_81692.pep
SSTAISSRLQQPRPTGSGGCSRVGAVLLRQALSSSSTTRRQRPPSSRSLFHSRAQLRRACRQASLLSLDATVVYHQSGIRASMGRSE

SEQ ID NO: 187275 - protein, 170 aa, Triticum aestivum
  unsure (1)..(170): unsure at all Xaa locations
  Clone ID: PAT_TA_81693.pep
XFICXEXIYXRTLITQQGHFERSSXVXXGACSLAPCRVSRRFRVVAVGGPKVESLSXMCGCTPSLRGSGAPSNGGPLRKLNRPARCHAFEHVLRLHPRTPRRSSSPPPPAARRSPPTRPAGARPRSTRTPGRPQSTAVTSRAEALSAQRLGCRMLRTGAGKGLPSRTSRG

SEQ ID NO: 187276 - protein, 91 aa, Triticum aestivum
  unsure (1)..(91): unsure at all Xaa locations
  Clone ID: PAT_TA_81694.pep
NFRMFVLFELVNVLIPCRVAHTHTNDQRDRYSCPLQGKLQCEVTLFFFSFFLFPVLVXCWAATVSHGVMLXXXTYSSLXIYXVLCGXIRTF

SEQ ID NO: 187277 - protein, 134 aa, Triticum aestivum
  unsure (1)..(134): unsure at all Xaa locations
  Clone ID: PAT_TA_81695.pep
EARLPTKILWMRRMRVLRRLLRKYREAKKIDKHMYHDMYLKVKGNMFKNKRVLMESIHKSKAEXAXXKTLSDQFEAKRAKSKAXRXXKHAKEGRRDXSWPQESCTTSGLQSSQVKRSRPRPRDGRNLFGILKVT

SEQ ID NO: 187278 - protein, 97 aa, Triticum aestivum
  Clone ID: PAT_TA_81696.pep
RVAGDSDAVSEAVKAAAPYLLGTCSPGHGREKMLSFSSSQQPPSCPSAAAAAQAALPLYYGTPASCLGGTAARAPEALLLFDLIYAGDWESCYFFLK

SEQ ID NO: 187279 - protein, 96 aa, Triticum aestivum
  Clone ID: PAT_TA_81697.pep
KYAIIKLHRKQVAYQWLPCEALLYKNFKRQRLPEFRLLPASMNFFRAETSKPCCEQRVLPWLEHKHKCTQTNCVNLFGSKCSSLGNLTCSLKGGFP

SEQ ID NO: 187280 - protein, 72 aa, Triticum aestivum
  unsure (1)..(72): unsure at all Xaa locations
  Clone ID: PAT_TA_81698.pep
PXPGSIXXARVTXXMARMXSAXIMCVDSXAVXEKFTGMIXQHXVRXTEIDKVDIYQSYRPGDIVRALXXSLG

SEQ ID NO: 187281 - protein, 100 aa, Triticum aestivum
  unsure (1)..(100): unsure at all Xaa locations
  Clone ID: PAT_TA_81699.pep
PGDGDAPKIRLPLRPRLLRPAALHLPGXETAVELHSRSGVSXSXXEKVNRGRKLWXXWXTPGCSRVMTTSDYXTXDPNPVNAEAPLQAHTQLXTPXLYXI

SEQ ID NO: 187282 - protein, 99 aa, Triticum aestivum
  Clone ID: PAT_TA_81700.pep
LVQLLVGNQKKASAAALNLMSELTCLNRTSQTVEFLKELKSGGCLNTMQVLLVYLQQAPPVQHPLAAVMLLQLDLLGDPLQYSVYREEAVDAIMAALGA

SEQ ID NO: 187283 - protein, 132 aa, Triticum aestivum
  unsure (1)..(132): unsure at all Xaa locations
  Clone ID: PAT_TA_81701.pep
MEIAHEARSGIMVRSAPPTPTMWQDSSTDNKRSRGSRAEGRSSGSSADQDPSSPRSKHSATEQRRRTKINDRLDILRDLLPNCDQKRDKXSFLLEVIEYIRXLQEKCQNYDQGFLNKNNVXANCMQWDKVYY

SEQ ID NO: 187284 - protein, 117 aa, Triticum aestivum
  unsure (1)..(117): unsure at all Xaa locations
  Clone ID: PAT_TA_81702.pep
LATVIMLAYLLTGGFYVHNVPIFMIWAKYSSFTYYCYRLLIAVQYSGHLAQLLPLDSTHGEAGTWTCVGXLVAMFFAYXLLAYFALRRVKDVITHTHISLSLGEQAKLTIPARQGIK

SEQ ID NO: 187285 - protein, 115 aa, Triticum aestivum
  unsure (1)..(115): unsure at all Xaa locations
  Clone ID: PAT_TA_81703.pep
XQNPYQXRGRRSSIAXTRAXYRNTXGRRKRNYYSLTAGXKIVELQLKMRRNPHXTLHQPNQTSLFTSSTQGQIGQKPSAGNWLCXXGSPICLRQGANFQSRPPWQPNEEGETGKG

SEQ ID NO: 187286 - protein, 157 aa, Triticum aestivum
  unsure (1)..(157): unsure at all Xaa locations
  Clone ID: PAT_TA_81704.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVXIMPXDIQLARRIRGERAKLCSSSVIASLMCHWELRAFL

SEQ ID NO: 187287 - protein, 37 aa, Triticum aestivum
  Clone ID: PAT_TA_81705.pep
PCCLYTCFTIFEGLVRAHRISCVRILVISTHLKMPLV

SEQ ID NO: 187288 - protein, 144 aa, Triticum aestivum
  unsure (1)..(144): unsure at all Xaa locations
  Clone ID: PAT_TA_81706.pep
MQIFVKTLTGKTITLEVESSDTIDNVKAKIQDKEGIPPDQQRLIFAGKQLEDGRTLADYNIQKESTLHLXVLRLRGGXAKKRKKKTYTKPKKQKHKHKKVXLAVLQFYKVDDATGKVTXSRRSAQRRXGAGTHGNTRRTTGQCG

SEQ ID NO: 187289 - protein, 61 aa, Triticum aestivum
  Clone ID: PAT_TA_81707.pep
FFFFNCQSGLNSIIIKTSTDFSRHHNDESMTMTVLLPKYQLIFMASMMFLPLSLLENTSFT

SEQ ID NO: 187290 - protein, 133 aa, Triticum aestivum
  unsure (1)..(133): unsure at all Xaa locations
  Clone ID: PAT_TA_81708.pep
MPEVYARIPSVCPALIAGPVWRKGEDDKDEEEEDDEEEDEDEGHEQWLHLDSPSRDGCSGGPVMCARGVIGVVAQAALQITASVSTESVHEVLKRWLGIHWRMTGVCXRSSIHYCDRALTLLLAVDQAVNCEL

SEQ ID NO: 187291 - protein, 146 aa, Triticum aestivum
  Clone ID: PAT_TA_81709.pep
NTDVARAKPVDYAKDTMSGASAENTQASERSSTDEEMTEQQDGGTRIEGGTQDLECTSPERTIEKIGSDSHGDHTATAPEQETEQVLETESQIGNVGCNDHNSINSVMGGETLQLEDEMQAQQETEESNLIPKEGGRPLVNEEQNP

SEQ ID NO: 187292 - protein, 141 aa, Triticum aestivum
  unsure (1)..(141): unsure at all Xaa locations
  Clone ID: PAT_TA_81710.pep
TSFWCHQLSSERWHARLGHPSFVIVQQVLRNNQLPCXGERSXETICDSCQKAKSHQLPYPISTSVSTRPLQLVFSDVWGPAPMSVGRHTYYVSFIDDFSKYTWIYLLKKRSDIFQVFQNFQALVERQFDTKILAVQSDWGG

SEQ ID NO: 187293 - protein, 120 aa, Triticum aestivum
  unsure (1)..(120): unsure at all Xaa locations
  Clone ID: PAT_TA_81711.pep
RAIPIGEWYRAPRSRRRHRGLRTAPFXPGHVAXRRSASXQXSTEXLIXKSXSSALCGEIAQDFKTDLRFQSSAVSALQEPPRHTWWACSRTPTSAPSTPSASPSCPKDIQLARRIRGERA

SEQ ID NO: 187294 - protein, 75 aa, Triticum aestivum
  unsure (1)..(75): unsure at all Xaa locations
  Clone ID: PAT_TA_81712.pep
LPCTGLLKFXQNHFLVGPXPGFNXRNXEFATAAGXXHLGPSXXXDXKHQSESPRIXXTRXHPSXSXKMGTHSPXG

SEQ ID NO: 187295 - protein, 137 aa, Triticum aestivum
  unsure (1)..(137): unsure at all Xaa locations
  Clone ID: PAT_TA_81713.pep
MARTKQTARKSTGGKAPRKQLATKAARKSAPATGGVKKPHRFRPGTVALREIRKYQKSTELLIRKXPFQRLVREIAQDFKTDLRFQSSAVSGLQEAPRLLVGLFXGHQLCAIHAKRVTXMPKDIQXARRSGGXRAKP

SEQ ID NO: 187296 - protein, 120 aa, Triticum aestivum
  unsure (1)..(120): unsure at all Xaa locations
  Clone ID: PAT_TA_81714.pep
NHHFCIFFIYTHFSTLIAIQLYFPRVDSFRWTLFCVSNLFETVNFFNSRSYVPQNQVNKLTSNLAINMGTLLKSSGSIYKNVEKLSAFRLRTTPAXQPPQLCTLCYYVHGYLGWEEHXEH

SEQ ID NO: 187297 - protein, 113 aa, Triticum aestivum
  unsure (1)..(113): unsure at all Xaa locations
  Clone ID: PAT_TA_81715.pep
MDSQATVGSSPSNFKNMYALVRTPESNGQPERPMREVXGGLKTRTFKKNWSLAAEVGTDGLQSMLWSIRTTATKPTRETPFFLVYGAEAVLRHEVRRRSARVLAFNEAQQDAM

SEQ ID NO: 187298 - protein, 64 aa, Triticum aestivum
  unsure (1)..(64): unsure at all Xaa locations
  Clone ID: PAT_TA_81716.pep
LIFPPQVLTPSNSIQRLVSEADMAFALRSISLPSRHHTTEAEVQEDLHSLETSVSSSITIXDDV

SEQ ID NO: 187299 - protein, 84 aa, Triticum aestivum
  unsure (1)..(84): unsure at all Xaa locations
  Clone ID: PAT_TA_81717.pep
HRDLKANNILLDEEMDPKIADFGLARLLQEGHTHTQTTRAAGTLGYMAPEYAVHGSVSPKIDIFSFGXVLALGIYNQXKECISG

SEQ ID NO: 187300 - protein, 106 aa, Triticum aestivum
  unsure (1)..(106): unsure at all Xaa locations
  Clone ID: PAT_TA_81718.pep
PRRXLRXXXVNXXXXMALXTWLRDTGSXPWTWHPYPDNKVLPSQAQQISFPAFYRMYVSLARSXFSDQHLGAKKQHQQVQKFHITINKHASMTRCYYYPVITSMCL

SEQ ID NO: 187301 - protein, 77 aa, Triticum aestivum
  unsure (1)..(77): unsure at all Xaa locations
  Clone ID: PAT_TA_81719.pep
SPKQTERVSCENIPVQVAEPETIAPPSPPTPRLSAAAMSPMFQGAFCRDMAVVGTLLSRXGRFDRPPMAVKCEAMSC

SEQ ID NO: 187302 - protein, 56 aa, Triticum aestivum
  unsure (1)..(56): unsure at all Xaa locations
  Clone ID: PAT_TA_81720.pep
VLASSGXXIXDDXMLKFXEXXSXRXHRFXXLXAXXXRXRSLMLCXXECRGQPXXVS

SEQ ID NO: 187303 - protein, 170 aa, Triticum aestivum
  unsure (1)..(170): unsure at all Xaa locations
  Clone ID: PAT_TA_81721.pep
FDGALNVDVNEFQTNLVPYPRIHFMLSSYAPVISAEKAYHEQLSVAEITNSAFEPSSMMAKCDPRHGKYMXACCLMYRGDVVPKDVNAAVATIXKTKRTIHLWTGCPTGFKVWYQTTNHPSVXXKRRLAKGQXGPVHXSQSNNVVEXFSRXDNTEVASCFSTGLGEGGNL

SEQ ID NO: 187304 - protein, 65 aa, Triticum aestivum
  unsure (1)..(65): unsure at all Xaa locations
  Clone ID: PAT_TA_81722.pep
PKRXXRXEECWXSLPLFFXLCPXXAYVXHXXQCCXRXAVXLSAALAHXGXLWLXAXSLCXYAFTV

SEQ ID NO: 187305 - protein, 176 aa, Triticum aestivum
  unsure (1)..(176): unsure at all Xaa locations
  Clone ID: PAT_TA_81723.pep
CNLCRLGEGLGTDFFHCMKCNCCLGLKLKEHKCREKMLEMNCPICCDFLFTSSAAVRGLPCGHFMHSXACFQAYTCSHYTCPICSNPWGXYDXVFXMLDXLLAAGRLPEEYRXRCXXILRXXLRKKXFPRSNWLYHKMRRLRSYNTRVSKTEDKSNAELTSDPFSSPPIFGNPPTL

SEQ ID NO: 187306 - protein, 162 aa, Triticum aestivum
  unsure (1)..(162): unsure at all Xaa locations
  Clone ID: PAT_TA_81724.pep
MVAFRFHQYQVVGRALPTPGDEQPKIYRMKLWATNEVRAKSKFWXYFLRKLKKVKKSNGQXSAINEIFGEEPTTIXKNYGIWAAXYKSKTGYHNMYKEYRDTTLNGCRWEQMYTEMALPNRCESPCIQLTKTXDVNFKLCKRDTQAQIQSSPLGQKTTRTEH

SEQ ID NO: 187307 - protein, 77 aa, Triticum aestivum
  unsure (1)..(77): unsure at all Xaa locations
  Clone ID: PAT_TA_81725.pep
MGDDHGAMHPLDQAFCRPMGSQQQHFLSDAAAXRLGPSGRICRAWFRWTWGRARRSPPPPTATXLVADGPHENGALT

SEQ ID NO: 187308 - protein, 121 aa, Triticum aestivum
  Clone ID: PAT_TA_81726.pep
LNFRAPYSHDVGLPYSIAGLCLLPAAPEQISSLILVPIFCRMQQKARFTSSSSGCFSVHLLPVVQMWRAGKFYYQSTPSSGALPLMERTMNQRRRIIGRRRPGQGTMTGCCCILVSCLLMC

SEQ ID NO: 187309 - protein, 127 aa, Triticum aestivum
  unsure (1)..(127): unsure at all Xaa locations
  Clone ID: PAT_TA_81727.pep
YMGNGGGANSVAPGYTKGDGLGAEIVGTFVLVYTVFSATDAKRSARDSHVPILAPLPIGFAVFLXXLANIPITGXTGINRXGSLGGGKXSKXXXIXGQQGXXGXAXLNGXGFGGXXKXGGXKGXPLK

SEQ ID NO: 187310 - protein, 177 aa, Triticum aestivum
  unsure (1)..(177): unsure at all Xaa locations
  Clone ID: PAT_TA_81728.pep
GTNESPANLVSDRPQARRILLPRRLKMQIFVKTLTGKTITLEVESSDTIDNVKAKIQDKEGIPPDQQRLIFAGXSSWRMAAPFADYNIPEGATLHLCPAAXRGGMQSXVXDPQLGKTITLRXESPDTIDNVKGKVXGQGXIPPGTSXLXLAGKXLEDGRPRLIQIKTSTCLRWGSGN

SEQ ID NO: 187311 - protein, 95 aa, Triticum aestivum
  unsure (1)..(95): unsure at all Xaa locations
  Clone ID: PAT_TA_81729.pep
LVFSWKGLEVFDGSNSVWHTHDTESDDNNFLKTLQLVDEGDMRILDKGGELAWKASDEPRXAQHCGXPGSPGLVSNAALREPGWGWEAEAILKEP

SEQ ID NO: 187312 - protein, 80 aa, Triticum aestivum
  unsure (1)..(80): unsure at all Xaa locations
  Clone ID: PAT_TA_81730.pep
MSSSKACICDNEKYFQYGERDGHGCGRSSSXSCLFTAWPAPSYVTYSLFLKVPMXASXLSXKGFLDLXXHXXKQKGVXPR

SEQ ID NO: 187313 - protein, 95 aa, Triticum aestivum
  unsure (1)..(95): unsure at all Xaa locations
  Clone ID: PAT_TA_81731.pep
PGAXFPRHXCPGNHPTISIKSALVSYPLQDTGSVNQELLVEIXHLALVPHLVSXHXPGPYHIRTHNRRQVSLKHVLSSWFHWQNVQGARMRRYIM

SEQ ID NO: 187314 - protein, 142 aa, Triticum aestivum
  unsure (1)..(142): unsure at all Xaa locations
  Clone ID: PAT_TA_81732.pep
RVGSGAPVYLAAVLEYLAAEVLELAGNAAKDNKKTRIIPRHLLLAVRNDQELGRLLAGVTIAHGGVIPNINSVLLPKESPAAAXEKEANRPKKKSTTNPQKKKVAAKGYRPHSLVLLRFNSQWTKMRSCMYAWVSVVPSDPV

SEQ ID NO: 187315 - protein, 53 aa, Triticum aestivum
  unsure (1)..(53): unsure at all Xaa locations
  Clone ID: PAT_TA_81733.pep
CFRGKMSTKEVDEQMLNVQNKXSSVLLWXGFPKXLXSXFCKXXPRGLKXGATF

SEQ ID NO: 187316 - protein, 76 aa, Triticum aestivum
  Clone ID: PAT_TA_81734.pep
PIAIGFIVGANILVGGAFSGASMNPAVSFGPALVSWEWGYQWVYWVGPLIGGGLAGVIYELLFISRTHEQLPTTDY

SEQ ID NO: 187317 - protein, 136 aa, Triticum aestivum
  unsure (1)..(136): unsure at all Xaa locations
  Clone ID: PAT_TA_81735.pep
MAPVKLYGATLSWNVTRCVAALEEAGVEYELVPINFGTGEHKSPDHLARXPFGQVPALQDGXDLVLFESRAICKYXCRKEQXXLLKEGDTKXXAWVDVWSXVGAIKYTAVLXPILFXCLXHPMLGGPLTXSIDDTC

SEQ ID NO: 187318 - protein, 41 aa, Triticum aestivum
  Clone ID: PAT_TA_81736.pep
SEATHLVHSLSKTEHLILLTMKLLLASNNQSPSPQTATSVQ

SEQ ID NO: 187319 - protein, 81 aa, Triticum aestivum
  unsure (1)..(81): unsure at all Xaa locations
  Clone ID: PAT_TA_81737.pep
RIGGLEGPGFVAGGIQLVVIYVDFKLDKSYTPSKISIGAGDGFHNLXRESFIHTSMLRIVVLANHLNGRDTHVLQTKICGP

SEQ ID NO: 187320 - protein, 61 aa, Triticum aestivum
  Clone ID: PAT_TA_81738.pep
SLAPNIQGYQTLYCCNHPGLIYSSKVPNYYSIILVLHIIKIAMFLRTIIDVSSCQPSLLSL

SEQ ID NO: 187321 - protein, 171 aa, Triticum aestivum
  unsure (1)..(171): unsure at all Xaa locations
  Clone ID: PAT_TA_81739.pep
FNATKSGKSSLVFKGLNNINNEFQRRRENVVPPSARSQQPLVMKNWSACNDISNKQYNVADGSVPRRNATDNASSSQLALSTAKHYNSNVRELNDRVYAAPARXYDNRIXGTXGXMAKHRLGECLDKXQVPPGPYYDKMLXYSSXNAASTSGIGKSQRRPHNDPGKGHQSD

SEQ ID NO: 187322 - protein, 50 aa, Triticum aestivum
  unsure (1)..(50): unsure at all Xaa locations
  Clone ID: PAT_TA_81740.pep
TFQLXCXCPTKXPASTXAQSHEQVRPCRLXGGLQLPGXWPXLLXHKGEXD

SEQ ID NO: 187323 - protein, 75 aa, Triticum aestivum
  unsure (1)..(75): unsure at all Xaa locations
  Clone ID: PAT_TA_81741.pep
DCCTLRCRKGDXTCVIDGXGVRXXXLYPWPXCLLXRMLFTTSSSCPCKTPFFITRSMHTSSIHQVVVVVSNLSHP

SEQ ID NO: 187324 - protein, 108 aa, Triticum aestivum
  Clone ID: PAT_TA_81742.pep
SRRTPLNSGICRLPWTSPARRDPSSPPTPPMGGCGCYHQPPLHGRAPKFNMLDLQRLMLHDARRNMWFCCESPQRCSAMEAGEFYLLYLFVACIILQSKVHIRNLNNT

SEQ ID NO: 187325 - protein, 118 aa, Triticum aestivum
  unsure (1)..(118): unsure at all Xaa locations
  Clone ID: PAT_TA_81743.pep
KQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGXRA

SEQ ID NO: 187326 - protein, 126 aa, Triticum aestivum
  unsure (1)..(126): unsure at all Xaa locations
  Clone ID: PAT_TA_81744.pep
RFHATISAHKATSSWLQILSNQRINDSLVLKFVPHAAHPPLPRDLLRFSANVLRHLELHCCCLDPQLGVTLPLHSLHYLHLSNVVIPETSLHSKIAGCLALRKLQLFXVHXLXXARPLLNVISSXV

SEQ ID NO: 187327 - protein, 43 aa, Triticum aestivum
  Clone ID: PAT_TA_81745.pep
FFFFNRLLAQSYITVYGTERCCSALRVPRHIANITMARGPTCH

SEQ ID NO: 187328 - protein, 99 aa, Triticum aestivum
  unsure (1)..(99): unsure at all Xaa locations
  Clone ID: PAT_TA_81746.pep
MQIFVKTLTGKTITLEVESSDTIDNVKAKIQDKEGXPRPDQQRLIFXAGKQSEDGRTLXADYNIQEGXTLHWVSAPAGGAKEXKKXTYTXPKXKXQXKK

SEQ ID NO: 187329 - protein, 136 aa, Triticum aestivum
  unsure (1)..(136): unsure at all Xaa locations
  Clone ID: PAT_TA_81747.pep
ETVSVVAGSYGYIAPEYGYTLKVDQKSDIYSFGVVLMELLTGRRPIEPEYGESNIDIVGWIRERLRTNTGVEELLXTPASGGRVRHVREEMLLGAAXRGLCTAXXPKDRPTMPTWVTIXPEATPPGRHHRHVVKTF

SEQ ID NO: 187330 - protein, 54 aa, Triticum aestivum
  Clone ID: PAT_TA_81748.pep
SVRALGPIAPLPGIRTLSICVCLQCYGRIFSRLAIRPRIICTSLAVFMLNPVTL

SEQ ID NO: 187331 - protein, 143 aa, Triticum aestivum
  unsure (1)..(143): unsure at all Xaa locations
  Clone ID: PAT_TA_81749.pep
DLKDLYINTAIQMDVVGNRKAVVIHVPYRLRKPFRKIHVRLVRELEKKFSGKDVVFVATRRIVRPPKKGXCCSAPRTRTLTXVHDGILEDVLYPAEIVGKRVXIPFGMGXRHKSTWXQKERNNTEYNWNFSAXYRKFFGKXFL

SEQ ID NO: 187332 - protein, 74 aa, Triticum aestivum
  Clone ID: PAT_TA_81750.pep
LQRTGKEEGRELEVGEELPPPGFVDALDTLLVASSPLTYSQQRFNVCTAQPSPAHMLSTGQPKYVHRLGGLLTP

SEQ ID NO: 187333 - protein, 103 aa, Triticum aestivum
  unsure (1)..(103): unsure at all Xaa locations
  Clone ID: PAT_TA_81751.pep
SCPYWKCPGXMFXLXQDAYLIFYNNIRIKEDQGXKHIGVNLQSSVDNVAGSIGFDLPASPSCLTLLPTARLLHTSCGHLCLPRTACAAALRVASPSPSLEHRG

SEQ ID NO: 187334 - protein, 96 aa, Triticum aestivum
  Clone ID: PAT_TA_81752.pep
CAPGKVSIMPHSALCGVDNITVGGSGHCPPSSHGRTAPVMVGWHGRASAQGKPLGRPRRKGANPSCSSRAQLKNPLPASQVGSPKPTTCSKTHGCP

SEQ ID NO: 187335 - protein, 139 aa, Triticum aestivum
  unsure (1)..(139): unsure at all Xaa locations
  Clone ID: PAT_TA_81753.pep
MAAKEPMRVLVTGAAGQIGYALVPMIARGVMLGADQPVILHMLDIEFAAEALKGVKMELXDAAFPLLKGSLLQQLDVVRGCTGCECCGMVGGSPRKEEWKEDVMTKMFNLQQLLLELKHPNCKFGCCNQQTQLTKCPLP

SEQ ID NO: 187336 - protein, 154 aa, Triticum aestivum
  unsure (1)..(154): unsure at all Xaa locations
  Clone ID: PAT_TA_81754.pep
MARXFLLNXGAKXPSVGLGTWQAEPGVFGAAVYAAVKAGYXHIDCXREYXNXKXIXLXXKKLFFEEVXKREDLFXTSXLXNDCXAPEDXSXAXNEXLNDLKLXYXDLXLIXCXLSVNXGINTSXKXXXXTPGTWGNEKLWQPGFKWFFKSISFE

SEQ ID NO: 187337 - protein, 88 aa, Triticum aestivum
  unsure (1)..(88): unsure at all Xaa locations
  Clone ID: PAT_TA_81755.pep
MASKWVRPEVYPLFAATGVAIGICAFSLLRNITGNPEVRVNKMGXRAAGVLEXHEEGRRYARAWLKSYVQGQDPEIMPGIKQXFTXPK

SEQ ID NO: 187338 - protein, 78 aa, Triticum aestivum; identical to SEQ ID NO: 106962
  Clone ID: PAT_TA_81756.pep

SEQ ID NO: 187339 - protein, 150 aa, Triticum aestivum
  unsure (1)..(150): unsure at all Xaa locations
  Clone ID: PAT_TA_81757.pep
EKTHINIVVIGHVDSGKSTTTGHLIYKLGGIDKRVIERFEKEAAEMNKRSFKYAWVLDKLKAERERGITIDIALWKFETTKYYCTVIDAPGXHRDFIKNMITGTSQADCAVLIIDSTTXGGFEAGISKDGQTREXXLLASXLGVXQDICC

SEQ ID NO: 187340 - protein, 104 aa, Triticum aestivum
  unsure (1)..(104): unsure at all Xaa locations
  Clone ID: PAT_TA_81758.pep
SGRGKGGKGLGKGGAKRHRKVLRDNIQGITKPAIRRLARRGGVKRISGLIYEETRGVLKIFLXENVIRDAVTYTEHARRKTVTAMDVLYALXKRQXPHLYGSXG

SEQ ID NO: 187341 - protein, 166 aa, Triticum aestivum
  unsure (1)..(166): unsure at all Xaa locations
  Clone ID: PAT_TA_81759.pep
LLFGEKEVAVFGCRNPEEIPWAAAGAEYVVESTGVFTDKDKAAAHIKGGAKKVIISAPSKDAPMFVCGVNEKEYNLTSTLSPNASCTTNCLAPXLLRLSNDKFGIVEGFDDTXHAMTATXKLLXWPSNKDWRVXKAATSTHXKXTGXQRCXXXVPKLNGYGKAPCP

SEQ ID NO: 187342 - protein, 78 aa, Triticum aestivum
  unsure (1)..(78): unsure at all Xaa locations
  Clone ID: PAT_TA_81760.pep
GELVPGXPXGXXEXXCRDXLSXVWSSASPDFLRISMSTVFKPNKIKMHKMVILKTCIKKSCLLSNGRYGRSDPIFHFP

SEQ ID NO: 187343 - protein, 109 aa, Triticum aestivum
  unsure (1)..(109): unsure at all Xaa locations
  Clone ID: PAT_TA_81761.pep
NGLVFLLNQTNVRKLEKKTEKGRETYLGHLPDRPSSSAQLTGRRQSSPSSAPEGQGALVRRTPRACAPRQLPACLPLRRPGLAKKXQHRPVSPSVSXXLSLPXTLPLPG

SEQ ID NO: 187344 - protein, 102 aa, Triticum aestivum
  Clone ID: PAT_TA_81762.pep
GVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 187345 - protein, 89 aa, Triticum aestivum
  unsure (1)..(89): unsure at all Xaa locations
  Clone ID: PAT_TA_81763.pep
MAPKVAVAKKGDAKAQAAKVAKAVKSGSIKKTAKKIRTSVTFHRPKTLSKXXDPKYPXXSNPXKNKXYQXQIXQYPXTMIRDNKPFFIT

SEQ ID NO: 187346 - protein, 62 aa, Triticum aestivum
  unsure (1)..(62): unsure at all Xaa locations
  Clone ID: PAT_TA_81764.pep
YSNRPSLLDRNRIHQIHYMQSFSTGTTGDLAPYATPGLWLLKHAWDGITNTPPXRCSSPSSS

SEQ ID NO: 187347 - protein, 118 aa, Triticum aestivum
  unsure (1)..(118): unsure at all Xaa locations
  Clone ID: PAT_TA_81765.pep
LKLENSIITTTENSIIVILRELGTSSSTIXILGHTLHISXHIYFXIXQXEIPXEPXXHNAXDMMQIXPVAXHLRILXLKRXLLPNXTRGGPDQSPXXIRYXXMAAFKRXXKTWVPNYP

SEQ ID NO: 187348 - protein, 47 aa, Triticum aestivum
  unsure (1)..(47): unsure at all Xaa locations
  Clone ID: PAT_TA_81766.pep
MADQLTDDQIAEFKEAFSLFXKDGDGCITTKEWEHYAXAGGKNPTGG

SEQ ID NO: 187349 - protein, 190 aa, Triticum aestivum
  unsure (1)..(190): unsure at all Xaa locations
  Clone ID: PAT_TA_81767.pep
SCQASSSPATSFVGTGRDXPDLLFPASIXXXLAGVHSXSGRRXASXXCXASPVSACEXXRSCTPPTCVDRSXAXSXIASXLXARXXPKXXXGLPXPXLTXHEAXFXSXSGSXDDXXDYVCSPPQXTVFLPNWIQSFDIADPHDQXYTNTXXVPXYNASDVXINGSRHXLGLTSXSLXTIXXQSDIGXXLG

SEQ ID NO: 187350 - protein, 122 aa, Triticum aestivum
  Clone ID: PAT_TA_81768.pep
QEEHQTEVPQIPKVELPSFPEVHLPPKPELPKVELPPVPEVHLPSKPELPKVELPPVPEVHLPPKPELPKVELPMFPEVTCHPKPEMPKVESRRSPRSKGGVLPKAGDPLFPCSLSKAIGKP

SEQ ID NO: 187351 - protein, 65 aa, Triticum aestivum
  Clone ID: PAT_TA_81769.pep
ECPVTHCPATLSCSSCKTEYLKNSYLLEKWPKFSADFRAKTPSKLWLLKFSSKNFMKEVRKLNRL

SEQ ID NO: 187352 - protein, 159 aa, Triticum aestivum
  unsure (1)..(159): unsure at all Xaa locations
  Clone ID: PAT_TA_81770.pep
TCRELGIGIVAYSPLGRGFFSSGPKLVDTLSEQDFRKDLPRFQAENLEKNXHGYLERVSTMAARKGCTASAVALAWGHHQXGNDVCPIPXGTTKVRQLQTQNGGGLSRRPKRRWPTPTLPRSCRVIVDSPDTEVPEPSVTSFPGERGKNSCPNSPGKGR

SEQ ID NO: 187353 - protein, 66 aa, Triticum aestivum
  unsure (1)..(66): unsure at all Xaa locations
  Clone ID: PAT_TA_81771.pep
GTXXWXXPDXKTHXTVXYLNXGGAMVPVXVHTVLISXQHDETVTXXXIXADLMEHVIXPXXPKKYL

SEQ ID NO: 187354 - protein, 166 aa, Triticum aestivum
  unsure (1)..(166): unsure at all Xaa locations
  Clone ID: PAT_TA_81772.pep
MVAHRFHQYQVVGRALPTPGDEQPKIYRMKLWATNEVRAKSKFWXYFLRKLKEGEEGNGQDAPPSNEIFXEKEPTTIKEYGIWAGGTKSKTGYHNMYKEYRXDTTXNGGLEQVYTEMAXRTACCPCTKXSKMRRGXNCAKRDNTSXQHXKSVPAXYKRSPPPQVRH

SEQ ID NO: 187355 - protein, 52 aa, Triticum aestivum
  unsure (1)..(52): unsure at all Xaa locations
  Clone ID: PAT_TA_81773.pep
XXXQIHEMPGYXLSMCFYLLNKFPXKSCRKIMPCKKKKKKKKKKKKKKKKNS

SEQ ID NO: 187356 - protein, 132 aa, Triticum aestivum
  unsure (1)..(132): unsure at all Xaa locations
  Clone ID: PAT_TA_81774.pep
MVGLPGVDGLSTEQRKRLTIAVELVANPSIIFMDEPTSGLDARAAAIVMRAVRNTVNTGANXVVCTIHQTQALDISELLDDFLLMKRGGQVINAGXLGXILNKLSGIFGRNPXGLEKITQGYNPATWSWKPL

SEQ ID NO: 187357 - protein, 154 aa, Triticum aestivum
  unsure (1)..(154): unsure at all Xaa locations
  Clone ID: PAT_TA_81775.pep
VGFNVKNVAVKDLKRGFVASNSKDDPAKEAANFTSQVIIMNHPGQIGNGYAPVLDCHTSHIAVKFAELXVTKIDRRSXGKEWEALPKXLEXTGDAGYPSKMIPPXPWLWNFRHYLLLGXXLCRDMRQTVAVGXVXKGVGEEDPTGAKVQSCQEE

SEQ ID NO: 187358 - protein, 146 aa, Triticum aestivum
  unsure (1)..(146): unsure at all Xaa locations
  Clone ID: PAT_TA_81776.pep
XCLXLFLLXKWXFFVGIHLVPXPICCWXFDPYDARINMYSFPAKSLGCSPLTLIRRPQLRTQTGTLPFASMLARSRAKRVSMAQLAAGETKVRNILVLNIICILLLPFRRINYNPPSRRLVHINGHPCSQKTTHVIELHRGRLWIN

SEQ ID NO: 187359 - protein, 124 aa, Triticum aestivum
  unsure (1)..(124): unsure at all Xaa locations
  Clone ID: PAT_TA_81777.pep
ADPAKFLHLYELSIKVASGDEKIMANWFPMALNDGARSPESPRGXWVSSWEKMRGRFIRQLPRALNDHPPARVTCESVXQQQGETLQEXIQRXNNIPSKIXKVSRTFQGLTGWRSVSKMKESFQ

SEQ ID NO: 187360 - protein, 164 aa, Triticum aestivum
  unsure (1)..(164): unsure at all Xaa locations
  Clone ID: PAT_TA_81778.pep
MAGRKGGDRKKAVTRSVKAGLQFPVGRIGRYLKXGRYXQRVRSXAPVYLXAVLXEYLAAXXPGSLXGXAAXDNKKTRIIXRHLLLAVPQTTKSPEAVXGYPQHQSLLSQEIPAAAXKXAQIPKKKRRKSPRXRRTRIRPVHTMCPSIYKILEVVAEFQFQKGPE

SEQ ID NO: 187361 - protein, 86 aa, Triticum aestivum
  Clone ID: PAT_TA_81779.pep
IYAWVLQHLLEGTQNERKVRIQKIERRWAREWREYRYVTPKYMKKFALNPPCPRPPLAPSQIADPTSLKRGEDYPDEWAKRQAKLA

SEQ ID NO: 187362 - protein, 122 aa, Triticum aestivum
  unsure (1)..(122): unsure at all Xaa locations
  Clone ID: PAT_TA_81780.pep
SACCAPSSATTFAFSSLFKPPSWVTCGTASPSPVSCSSSHSSTAPVMGANDDVRRLRHRRLLRPGRLTVFEIHAVWDCQAHNEYLGXACHCTKLIDHLNQLLNGLLGFFYKKGESNLKTEMK

SEQ ID NO: 187363 - protein, 85 aa, Triticum aestivum
  unsure (1)..(85): unsure at all Xaa locations
  Clone ID: PAT_TA_81781.pep
LLHTCKVTPYVGSNNNVRLSXCLLIWDLQSXXPXFTXYGXIGADIHALXTISILRIFHYNILXSKLDSWALMEXXXRHNXXKQIL

SEQ ID NO: 187364 - protein, 108 aa, Triticum aestivum
  unsure (1)..(108): unsure at all Xaa locations
  Clone ID: PAT_TA_81782.pep
XQXSNPXANAPTXXTXRXTXPPSCPRXXAPXTXSSXXPHSXXYHPAAPSLFLPLCMRGCQYASVSITRTDPSSVFCFPCIKCTHIIECKXXXTVCATAXXXKKKKKNX

SEQ ID NO: 187365 - protein, 85 aa, Triticum aestivum
  unsure (1)..(85): unsure at all Xaa locations
  Clone ID: PAT_TA_81783.pep
GXMXTXEVDQQMINVQNKNSSYFVAXLPNTVKSSXCXIPPRGLSIASTFIXXXTIHPKIXSXXXTXXFXAMFXXKASCVTTIARN

SEQ ID NO: 187366 - protein, 128 aa, Triticum aestivum
  unsure (1)..(128): unsure at all Xaa locations
  Clone ID: PAT_TA_81784.pep
IVPHGPRVFFFYTQWTFLLVTIYFAVATAISAHGCWSYSKKSLRKADEYGDVENRDLSASISGDRKNGEIDKMXXYYEXIANXXRAAFWGXVXXXIIYQXNAGATMXLXDVXFWGXLXVPFFYXXKFG

SEQ ID NO: 187367 - protein, 141 aa, Triticum aestivum
  unsure (1)..(141): unsure at all Xaa locations
  Clone ID: PAT_TA_81785.pep
XLHXFXACSXXQXRLXSTXXISQVRXVXRESTQRMXXGXXXQXTXSSMMTKAAIXSGSRLNPALVLXXAAAHLPHGXIAXFLXGRXVEMRSFLAWRTRRKEEMRRGRREEVLSWXSGISXVXIYRPXSLFPSPXPRPVGRS

SEQ ID NO: 187368 - protein, 92 aa, Triticum aestivum
  unsure (1)..(92): unsure at all Xaa locations
  Clone ID: PAT_TA_81786.pep
DMSFLKXWKLGYCXPGXNLTTGXEKYVLKKSPGTSLPASYYISSVLFQNPRVNRXPTCIVYASVCNLGRXXTSCAVFFFWECYTHVEVPGRR

SEQ ID NO: 187369 - protein, 187 aa, Triticum aestivum
  unsure (1)..(187): unsure at all Xaa locations
  Clone ID: PAT_TA_81787.pep
LIYKLGGIDKRVIERFEKEAAEMNKRSFKYAWVLDKLKAERERGITIDIALWKFETTKYYCTVIDAPGHRDFIKNMITGTSQADCAVLIIDSTTGXGFEAGISKDGQTREHALLAFTLGXVKQMICCCNKMDATTPKYSKARYEEIVKESLLPEEGGYXPEKVLRPSLGQGDNMIEXQQPDGKGQPA

SEQ ID NO: 187370 - protein, 159 aa, Triticum aestivum
  unsure (1)..(159): unsure at all Xaa locations
  Clone ID: PAT_TA_81788.pep
ISNMSGLDSLQTIPEFKVSPLEGQEAKQLRYLNRLSGKLIISGLDSIKRREEAVEVDLAAKKLLTDLTLRIXGSSKVAAEVLEGXCPPVGLEELGNPMATKVWVYPKWDGWGKAKWVDQENCRNELKMEEPRLLLNWVGVSTFRNCITELDKPYGSTRN

SEQ ID NO: 187371 - protein, 96 aa, Triticum aestivum
  unsure (1)..(96): unsure at all Xaa locations
  Clone ID: PAT_TA_81789.pep
MAGSEAVPVVAVAAGKQPVNGSAMAGIDKLVTSTVGKSTNVLWHDCPIGQFERQELLXKKGCVVWITGLSGQGKXTLACALIATAPQRHLTYIPRR

SEQ ID NO: 187372 - protein, 89 aa, Triticum aestivum
  unsure (1)..(89): unsure at all Xaa locations
  Clone ID: PAT_TA_81790.pep
DQQRTHTHQPSQGKVAGERSARDVRPRKGGKGLGKXXAKXHXXVLLXNXQGIXXPAIRRXXRXGSXXRISVLIFXXTLXVLXIFLXXII

SEQ ID NO: 187373 - protein, 78 aa, Triticum aestivum
  unsure (1)..(78): unsure at all Xaa locations
  Clone ID: PAT_TA_81791.pep
XVRIRAAVVXMIPFXYSETCRDXTSDHNXFRNRISVXLXTTXIQKCIIXRIESQIYVQAEDATRPSCEKCAWXDRVIP

SEQ ID NO: 187374 - protein, 67 aa, Triticum aestivum
  Clone ID: PAT_TA_81792.pep
GGDGEGRRRDRGGGRGGGGHGGREGVVRGGRASAGGRQAETRRGGGRARLQGSRGGGSSCTRHHPQG

SEQ ID NO: 187375 - protein, 85 aa, Triticum aestivum
  unsure (1)..(85): unsure at all Xaa locations
  Clone ID: PAT_TA_81793.pep
MGGGNAQKSKMARERNLEKLKGGKGSQLEANKKAMNIQCKICMQTFICTTSEAKCKEHAXEAKHPKSTPPMFPHLXALISAKRRE

SEQ ID NO: 187376 - protein, 69 aa, Triticum aestivum
  unsure (1)..(69): unsure at all Xaa locations
  Clone ID: PAT_TA_81794.pep
MVKAVAVLTGSEGVKGTIFFTXEGRRGPTTVTGSVTGLKEGLHXFXVHALGDTTNGCMSTGPFPASCWT

SEQ ID NO: 187377 - protein, 162 aa, Triticum aestivum
  unsure (1)..(162): unsure at all Xaa locations
  Clone ID: PAT_TA_81795.pep
QSSYYVRYGGGANELSAGYSKGTGLAAEIIGTFVLVYTVFSATDPKRNARDSHIPVLAPLPIXGFAVFMGHLGTIPITGHRHQPKRRTWGAAVIYNTDKPGDDHXFWVGHCFGAAXPRLQLLEGNAPNFGPKRTNHPGRMNCNIKKCSKKSVPNTFPVNAPS

SEQ ID NO: 187378 - protein, 140 aa, Triticum aestivum
  unsure (1)..(140): unsure at all Xaa locations
  Clone ID: PAT_TA_81796.pep
VLQLKDMSGCSVEMTFWGNFCDAEGQQLQSLCDSGLNPILALKSGRXGEFNGKTVSTTSSXCXNKPXFPEAERLXQWYITEGKXLPALLYLGEMSSMGQXDSGKNAQFKDEPLGIXKPDWLTFKAFSPTNFTQQHKEVME

SEQ ID NO: 187379 - protein, 75 aa, Triticum aestivum
  unsure (1)..(75): unsure at all Xaa locations
  Clone ID: PAT_TA_81797.pep
WACFXFXQVTVKXRRNKERNVLGXCNVXSVXPVCLQYXPXGXVLXXTTKEXNXDRMXDLWDYGYXSNSXXNSCYF

SEQ ID NO: 187380 - protein, 89 aa, Triticum aestivum
  unsure (1)..(89): unsure at all Xaa locations
  Clone ID: PAT_TA_81798.pep
MSCNCGSGCSCGSDCKCGKMYPDLTEQGSAAAQVAAVXVVLGVAPEXNKAGHSEVGRRXSGKGALRRQCKCNPCNWLTASPLLRCWGIY

SEQ ID NO: 187381 - protein, 142 aa, Triticum aestivum
  unsure (1)..(142): unsure at all Xaa locations
  Clone ID: PAT_TA_81799.pep
MARTKQTARKSTGGKAPRKQLATKAARKSAPATGGVKKPHRFRPGTVALREIRKYQKSTELLIRKLPFQRLVREIAQDFKTDLRFQSSAVSALXEAAEDTWWGCXKDTTSAHHAKRVTSCPRTSSSQDRGLNPAPSVVSDCS

SEQ ID NO: 187382 - protein, 74 aa, Triticum aestivum
  Clone ID: PAT_TA_81800.pep
RHSPPALHPAVVPSYPPPESDNDESWVWSQIKAEARRDADAEPALASFLYATVLSHPSLERSLSFHLANKLWGG

SEQ ID NO: 187383 - protein, 44 aa, Triticum aestivum
  Clone ID: PAT_TA_81801.pep
VRRRHRDRQRQGVPEHPAHQGRAPQHPDPDLLLIQLNALASVVA

SEQ ID NO: 187384 - protein, 151 aa, Triticum aestivum
  unsure (1)..(151): unsure at all Xaa locations
  Clone ID: PAT_TA_81802.pep
MSTAEATREENVYMAKLAEQAERYEEMVEFMEKVAKTADVGELTVEERNLLSVAYKNVIGARRASWRIISSIEQKEESRGNEAYVASIKEYRTXRIETELSKICDGXLKLLDSHLVPSATAAESKVFYLKMKGDYHXYLAEFKQALRXKNS

SEQ ID NO: 187385 - protein, 100 aa, Triticum aestivum
  unsure (1)..(100): unsure at all Xaa locations
  Clone ID: PAT_TA_81803.pep
SSCFDLLVQRWAVNDICPYTHMGLHKGMITFKWHVLPKEEXXERXAGXAINXLNTTLLKPCIXXSGRIETKLXNWTXCHHXITXTHXKXVXITHIXLTEX

SEQ ID NO: 187386 - protein, 142 aa, Triticum aestivum
  unsure (1)..(142): unsure at all Xaa locations
  Clone ID: PAT_TA_81804.pep
MAPKADKKPAAENKVEKAAEKTPAGKKPKAEKRLPAGKTASKEAGGEGKTRGRKKGSKAKKGVETYKIYIFKVLKQVHPDIGISSKAMSIMNSFINDIFEXLAGESXKLARYNKNHITPGQTRRSSPGKCKQRSRKAHKLLS

SEQ ID NO: 187387 - protein, 105 aa, Triticum aestivum
  unsure (1)..(105): unsure at all Xaa locations
  Clone ID: PAT_TA_81805.pep
EEVTYSIVVSSIEATVTALWVMDXSWLNGFQCRFTVYSASMGQEEVLLPPMARFKLSRRVVSVESSEQLVVSVVAWRGGDRVATRRVFLTPEDAGRRYGELDMGF

SEQ ID NO: 187388 - protein, 69 aa, Triticum aestivum
  unsure (1)..(69): unsure at all Xaa locations
  Clone ID: PAT_TA_81806.pep
QTHYNIXIHKHAQLHVGSYSTCMSIMATRSVLLYLINFTLYNQNKRGKYNVGMMNLHTCMTKEVESPSL

SEQ ID NO: 187389 - protein, 110 aa, Triticum aestivum
  unsure (1)..(110): unsure at all Xaa locations
  Clone ID: PAT_TA_81807.pep
TFQKVVMLRAQRTSAPEQQPSLMKRFINWKDQTCNHTNKADRKLDPPKTSTDCIPRDPMETHLWTPSDDARRTTGTGIGRRRHYPTEXNRQLTHXLXNPQVIEDICXLFR

SEQ ID NO: 187390 - protein, 75 aa, Triticum aestivum
  unsure (1)..(75): unsure at all Xaa locations
  Clone ID: PAT_TA_81808.pep
SPAIVFILDKVAPFVPAPKEEPKAEPEAAAPXEEXTTREVAVXEEKEEEAEXSAXPXEAXPVEAAAPAAEVVXEI

SEQ ID NO: 187391 - protein, 134 aa, Triticum aestivum
  unsure (1)..(134): unsure at all Xaa locations
  Clone ID: PAT_TA_81809.pep
XRXKXKYLGELXKEXRXVXNKLYXRDGXRKNSKEALDXMMNLDPTLEVVKCLLDKHNEEHHLFEDLAYEVKQVVSYKAHFPENDSQYECRSFSHLNVLAKRGLNDNQNFSSLKSHAQMVNLRSMRLLVFGRFVR

SEQ ID NO: 187392 - protein, 160 aa, Triticum aestivum
  unsure (1)..(160): unsure at all Xaa locations
  Clone ID: PAT_TA_81810.pep
GGLQPRETGNAACGRSNQGPHCGTSRDNAPLVARKFYLGTHFPGCVCAXRNLLSRTNKXLYIVCQXVSFNCPIRLKLVNGKVKTSCHDTSWDSFQLLEIPTTGWTTETLYLLVXCHVLADVXQIQWDFLXNHXHATXHTRCISVNWYNHGNHXGXTXFXX

SEQ ID NO: 187393 - protein, 112 aa, Triticum aestivum
  unsure (1)..(112): unsure at all Xaa locations
  Clone ID: PAT_TA_81811.pep
QRRTVFLNEGSHNRRGSIAPPSPFLAASHRXRPPAASRRRTPPTSRRTSSTSHGSAASPSLLPQPSPQPRIDKALMPTLPLLAAPSPSSWLSLTAQPSLLWFISNTHHGRNS

SEQ ID NO: 187394 - protein, 130 aa, Triticum aestivum
  unsure (1)..(130): unsure at all Xaa locations
  Clone ID: PAT_TA_81812.pep
ARGGTAATAAAAAKGKKKGSVSFVIDCTKPVEDKIMEIASLEKFLQERIKVAGGKAGNLGDSVTVTRDKSKVTVTSDGAFSKRYLKXLDKEYXEEHNVRTXVXVIAANKDXNVYDSRYFNIAGNEGEEEI

SEQ ID NO: 187395 - protein, 33 aa, Triticum aestivum
  Clone ID: PAT_TA_81813.pep
LALRIPIRSVVVQNHITGYWDSQAPRHVRTTSA

SEQ ID NO: 187396 - protein, 129 aa, Triticum aestivum
  unsure (1)..(129): unsure at all Xaa locations
  Clone ID: PAT_TA_81814.pep
KDWKGLRVTVKLTVQNRQAKVSVVPSAAALVIKALKEPERDRKKVKNIKHNGNISLDDVIEIAKIMKVRSMAKEMAGTVXKEILRHLRQASGCTVXDGKDPKGFGRRRFDDGEVGDSPLKEGLVLGEVC

SEQ ID NO: 187397 - protein, 62 aa, Triticum aestivum
  unsure (1)..(62): unsure at all Xaa locations
  Clone ID: PAT_TA_81815.pep
MGKEKTHINIVVIGHVDSGKSTTTGHLIYKLXGGIDKRVIERFXEKEAAEMNKRLSKYAWVL

SEQ ID NO: 187398 - protein, 176 aa, Triticum aestivum
  unsure (1)..(176): unsure at all Xaa locations
  Clone ID: PAT_TA_81816.pep
ESSDTIDNVKAKIQDKEGIPPDQQRLIFAGKQLEDGRTLADYNIQKESTLHLVLRLRGGMQIFXVRPWTGKTITLEVEPPDTIRQRQRPKIQGQRRASPPDQAAPPLLPGKQSEDGVPLLDLQHPKKXPPSHLGVRFXGGMQSFVQTLDGQTITLELEPXDTIXQREXKFQDKEPS

SEQ ID NO: 187399 - protein, 121 aa, Triticum aestivum
  unsure (1)..(121): unsure at all Xaa locations
  Clone ID: PAT_TA_81817.pep
GKSFILXIFITPSIXGDRLKQLPGTHATHNIHTKDTMGRAWESGASKPHAHAHAPLLGLHQIRRSLFTYTLTPTHVRTSACSLTVAGVALAVVAAAAALAGLPGGHLELPRLVLRRHAEDD

SEQ ID NO: 187400 - protein, 158 aa, Triticum aestivum
  unsure (1)..(158): unsure at all Xaa locations
  Clone ID: PAT_TA_81818.pep
LDRYKGHVNGAGMNVSTDSSEDKESNNSDEKPSEFTSVESEDTVSGMLYDMLQKEVVALRKACHEKDQSLKDKDDAXEMLAKESPTLLTKGDGVQRLKKMETGMVSWPWEKEVGGLWRFRERARITKGKEVPAPSASCQQHKSTWEALPPSNTQHVMV

SEQ ID NO: 187401 - protein, 110 aa, Triticum aestivum
  unsure (1)..(110): unsure at all Xaa locations
  Clone ID: PAT_TA_81819.pep
AKDNKKSRIVPRHLLLAIRNDXELGRLLSGVXIAHGGVIPNINPVLLXKKAAEXKAEKAEKDRHQVRPKKATKSPKEGHQRRSSGSRAPFPELGLDGVPFSLPFSVSPGV

SEQ ID NO: 187402 - protein, 105 aa, Triticum aestivum
  unsure (1)..(105): unsure at all Xaa locations
  Clone ID: PAT_TA_81820.pep
EFKLKTIRRLTEIEDDSYVVVHVMDVTDGIVYLRTAYDGYTEVPQLLLSFCLETAELKKICEYDHKLHPYVMGMGLLLWVRKYMDKGPKWIYSVYPXAPRKEADC

SEQ ID NO: 187403 - protein, 157 aa, Triticum aestivum
  unsure (1)..(157): unsure at all Xaa locations
  Clone ID: PAT_TA_81821.pep
IPGKKFYWEAXLPGSSSFETXSXPSTKSNPXNWERNGVQGPPFGEGGRASETKERLXAKLNRRSRRCGGTGGIGGPSREAGAPLVFTAGASSSPPPAPLRMVDRRRGAGAGEGSMAPSSSMRSSSSESKSTASTSVFIAAAAIAAAAAGVGFGSGFG

SEQ ID NO: 187404 - protein, 68 aa, Triticum aestivum
  Clone ID: PAT_TA_81822.pep
CCSSLWRSCSRCSPSPSSSPTVTSPPPAERRGLTISCGESVDERVSSFAEAARGGTDADVDRRSIMRS

SEQ ID NO: 187405 - protein, 104 aa, Triticum aestivum
  unsure (1)..(104): unsure at all Xaa locations
  Clone ID: PAT_TA_81823.pep
MAPVKLYGATLSWNVTRCVAALEEAGVEYELVPINFGTGEHKSPDHLXPRNPFGQVPALPGWVTYVLRIHLAILQSMPARQRTSPELGRHPKESKQWVDVLPKG

SEQ ID NO: 187406 - protein, 155 aa, Triticum aestivum
  unsure (1)..(155): unsure at all Xaa locations
  Clone ID: PAT_TA_81824.pep
DYNIQKESTLHLVLRLRGGMQIFVKTLTGKTITLEVESSDTIDNVKAKIQDKEGIPPDXQQRLIFAGKQLGGWPAPFARLQHPKKPLSTGAPSSRWWVCKILPVKDPPTGKDHHPLEVLSPSDTIPTTVRPKISDQGISPPTKQRPLSFPRQAAF

SEQ ID NO: 187407 - protein, 137 aa, Triticum aestivum
  unsure (1)..(137): unsure at all Xaa locations
  Clone ID: PAT_TA_81825.pep
RTLQLGAMILVWYLLNIYFNIYNKLVLKAVPFPYTITTFQFASGSFFITLMWLLNLHPKPRLSLQQYAKILPLGLXHMMGNVFTNMSLXKVAVSFTHTIKGHGAFFSVPFSILAPPGRHLPLLGSSPPCRSGSLASD

SEQ ID NO: 187408 - protein, 97 aa, Triticum aestivum
  unsure (1)..(97): unsure at all Xaa locations
  Clone ID: PAT_TA_81826.pep
SXYCXXFVDGPLXPYXHNGVFPLSLDXRQDELSQTLFPLQEINLLANPTXVSWRGYEVLKIMLKVFRELKYXHWRDLIITRIHRDPKKHXAKSRDIK

SEQ ID NO: 187409 - protein, 197 aa, Triticum aestivum
  unsure (1)..(197): unsure at all Xaa locations
  Clone ID: PAT_TA_81827.pep
LGSGAVQREREPERGMEWGESILYSNGLGAPAAPYAAHPSDTEYKVRMKPERPALXILPKGAPHKHKRRPRYLGVPQFGNRKNKKHQGLAAVSPWGCAATPGGNXSLQYGRTLLRRPTEXXPNSARHYQLRSNPXTXTSCLLRHLRPXEXSXPXHXXXINXXMXKFGXXXNGLKCAKXHXKXSKVEKYXYNCXXQXG

SEQ ID NO: 187410 - protein, 45 aa, Triticum aestivum
  unsure (1)..(45): unsure at all Xaa locations
  Clone ID: PAT_TA_81828.pep
KKYMRVNISRVKLIKHDYMYVRTNAIKQAIKVASXPCTLQHPRFF

SEQ ID NO: 187411 - protein, 82 aa, Triticum aestivum
  Clone ID: PAT_TA_81829.pep
FFFFDRAPTSSKHHKVHQDEMQRRSKSLSLYCYTQKKEACRQLKHDWLWPTAMPCMHANTTHGYLLACLPTTILRPYALDRT

SEQ ID NO: 187412 - protein, 63 aa, Triticum aestivum
  unsure (1)..(63): unsure at all Xaa locations
  Clone ID: PAT_TA_81830.pep
MPRCPRRMFESATKYLLSKLKDLQFFVGESMHDDGGVVXAYXKEGAAXPXFXYFAHGLKEVKC

SEQ ID NO: 187413 - protein, 37 aa, Triticum aestivum
  unsure (1)..(37): unsure at all Xaa locations
  Clone ID: PAT_TA_81831.pep
AAGYTSRFGLYFXDYNDXLKRYPKSSVQWFKXLLSSS

SEQ ID NO: 187414 - protein, 87 aa, Triticum aestivum
  Clone ID: PAT_TA_81832.pep
GKGRMSPKWKEMRERERERERERPLQPLLGCCFSILSSLQLFAFETELLECTRIPNKKIQMQLKPTEAFWELHLIIFALNTRISSQV

SEQ ID NO: 187415 - protein, 99 aa, Triticum aestivum
  unsure (1)..(99): unsure at all Xaa locations
  Clone ID: PAT_TA_81833.pep
RCYSSRSGQVHHAAATAHPEATRPATMGDADRRVAGPAGPTGRLRRRQLQGLGDVAVVVLFIALHVLLSFDVVFKKAKKLMPNKCFQSRMIIXDKLTIA

SEQ ID NO: 187416 - protein, 77 aa, Triticum aestivum
  unsure (1)..(77): unsure at all Xaa locations
  Clone ID: PAT_TA_81834.pep
NPIVCDESPXXEQGVXAEASSAGPSXENXXALXWRQNTGLRTHECTGQKIXKNDQEXKEHNXXLCKTRHGIKILEEK

SEQ ID NO: 187417 - protein, 159 aa, Triticum aestivum
  unsure (1)..(159): unsure at all Xaa locations
  Clone ID: PAT_TA_81835.pep
TVRGRPSPRQFQLSIFMAPDGRHQDAPVKLTDSPRVRLLPLADQAPLPASIPTLPRILVSXGPTWDWLNLDPGKQIXLPRQPKCQSYNPQAVFGWQFIXCPDXREPKTTAIGNLASQRKXGFATWEXKSEQXPXLXQLKSSPLXPXTWVFPXKFXXFKI

SEQ ID NO: 187418 - protein, 173 aa, Triticum aestivum
  unsure (1)..(173): unsure at all Xaa locations
  Clone ID: PAT_TA_81836.pep
GEESCERQLEVEEGAALRGGGANNWHQSFVDPWRRRRCRWLWWPALAPGREVMAGSGAMPPGGRXAVRCRRDEGGAMIRRPPRTSIHRTKMVPXXDPALXXASRXLRXPTFNAQXWEARXXPRKEDLVGQCPCXLMFXXIGGCQNFPTXKIPXFIPTTXGFYXTPTXXENLXX

SEQ ID NO: 187419 - protein, 141 aa, Triticum aestivum
  unsure (1)..(141): unsure at all Xaa locations
  Clone ID: PAT_TA_81837.pep
FFPGSPDFESGWPTPSQSSVMMLTSNQAAPAYSSRKYSRCLLLELASWAAFSFPWPSPFLLLGSLVLDDGSFLHSNRKTLDWSLQKSWDKKSKSVPFIPNWDTFPXWPHPFGSLIQLPWNPMGSISHTPFFPKPGWXPSLG

SEQ ID NO: 187420 - protein, 156 aa, Triticum aestivum
  unsure (1)..(156): unsure at all Xaa locations
  Clone ID: PAT_TA_81838.pep
MARTKQTARKSTGGKAPRKQLATKAARKSAPATGGVKKXHRFRPGTVALREXRKYQKSTELLIRKLPFQRLXVREIAQDFKTDLXRSKSSAVSALQEAAEAYLRRVFXDTNXCAIHAXRVTSCXKDIQXARXIXGXRAKICLLSSDNRRGSSCKWV

SEQ ID NO: 187421 - protein, 53 aa, Triticum aestivum
  Clone ID: PAT_TA_81839.pep
GNREVLEAGERNFNRFGGWLGKYSTTNKNKRLLEDVHSHILASQQANLDREGV

SEQ ID NO: 187422 - protein, 123 aa, Triticum aestivum
  Clone ID: PAT_TA_81840.pep
LNLDFQLQEGGRKLKVDAWFGTRKTMAAIRTAISHVQNLITGVTKGFRYKMRFRGTPTSPSNASITAAKPPASEDLRNFPPGEERRLRKLDIAPDRGPSLAVPEKVPRMKFSLNGNDIQLFSP

SEQ ID NO: 187423 - protein, 106 aa, Triticum aestivum
  unsure (1)..(106): unsure at all Xaa locations
  Clone ID: PAT_TA_81841.pep
GVKKPHRYRPGTVALREIRKYQKSTELLIRKLPFQRLVREIAQDFKTDLRFQSHAVLALQGGGPRRTSVRAVRRTPTWCAIHAKPRXPSCPKDIQAPGRIPLAKRA

SEQ ID NO: 187424 - protein, 107 aa, Triticum aestivum
  unsure (1)..(107): unsure at all Xaa locations
  Clone ID: PAT_TA_81842.pep
HLQPAPSPSPQIRSPARRDGGEQAQGGQAPGADERPPRHRRRQGDRQQGPASVYQLKHLRPKKDGRLTXKIFLRXTSKKGRRPPTREITRGTPXTXAXNLLTXRKFP

SEQ ID NO: 187425 - protein, 86 aa, Triticum aestivum
  unsure (1)..(86): unsure at all Xaa locations
  Clone ID: PAT_TA_81843.pep
KFXWQGSLXXVSGGKFREQGXGXXKXAIGGXGRIXEKGQATSSSWKDXTGISKGALLNGIPFSHLPLVSFRRSKACSRFLKTATFT

SEQ ID NO: 187426 - protein, 104 aa, Triticum aestivum
  unsure (1)..(104): unsure at all Xaa locations
  Clone ID: PAT_TA_81844.pep
LGRIPSAVGYXPXLATDLXGLQERITTTKKGXITSVQXAIYVPADDLTDPAPGYHLCPSLDATTVLSTXRFPELGHFPWLSDSFWDSHIPRMFSSPQRSWVLGN

SEQ ID NO: 187427 - protein, 108 aa, Triticum aestivum
  unsure (1)..(108): unsure at all Xaa locations
  Clone ID: PAT_TA_81845.pep
MKGTKLAAILILQAVLVMGVLSHVNADYFPKCCNNCRSFSGVXDVCDDAHPKVPXRAAAFPPCTSPRNVAAPGLNPNRFNGTLPVGPLPRSYWIGPNAQAIICFPPLN

SEQ ID NO: 187428 - protein, 59 aa, Triticum aestivum
  Clone ID: PAT_TA_81846.pep
KKWSKGKQKEKVNNAVLFDQATYDKLLTEVPKYKQITPSVLSERLRINGSLARRAIKDI

SEQ ID NO: 187429 - protein, 67 aa, Triticum aestivum
  unsure (1)..(67): unsure at all Xaa locations
  Clone ID: PAT_TA_81847.pep
LVLRIAVLCTAKSPKDRPTMRDVVTMLAEAKPRRKXSSSATVVATVXVHKDKPVFKHVRPDSRLPVS

SEQ ID NO: 187430 - protein, 108 aa, Triticum aestivum
  unsure (1)..(108): unsure at all Xaa locations
  Clone ID: PAT_TA_81848.pep
XPPGRGIPVXXVPTXAYPXXTSNLPXGSPWNECPQGEGIGLWQASGWXGRSCLPLXMPAXHGSTPCALLPGEMPXTEVMKAFMSSVARPCSFEGSVVGVGLNQQVAVC

SEQ ID NO: 187431 - protein, 79 aa, Triticum aestivum
  unsure (1)..(79): unsure at all Xaa locations
  Clone ID: PAT_TA_81849.pep
MSCNCGSGCSCGSDCKCGKMYPDLTEQGXSAAAQVAAVVXSSGVAPEEQGGAFQVAARAVPAKGCSCGDNCKCKPPANC

SEQ ID NO: 187432 - protein, 129 aa, Triticum aestivum
  unsure (1)..(129): unsure at all Xaa locations
  Clone ID: PAT_TA_81850.pep
QTIRHMIEDDCADNGIPLPNVNSKILSKVIEYCNKHVQAKPADGAAAGAGAGASDAAPAAPAEGXLKNWGRPSSSKVRPRPPSFDLILGLPNYLEHQRAAWTLPCQTVAXDIIQRAKPPXEFRXXFKSN

SEQ ID NO: 187433 - protein, 115 aa, Triticum aestivum
  unsure (1)..(115): unsure at all Xaa locations
  Clone ID: PAT_TA_81851.pep
AEPDVCSEGLSGLKFSFGLTPNDKKEESDGTDKGEIRQIAEKMDRIVSFDHPVQSNDDKAAYESPCSDDRNSQGSKYVKRSAVPXLGKTNLLVXERXEKRESPXIDCSTPTGSLG

SEQ ID NO: 187434 - protein, 120 aa, Triticum aestivum
  unsure (1)..(120): unsure at all Xaa locations
  Clone ID: PAT_TA_81852.pep
PNLVMAYNGWRSGEMRYGESPTAPITRSASNYHGATTYGTTHYPHPGSDHTLPLFRAQARPKSNGDSRLIVGEYELDDVAXELNYDPTWVKHDVHAPWAYHLYGCHTNRGVFNLHAYIGL

SEQ ID NO: 187435 - protein, 98 aa, Triticum aestivum
  unsure (1)..(98): unsure at all Xaa locations
  Clone ID: PAT_TA_81853.pep
MAPKAAEKKPVEKTPAGKKPKAEKKVPASKEGGXXXGKKKAKKSVETYKIYIFKVLKQVHPDIGXXSKXXIMNPFINDIXXXXAGESAXFGGXNXEPP

SEQ ID NO: 187436 - protein, 166 aa, Triticum aestivum
  unsure (1)..(166): unsure at all Xaa locations
  Clone ID: PAT_TA_81854.pep
PRNQDAGLAELPATVAALKNPNSKILYDQYNHERYPPGDPSKRAFAYFVLSGGRFVYASLLRLLVLKFVLSMSASKDVLALASXLEVDLSSIEPGSTVTVKWRGKASSSRRRTDDDIKLANSVDVASLRHQEQDLSIERPRVVVVLVPHHWVDPLPIREGVVCHGP

SEQ ID NO: 187437 - protein, 102 aa, Triticum aestivum
  unsure (1)..(102): unsure at all Xaa locations
  Clone ID: PAT_TA_81855.pep
MKSTKLAAILILQAVLVMGILSHVNADYFPKCCNNCRSFSGVDVCDDAHPQCPKGCSACRVVTPSLTRRSGCADMKRPSDGTCGXHARXLIRSVQGQDECAA

SEQ ID NO: 187438 - protein, 112 aa, Triticum aestivum
  unsure (1)..(112): unsure at all Xaa locations
  Clone ID: PAT_TA_81856.pep
IIKHTMEIIHLLTDANPIQIIVDAIINSGPREDATRIGSAGVVRRQAVDISPLRRVNQAIYLLTTGCQGRALXGTSKTIAXEXLADELINAAKGSXNSYAIXEEDELSVCPR

SEQ ID NO: 187439 - protein, 96 aa, Triticum aestivum
  unsure (1)..(96): unsure at all Xaa locations
  Clone ID: PAT_TA_81857.pep
XTMGWXXFLMSAMDGHPKIDQRCLEVESPRXTSWSLIAGSAIPSCRGRAATAVLAACSLTDDVLELPAVPQRAALGEGIGGGAGEEEDKADAETQK

SEQ ID NO: 187440 - protein, 46 aa, Triticum aestivum
  Clone ID: PAT_TA_81858.pep
GAAIIYNKKQAWDDHWIFWVGPFIGAALAAIYHVVVIRAIPFKSRD

SEQ ID NO: 187441 - protein, 182 aa, Triticum aestivum
  unsure (1)..(182): unsure at all Xaa locations
  Clone ID: PAT_TA_81859.pep
MAEQTFIMIKPDXVQRGLIGEVISRFEKKGFYLKGLKLQNVXKSFAEQHYSDLSSKPFFAGLVEYIVSGPVVAMVWXGKSVVATGRXIIGATXPLXSEPGTIRGDFAVTXXRNVIHGXTXFXSAXKESPVVPXGIAXWRATANCLAKMFMVDEVRTIVVFFTWNFVLNTLEKTKIRKGGFRL

SEQ ID NO: 187442 - protein, 74 aa, Triticum aestivum
  unsure (1)..(74): unsure at all Xaa locations
  Clone ID: PAT_TA_81860.pep
LXSSLXAXVXXXHLXXTXAAXRWGTKLQSFCVXLXGSPDLKAXXXXPNXLGTMXHXFTFTXXDGIDAIEDVIYH

SEQ ID NO: 187443 - protein, 66 aa, Triticum aestivum
  Clone ID: PAT_TA_81861.pep
KIEWDGYSKGRTKCLREEANQSEWRQGKESRPGPVAMPLTRMGVTFLYHRKRYEMDPHSPLLFFCN

SEQ ID NO: 187444 - protein, 106 aa, Triticum aestivum
  unsure (1)..(106): unsure at all Xaa locations
  Clone ID: PAT_TA_81862.pep
FPXSLXNTATGMMAMIVXLGFYLXTALINVXQRATAWLPXNMNXSKLENLYWLLTVLVAVNFGCFLTCAKAVHPGTCKLKLRTQHSLIHMHVCLLKYVGFGHLSGT

SEQ ID NO: 187445 - protein, 138 aa, Triticum aestivum
  unsure (1)..(138): unsure at all Xaa locations
  Clone ID: PAT_TA_81863.pep
RQRQLRFAGDARGRMAPYLLRSAVAILRGSTPPSTFLRRSPIDSSRFFASGGAVRVEPAKACCMACTEMEADLEMVAVNTRLRALEEKLDILEEHERRFQRXERFQKKLACVLXPATSPCMCLVXRRXQXRIRHLLRP

SEQ ID NO: 187446 - protein, 116 aa, Triticum aestivum
  unsure (1)..(116): unsure at all Xaa locations
  Clone ID: PAT_TA_81864.pep
TTKPISPEKEASTMSGRGKGGKGLGKGGAKRHRKVLRDNIXGITKPAIRRLARRGGXKRISGLIYXETRGVLKIFLXNVIRDAVTYTEHARRKTVTAMDVVYALKRXXRTLYGFGG

SEQ ID NO: 187447 - protein, 127 aa, Triticum aestivum
  unsure (1)..(127): unsure at all Xaa locations
  Clone ID: PAT_TA_81865.pep
SERLTQICAEGQAWIRVAKSHEAVAAGLQATLDQLLQSPCAAVAATGADGDGDAEDARSCCFETPAGDDAAASKASAAACXACGXGESCVLLLPCRHLCLCXACDAAVDTCPXCATTMNASLHVLLS

SEQ ID NO: 187448 - protein, 154 aa, Triticum aestivum
  unsure (1)..(154): unsure at all Xaa locations
  Clone ID: PAT_TA_81866.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIRTRRAFPRDQQRLIFAGKQXEDGRTXADYNIKRSQPQLVLRXVWMQIS

SEQ ID NO: 187449 - protein, 93 aa, Triticum aestivum
  unsure (1)..(93): unsure at all Xaa locations
  Clone ID: PAT_TA_81867.pep
XXGXXRXNGNLXVXHXKKHRMGNVAIPGNFXTXLFPETNMRKXRELGQKVLTQMCLLVFCXKPCLVVXXXDXXPXPXISXLTXXIFXTPIXYT

SEQ ID NO: 187450 - protein, 84 aa, Triticum aestivum
  unsure (1)..(84): unsure at all Xaa locations
  Clone ID: PAT_TA_81868.pep
LRPLHNFRELEWSRATLVHCNWCLLHIESLKEYDAALEGGFSQSVLLSERXWGHITLLSLACLCLGRVIEAFTCYRXTVMKAQV

SEQ ID NO: 187451 - protein, 84 aa, Triticum aestivum
  unsure (1)..(84): unsure at all Xaa locations
  Clone ID: PAT_TA_81869.pep
IVXFLGXTNRSSYXAHGEXTKLXCXLGFRSXIQXGACIXKRNXXFXLXPSXGPXXRGXIFPXXQXXXLRLPRKNQXXKXFENPL

SEQ ID NO: 187452 - protein, 73 aa, Triticum aestivum
  unsure (1)..(73): unsure at all Xaa locations
  Clone ID: PAT_TA_81870.pep
SDTKRKGHKVYFMSHGXQSCSLFPSEVNIFXQRSLQEIASHRFLRLVRTRKLCTFFYLIADIVLILEMIFGRW

SEQ ID NO: 187453 - protein, 108 aa, Triticum aestivum
  Clone ID: PAT_TA_81871.pep
SYYESLIISVFSGQVSVETNHFYLLSSPHQTQLLCFAGGRRIRSMTQHPTVTMLATSIGSRHRSSLSPHHPARAAHGLVTPSDRLPAAEICSRVRTTSAMDGRSAGLS

SEQ ID NO: 187454 - protein, 83 aa, Triticum aestivum
  Clone ID: PAT_TA_81872.pep
SECARAPLLRLIVRIGSQVLYCTPRLGFFSPFPHGTCTLSVIEEYLGLEGGPPFSRKSDHHSNTPRFTGKDRTMGTNEQGYHL

SEQ ID NO: 187455 - protein, 118 aa, Triticum aestivum
  unsure (1)..(118): unsure at all Xaa locations
  Clone ID: PAT_TA_81873.pep
LNMTNLWLHGKEHIAASFSQAEQSSEAVETSRKSFGQRSRSSPVPDDDCXLVLGLGPMPNLYSADSQSSGGNKVKLSGILFTQHCTASDPGLLGGDFKRQLKEICSPQHCLGRKEHSQ

SEQ ID NO: 187456 - protein, 206 aa, Triticum aestivum
  unsure (1)..(206): unsure at all Xaa locations
  Clone ID: PAT_TA_81874.pep
QRQRRILKQRLKVPPALHQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFXKIXKLLRXTXRQIDEVRRXGXGVWAQIQAKTRQGKLSKGGPRQLVTYMLINVRC

SEQ ID NO: 187457 - protein, 48 aa, Triticum aestivum
  Clone ID: PAT_TA_81875.pep
IFNIIRWEEERKKLNNSTWSHATDRSRSTLVSYQSFHGGSSAEGGSLL

SEQ ID NO: 187458 - protein, 69 aa, Triticum aestivum
  unsure (1)..(69): unsure at all Xaa locations
  Clone ID: PAT_TA_81876.pep
PTSSGPRPRPPPPPPXWQHPGPPVSSSPVRRLRPXRXSTSRXSELXXXERLXXXSPCKLXXRVGHAPXA

SEQ ID NO: 187459 - protein, 74 aa, Triticum aestivum
  unsure (1)..(74): unsure at all Xaa locations
  Clone ID: PAT_TA_81877.pep
AGXAFXGASMNPAVSFGPAVVSGVWENHWVYWLGPFXGAAIAALVXDIXFIGQRPHDQLTNRRKSISSRRVITM

SEQ ID NO: 187460 - protein, 98 aa, Triticum aestivum
  unsure (1)..(98): unsure at all Xaa locations
  Clone ID: PAT_TA_81878.pep
XDXDLSAXKSFLLGCSLDVYXVIGILHXFPGLVQSIRXVPIPENVTCPNLXFHLQAKVRTPFFLXQIRHXGEPLAAASSSSRSFLEVLIGAGASGSWT

SEQ ID NO: 187461 - protein, 143 aa, Triticum aestivum
  unsure (1)..(143): unsure at all Xaa locations
  Clone ID: PAT_TA_81879.pep
ERRPCLSRMCTTSLGSTRTWSPAASSAKLGYTITLRPFXSAASPKNDXEPRPLWGWSIXPNDYLFXSWASLKGPXLQPGWXVLLPGXXPTGVVLXCLXNXSWXSMXXICKXXQPCWXNXXKGXXYSXXWXVLXNNGXKKPXXF

SEQ ID NO: 187462 - protein, 81 aa, Triticum aestivum
  unsure (1)..(81): unsure at all Xaa locations
  Clone ID: PAT_TA_81880.pep
EVYPLFAATGVAIGICAFSLLRNITGNPEVRVNKMGXRAAGVLENHEEGRRYAEHGLXRAYVQDKTPEIMPGINXSSTSPK

SEQ ID NO: 187463 - protein, 130 aa, Triticum aestivum
  unsure (1)..(130): unsure at all Xaa locations
  Clone ID: PAT_TA_81881.pep
RKSTGGKAPRKQLATKAARKSAPATGGVKKPHRFRPGTVALREIRKYQXKSTELLIRKLPFQRLVREIXQDFXTDLRFKSSAVSALQEAAEAYLVRLFEDTTSAHPRKRVTSCPRNQLAEQKAKLSFSEV

SEQ ID NO: 187464 - protein, 138 aa, Triticum aestivum
  unsure (1)..(138): unsure at all Xaa locations
  Clone ID: PAT_TA_81882.pep
LADYNIQKESTLHLVLRLRGGMQIFVKTLTGKTITLEVESSDTIDNVKAKIQDKEGIPPDQQRLIFXAGKQSEDGRTLADYNTRRXXTLHLGAQVPXGGMQISVKDVNRQDITWEVGXSGHXDXCEGKXQDKEDPPGQ

SEQ ID NO: 187465 - protein, 123 aa, Triticum aestivum
  unsure (1)..(123): unsure at all Xaa locations
  Clone ID: PAT_TA_81883.pep
MSLIAGEEFQHILRVLNTNVDGKQKIMFALTSIXGVGAASPTSVCKKADIXTLNKRAGXFPAEEIXTALMAVXVHNPRQFXGAXTWSSXRKKIIKTVSQSRLPTPFDINSRMTQRSLRTSWLH

SEQ ID NO: 187466 - protein, 85 aa, Triticum aestivum
  unsure (1)..(85): unsure at all Xaa locations
  Clone ID: PAT_TA_81884.pep
IAXWFPSIHPSLSLVAMXLXXDLVVAWPXMXGGKKGGRDRKXXQERTDRKXGTGMXGXAKNGGRGXXFTXEGAXXYTXXDLNLVA

SEQ ID NO: 187467 - protein, 145 aa, Triticum aestivum
  Clone ID: PAT_TA_81885.pep
MRTLISKGKIFPVHRVANEVQIEKIDSINALGPLTHSRATQLANFCGHFAYFSISEPKRVDEAFMEPWIQAMQEELQQFELNVWELVKRPDPRKHNVGTKWIYCNKQDEHGQVVRNKARLIAQGYAQVEGIDFDETFAPVARLEA

SEQ ID NO: 187468 - protein, 68 aa, Triticum aestivum
  unsure (1)..(68): unsure at all Xaa locations
  Clone ID: PAT_TA_81886.pep
TQFFLGSCLTFDSKYXLFCYKVDRTXTLLPHLNFCVYFLVHGADLAHTKISXPSSATDQKDKWHNLXK

SEQ ID NO: 187469 - protein, 131 aa, Triticum aestivum
  unsure (1)..(131): unsure at all Xaa locations
  Clone ID: PAT_TA_81887.pep
GGGGARRGEARRPSPSSQPWLGVLKKHPERRLNAPSHWMLDKLGGAFAXKQSSGPXKARXCLXLILILRNRLKYAPTYRXVQSXLMQRHIXVDGXVXTXKXXPXGSRXIISIPXXGEKXRXRXXTKGPFRP

SEQ ID NO: 187470 - protein, 90 aa, Triticum aestivum
  Clone ID: PAT_TA_81888.pep
YSTQKIYCEKYDKRSANTHFAHEILDRLCITTCISQRLVHLPTMTESDKVIPLHHQNPHCLSYCSLLPILPLFGCDSSQAILGICWCIQC

SEQ ID NO: 187471 - protein, 140 aa, Triticum aestivum
  unsure (1)..(140): unsure at all Xaa locations
  Clone ID: PAT_TA_81889.pep
LFLXTNXIGLVEXXSLAILXPNVXEYKRLVXKVLNCDVNEEXASDQLTALCQKIXXVTIMXXGKXXVIXDGXXVTHXXVPLXSPRXCGXQGDIXLEXWHYFXQXTTFSVSITVIQSVQSWSPLKKWLWKDKANDKLVLKL

SEQ ID NO: 187472 - protein, 136 aa, Triticum aestivum
  unsure (1)..(136): unsure at all Xaa locations
  Clone ID: PAT_TA_81890.pep
MAAAAQRLLAASTKIVGVGRNYVAHAKELXGNPVPKERVLFLKADLRRSSTQGVAPPPSXVPGALXXLHNEVGVAVXVISTEXSXTARXSXMDSXGGNXLLLXMTXRTSXRXXSKXLPWTXXKRKGYFXQLGSKAT

SEQ ID NO: 187473 - protein, 136 aa, Triticum aestivum
  unsure (1)..(136): unsure at all Xaa locations
  Clone ID: PAT_TA_81891.pep
KTPAGKKPKAEKRAPASKEAGGEGKTRGRKKGSKAKKGVETYKIYIFKVLKQVHPDIGISSKAMSIMNSFINDIFEKLAGESAKLARYNKKPTITSREIQXTSVRLVLPGELAKHAVSXGXKAVTKLTHPRLRRCS

SEQ ID NO: 187474 - protein, 99 aa, Triticum aestivum
  unsure (1)..(99): unsure at all Xaa locations
  Clone ID: PAT_TA_81892.pep
MSDTDEHHFESKADSGASKTYPQQAGAIRKGGHIVIKARPCKVVEXSTSKDWGSMGHAKCHFXCHLTSLNGKRSXRISXLXPKTXDXPHVDRQDYQVDT

SEQ ID NO: 187475 - protein, 106 aa, Triticum aestivum
  unsure (1)..(106): unsure at all Xaa locations
  Clone ID: PAT_TA_81893.pep
MSDLDVQXPTAFDPFCRRQMVGNLVXLAGLKXXVQXXIQQXNXPXSLXTVXGLXKEXSYSKILKGPQRKSLLNGYNXVQDTELGXVXQLQGDXEEXLSNFLVKAGX

SEQ ID NO: 187476 - protein, 83 aa, Triticum aestivum
  unsure (1)..(83): unsure at all Xaa locations
  Clone ID: PAT_TA_81894.pep
FKVLKQVHPDIGISSKAMSIMNSFINDIFEKLAGEAAKLARYNKKPTITSREIQTSVRLVLPGELAKHAVSXGTKAVTKFTSS

SEQ ID NO: 187477 - protein, 155 aa, Triticum aestivum
  unsure (1)..(155): unsure at all Xaa locations
  Clone ID: PAT_TA_81895.pep
KNWSSRSRSRIHNYSTRSWNQQKEVSKKSLVLTRSPMITKVGRVEIRQSSVCWCQCCDAESTKASFTSMTXAEEWXECFXDNXEVWVAXVAAGSSXEMRLRRPTXXPXFGXENXXVIXHFPXKXLSTIIXQSLXGLGRTSAGESSXHVXLXNENS

SEQ ID NO: 187478 - protein, 92 aa, Triticum aestivum
  unsure (1)..(92): unsure at all Xaa locations
  Clone ID: PAT_TA_81896.pep
DAIGVSSVVAAMIGLSILLLLGVMNWDDCLNEKSAXDTLXWVAXPXGNXGRXXXDLXXVAWXSNWGAKGLQXFSMXWPAXIWGPQGSQFLNH

SEQ ID NO: 187479 - protein, 81 aa, Triticum aestivum
  unsure (1)..(81): unsure at all Xaa locations
  Clone ID: PAT_TA_81897.pep
KGLXTPKFHPXIXRTXFFPQPXIXIWLXPRPFXLKRPXLIFFXXGGLVXGXLKFXMXSPGRFXGAERDDGFXHARPHGGRR

SEQ ID NO: 187480 - protein, 99 aa, Triticum aestivum
  unsure (1)..(99): unsure at all Xaa locations
  Clone ID: PAT_TA_81898.pep
AGKPAGVFFXTGTXGGGQEXXXLXGVXQLTXHGMVFVPVGYXFGAXMFXMDXVXGGXPYXAGXFAGDGSRWXSEMXLXQAFQXGKYFXGIXKKLKGSSA

SEQ ID NO: 187481 - protein, 102 aa, Triticum aestivum
  unsure (1)..(102): unsure at all Xaa locations
  Clone ID: PAT_TA_81899.pep
ENXXTGVALXTVRKGTRXPNRQRPRHAMSSQLXCQRKPLPPRXDRRRRTVDSVAVHPRTWEEGHRQAASGKGTERTRQATECSPGAEHHQIHGLDMNEKEMP

SEQ ID NO: 187482 - protein, 154 aa, Triticum aestivum
  unsure (1)..(154): unsure at all Xaa locations
  Clone ID: PAT_TA_81900.pep
ISFPXTLDMSKFLXTHISCIXLXKTXGXLQSCSSCXGKLHPMLRXPXGSHQTSTPCVSKDFTSSFLPMFLSCVEAFCFLGTFFGCLRFCLCHQMVGASVFLLVATQMVGEVTLQVHESKTHGSFTGETSHSFQSLASHVNSKHPQVVLPVVNLS

SEQ ID NO: 187483 - protein, 173 aa, Triticum aestivum
  unsure (1)..(173): unsure at all Xaa locations
  Clone ID: PAT_TA_81901.pep
QGNGGGANSVAPGYTKGDGLGAEIVGTFVLVYTVFSATDAKRSARDSHVPILAPLPIGIRGVSGCTWATIPNQRXTGXQTRARSLXXAIIXTTKKQAWGRHWFSWVXPFIGAALAAXHVVVIXAXPXKTAINNHPMWLLVPVVSPCSKCFPTYTYFQFWKFQIRNCKDNCVNL

SEQ ID NO: 187484 - protein, 150 aa, Triticum aestivum
  unsure (1)..(150): unsure at all Xaa locations
  Clone ID: PAT_TA_81902.pep
RLRLTNQDKNKYNTPKYRFVVRFTNKDVTAQIVYATIAGDIVMAAAYSHELPRYGLEVGLTNYAAAYCTGXLLLGPXVLKERGSWMKEYERQCFRHWVKDXLFXLPDXKEXFPCLLGCLALIXRTTTGNRVXXGALKGLLDWWLYIPXSG

SEQ ID NO: 187485 - protein, 134 aa, Triticum aestivum
  unsure (1)..(134): unsure at all Xaa locations
  Clone ID: PAT_TA_81903.pep
MGGGNAQKSKMARERNLEKLKGGKGSQLEANKKAMNIQCKICMQDFHPAPPLKAKCKEHAEAXKHPKERLVQCSPHLKASDICPIKREERNCHNPPICSRKCLIVDLTLGGCPTVWFCAYKVPQPVLKYLTVVS

SEQ ID NO: 187486 - protein, 74 aa, Triticum aestivum
  unsure (1)..(74): unsure at all Xaa locations
  Clone ID: PAT_TA_81904.pep
SNIILCXXXAXXITRVEPEQFHSSRKHSXCRCSRHRVSLHGAAASSPSSXGXAHHGGGRERREGVGRDAHAAPS

SEQ ID NO: 187487 - protein, 124 aa, Triticum aestivum
  Clone ID: PAT_TA_81905.pep
YITRQISAELSLPALESKRLWPTSVSSMSPSLHRAAAHTQGDQAQPNGRCSFLPHPCVPFKITGCMYEYPSGDAWIYLTETRRVYICQNVCWERHESAKAVMCKVLIQGDNPVDYQVLRYSLTK

SEQ ID NO: 187488 - protein, 97 aa, Triticum aestivum
  unsure (1)..(97): unsure at all Xaa locations
  Clone ID: PAT_TA_81906.pep
XCXXIXSAGKFSCRXFFSPRMCRTFXRXXRXPLXXLXRANCSLSXGSDNQPSIPXHSSGSSAILMLETNFSASWIRHPPGGKFGXLGLNARDSFPAX

SEQ ID NO: 187489 - protein, 110 aa, Triticum aestivum
  unsure (1)..(110): unsure at all Xaa locations
  Clone ID: PAT_TA_81907.pep
QRLIFAGKQLEDGRTLADYNIQXESTLHLDLRLRGGMQIFVKTLTGKTITLEVXSSDTIXDNVKAKIQXXEGIXPDQXRLIFCWQAXXRMVPPXPDXNIQEGXTFNWCPL

SEQ ID NO: 187490 - protein, 128 aa, Triticum aestivum
  unsure (1)..(128): unsure at all Xaa locations
  Clone ID: PAT_TA_81908.pep
PFATSFSGTIXGLVXGFHHSXGLHNIHXNYSLPKIFPGXHLAKRNVVKSSVPSSXGQXPXGXFXGXFAANNLXVAIXKVPQAHXGVXXKVRMLEATKGGWTIGYPKLGTRGPTQLLIQIHWINPGWRA

SEQ ID NO: 187491 - protein, 99 aa, Triticum aestivum
  unsure (1)..(99): unsure at all Xaa locations
  Clone ID: PAT_TA_81909.pep
HPTLIIKQSLPTSSPSFPSKQXTLVSSXXASVGXXLXVLQTWHLDFRNGIHQDWXXXXWYQNLNXGKYXIKGFPFKXXSXEXKXLDXNRXLCQGXXVGX

SEQ ID NO: 187492 - protein, 53 aa, Triticum aestivum
  unsure (1)..(53): unsure at all Xaa locations
  Clone ID: PAT_TA_81910.pep
ERESHSLICVGXKKLLIERLLXSQGDVXLSLFFFPSHTVNIXYTICLXSSAAK

SEQ ID NO: 187493 - protein, 131 aa, Triticum aestivum
  unsure (1)..(131): unsure at all Xaa locations
  Clone ID: PAT_TA_81911.pep
DDVELVAVNDPFITTEYMTYMFKYDTVHGHWKHSDIKLKDDKTLLFGEKPVTVFGVRNPEEIPWGEAXADYVCGSTGVFTXDKDXAAXAHFKGGAKKWHLCPKQRSPMFVVXVNEDXTPQDVKFLKMLLHH

SEQ ID NO: 187494 - protein, 158 aa, Triticum aestivum
  unsure (1)..(158): unsure at all Xaa locations
  Clone ID: PAT_TA_81912.pep
DLVDLGDMYFHELVNRSLIQPVKVKYNGKVSWCRVHDTILDFLIDLSERENFSTLLSNKAKPDRRIRRLSLMGNEDQGIIEQLDISHAXRSLGVFGPTKQLPSLVKSDALRVLXDLRVCGGLGNHQVKDIGKLVQLRYLNIDGTDITELLIKLGAWST

SEQ ID NO: 187495 - protein, 163 aa, Triticum aestivum
  unsure (1)..(163): unsure at all Xaa locations
  Clone ID: PAT_TA_81913.pep
PKDLFRCQLLLSILAHVSCCFHGPRRRTNPDHVSCHLLLFPLVYRARSRPVLVLCPATACPFKTSSYPPLLPTKFKFSMIQIRAPMXNCLETTLAAHYXQVXKELGPRCSXNPXXNSXGXPSLRXGHXXRXKXLKVRXRRTWVRXXXTXAKDKPRQXXKEKIL

SEQ ID NO: 187496 - protein, 100 aa, Triticum aestivum
  Clone ID: PAT_TA_81914.pep
EAKANLLLLEGQLKGERFFGGDTIGLVDIAASGLARWLEVFEEISRVDLLTDEKFPALNPWAKEYAGDEHAKECLPNKDELVAKFTAVKKKFLAMAEVQK

SEQ ID NO: 187497 - protein, 62 aa, Triticum aestivum
  Clone ID: PAT_TA_81915.pep
MAPTLKLRFLAVAATATVVASLLVGMASAVDGPAPAPASGASVTAPAVAMASLTALVFGYFF

SEQ ID NO: 187498 - protein, 126 aa, Triticum aestivum
  Clone ID: PAT_TA_81916.pep
MSKSVSSGSTSSGSRQSKSVSAANDLYSKANALSGSAKSKSVSAANDLSSKANASSGSANLKSVSAIDDFPSKANASSGRTHSNDHSSKANASSGSTHSNSVQTKKIQEKTKKKVVPLPVKKKPQK

SEQ ID NO: 187499 - protein, 76 aa, Triticum aestivum
  unsure (1)..(76): unsure at all Xaa locations
  Clone ID: PAT_TA_81917.pep
MXCNCGSGCICXSXCKCGKMYPDXXEQGSAAAEVAAVGRPRVAPXNXEGXFXVAXRQIPAXGCNCGDNCXXKPCNC

SEQ ID NO: 187500 - protein, 80 aa, Triticum aestivum
  unsure (1)..(80): unsure at all Xaa locations
  Clone ID: PAT_TA_81918.pep
SYISXSXLSRXSFLCSFXCILXLLPGEELGWGDXXRRRARXCGGLARGGLWRRRPPATLVLCPHHETXPRWKLFPHEQKP

SEQ ID NO: 187501 - protein, 163 aa, Triticum aestivum
  unsure (1)..(163): unsure at all Xaa locations
  Clone ID: PAT_TA_81919.pep
MVKAVAVLTGSEGVKGTIFFTQEGDGPTTVTGSVTGLKEGLHGFHVHALGDTTNGCMSTGPHFNPAGHVHGAPXEDEIRHAXGDLGNVTAGADGVANINVTDCHIPLTGPNSIVGXAVVVNGDADXLGKGGHDLXETGNLVPLLLRIIGSRLRFISTALSEPK

SEQ ID NO: 187502 - protein, 94 aa, Triticum aestivum
  unsure (1)..(94): unsure at all Xaa locations
  Clone ID: PAT_TA_81920.pep
MIRHXQIXEICILYSHILVYLXXEPFSGSGKRLSRRDQSLLSLXTLVHMSCSFSIHGCHLPSLPKMQQSPFTPEPDSLPYITVAARPRWNTCCY

SEQ ID NO: 187503 - protein, 97 aa, Triticum aestivum
  unsure (1)..(97): unsure at all Xaa locations
  Clone ID: PAT_TA_81921.pep
VQRDAAAAPDAIAGGEYTLVYEDDEGDRMLVGDVPWXMFIVTAKRLRGLXSSDLPASSLTEXGSXKRPAXAAIIRAVSVTKVPVLLLRTYRMRMKSL

SEQ ID NO: 187504 - protein, 141 aa, Triticum aestivum
  unsure (1)..(141): unsure at all Xaa locations
  Clone ID: PAT_TA_81922.pep
HKPLXILLHEHVHTLAGTQHFFLPRYENXKXTRRTGVVXPLVVEIIQXDKVKGMXXNYSTLPLHAXHTXLXACXVSDETFAVXTWXQLXSIDQTALTPCPLDGRAWLLRWXSXIRIVXGQXXVSGQLWXCRRQWXMVTXPX

SEQ ID NO: 187505 - protein, 78 aa, Triticum aestivum
  unsure (1)..(78): unsure at all Xaa locations
  Clone ID: PAT_TA_81923.pep
HGWFARSSLHSHSTSPSSXSXSSCPLKWXRSQLSSLRGNXLVLXELELLLGRYHXYVKPXXFFSLLDVXSLDTCLTVF

SEQ ID NO: 187506 - protein, 62 aa, Triticum aestivum
  Clone ID: PAT_TA_81924.pep
DQATMATAPRPPTSPPPATPPGTRSQRTPPTPSSCTNSQIVQREEQGSLLGRSVALCLRMAC

SEQ ID NO: 187507 - protein, 130 aa, Triticum aestivum
  unsure (1)..(130): unsure at all Xaa locations
  Clone ID: PAT_TA_81925.pep
PDAKXXKGLLGKIMXKLPGYHKTXEGXXGHRRXRRAQXQRXIAXXPRDXIDCDLNXIVXXCXXIXXXSKXXSPVRLCXYXXXXLSVQPXSVSMIHVXXASNQRLXFXMFLSXHMXLGLCWYXLILKFPPQ

SEQ ID NO: 187508 - protein, 57 aa, Triticum aestivum
  unsure (1)..(57): unsure at all Xaa locations
  Clone ID: PAT_TA_81926.pep
GXXPCEYLSAXXWRSXAEKTVYXRKERAXDLGPEAVPXXVPGXDGVGXAXXAXVQXG

SEQ ID NO: 187509 - protein, 114 aa, Triticum aestivum
  unsure (1)..(114): unsure at all Xaa locations
  Clone ID: PAT_TA_81927.pep
KKPKAEKRPPKSKEGGADKKKKKAKKSVETYKIYIFKVLKQVHPDIXGISSKAMSIMNPSSTTSSEKSARRSAKSAXYNKXPPHSREXQTPSAPPPPAPQNASLKDQASQFTPP

SEQ ID NO: 187510 - protein, 98 aa, Triticum aestivum
  unsure (1)..(98): unsure at all Xaa locations
  Clone ID: PAT_TA_81928.pep
MLGEKAVGVNTKSSARLKTLTAKRRRVCGRGXSSAAAGASXXTAATSXSAAGAAXSXTSSTTAGSASATASXVSVSTTAGASASGSAAAAGSGSLVSS

SEQ ID NO: 187511 - protein, 43 aa, Triticum aestivum
  Clone ID: PAT_TA_81929.pep
ENGTVVEQGPHDFLLSKGGRYAELWSQQNNSEASDASDVSLEV

SEQ ID NO: 187512 - protein, 186 aa, Triticum aestivum
  unsure (1)..(186): unsure at all Xaa locations
  Clone ID: PAT_TA_81930.pep
TIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNCSTMNFRQXNYNFXEPFPXLAKELVVIPNIHFLEXGLNPPEVTSTWAMHNTRADLRRNTPRPTHDIDQRYDRRLHHTWSKTSIV

SEQ ID NO: 187513 - protein, 56 aa, Triticum aestivum
  unsure (1)..(56): unsure at all Xaa locations
  Clone ID: PAT_TA_81931.pep
RAVVLQLSAGEKIEPEEHGDGKWLAVPPXSWCCKPCLXCDLXFNXXFYNFAKRQSI

SEQ ID NO: 187514 - protein, 113 aa, Triticum aestivum
  unsure (1)..(113): unsure at all Xaa locations
  Clone ID: PAT_TA_81932.pep
MTTVPGSLVWELVKKNNCFLIKQFGNSNAKVQFNKEPXLYNVHPXKXSGLXEQQDXGVNHSTREXXGLXFSXTKDQXAXNPCXFQXKPLFPKGSPKIAIFFKTILGNIKAQPL

SEQ ID NO: 187515 - protein, 146 aa, Triticum aestivum
  unsure (1)..(146): unsure at all Xaa locations
  Clone ID: PAT_TA_81933.pep
PALFCSSRRPWLAARPLLPWCCCLLLIPWLLLLQSYPYQIPWDDVFSDTKQPLFVDIGSGKWLFPIPKWLRNWGKAPNFPGALKMNEKVGCKVPSRMLASTGEKELYTFPXDKCTSKFXLXXFQXIPGLXNFFQIKCPIPDXKXXK

SEQ ID NO: 187516 - protein, 61 aa, Triticum aestivum
  unsure (1)..(61): unsure at all Xaa locations
  Clone ID: PAT_TA_81934.pep
FFFFXFFXXEXXHNCSXFXIXNHHKALNPAXTTLXQTTSLXVXTIXNSRXQPVTHLXLXPS

SEQ ID NO: 187517 - protein, 94 aa, Triticum aestivum
  unsure (1)..(94): unsure at all Xaa locations
  Clone ID: PAT_TA_81935.pep
AEGRLMNLGCATGHPSFVMSCSFTNQVIAQLELWNEKATGKYEKKVYVLPKHLYEKVAASTWGKLGAKADQVTXPNLDYIYTQFEGRTTCGYRY

SEQ ID NO: 187518 - protein, 88 aa, Triticum aestivum
  unsure (1)..(88): unsure at all Xaa locations
  Clone ID: PAT_TA_81936.pep
LAEGRLMNLGCATGHPSFVMSCSFTNQVIAQLELWNEKATGKYEKKVYVLPKHLDEKSXLHLGQAPAPRLTKLTNPNPDYIXIPIXGP

SEQ ID NO: 187519 - protein, 132 aa, Triticum aestivum
  unsure (1)..(132): unsure at all Xaa locations
  Clone ID: PAT_TA_81937.pep
KTITLEVESSDTIDNVKAKIQDKEGIPPDQQRLIFAGKQLEDGRTLADYNIQKESTLHLXVLKLRGGMQVFVKDAXTGKTITLXVGSSXDTIYNVXAKFQDKEXFPXDQHXXXFRETLXDGAPXKLXIXXYL

SEQ ID NO: 187520 - protein, 161 aa, Triticum aestivum
  unsure (1)..(161): unsure at all Xaa locations
  Clone ID: PAT_TA_81938.pep
LAGTNGETTTQGFDDLGKRCAKYYEAGARFAKWRAVLKIGATEPSQLSIDQNAQGLAXRYAIICQENGAGCPLLSLRSXVDGXHDIDRCAYVTEXLLAACYKALKRPHSSFEGTSLXPNMAPWFRPQXVXPEVISDTPSDLQKDLPAXSPHSLRGEEPGTP

SEQ ID NO: 187521 - protein, 57 aa, Triticum aestivum
  unsure (1)..(57): unsure at all Xaa locations
  Clone ID: PAT_TA_81939.pep
MGHSNVWNSHPKNYGPGSRVCRVCGNSHGLIRKYGLMCCRQCFRSNAKDIXGFINYR

SEQ ID NO: 187522 - protein, 88 aa, Triticum aestivum
  unsure (1)..(88): unsure at all Xaa locations
  Clone ID: PAT_TA_81940.pep
EEVNMYIELPKXVPXXLIHCVFXAGXXEVGIRGNPPYLNHDLMHPXXTDSSFWDNXEXXVNCDITLXXGEXGGKXWXSXNKGQGXLIP

SEQ ID NO: 187523 - protein, 67 aa, Triticum aestivum
  unsure (1)..(67): unsure at all Xaa locations
  Clone ID: PAT_TA_81941.pep
XSEVVQMKVXXXIXXWIXMAXLCWPXAGSXCRPSAXRGSYPSPSXTXCXLPPPMXVDSSTRRETMLX

SEQ ID NO: 187524 - protein, 101 aa, Triticum aestivum
  unsure (1)..(101): unsure at all Xaa locations
  Clone ID: PAT_TA_81942.pep
VXFXXQLXRQTGXXPXGIXNXPAXGQXXPSTRTLSLLKSQXEDRIDRXARAQRQGKDAPHGKTVKDLMNLYNTSRPPSTXTGCQNSRLAGYPFTXLQSQES

SEQ ID NO: 187525 - protein, 123 aa, Triticum aestivum
  unsure (1)..(123): unsure at all Xaa locations
  Clone ID: PAT_TA_81943.pep
VFKQSGRLNAEHKGLDAPSEDDDEPHKQHAGKQKNFPLEVKTVNSLHVITRKNSAAPAKTRAARSTPARSPKLGCLKPILPTIKDYSQKCSETQGGTAFXYWVXIIXRLQLQHKSKWDGGKRY

SEQ ID NO: 187526 - protein, 69 aa, Triticum aestivum
  unsure (1)..(69): unsure at all Xaa locations
  Clone ID: PAT_TA_81944.pep
LTSXMLFXSLLKFCRFCVCSCGTELSGNVMCCLNSHCTSYTYICGKLNGXLTLXIDXGKSVCXXIAFEH

SEQ ID NO: 187527 - protein, 118 aa, Triticum aestivum
  unsure (1)..(118): unsure at all Xaa locations
  Clone ID: PAT_TA_81945.pep
VTRVLLLLSLTGISSLAGTLQGNGIQVHMAFRITLQSDAQTGKGQXNALEITLRCMVFLQXKKWMNWLSLAEWWYNTSYHTSLKMTPFQALYNRPPNMISEAALYPAEQVQDFSSVLT

SEQ ID NO: 187528 - protein, 91 aa, Triticum aestivum
  unsure (1)..(91): unsure at all Xaa locations
  Clone ID: PAT_TA_81946.pep
MKGTKLAAILILQAVLVMGVLSHVNADFFPKCCNNCRSFSGVDVCDDAHPKCPKGCSACRVVSXRAPEMWRCAXYEXTVRRTCGGXPCKXY

SEQ ID NO: 187529 - protein, 160 aa, Triticum aestivum
  unsure (1)..(160): unsure at all Xaa locations
  Clone ID: PAT_TA_81947.pep
QDVDNANRFLFDQTSGNQQHSFMKRPEQGHFRAPEGYSANSSMMRNQMNGGNFTSSDNPQVGIWAMLPPRIGRKGPQGGTLLXKAKFXWVHPNYLXGYNGSWXPDWGTSSXKCLIDXLYFXYLAXQIXXXYDDXFXAXGHXRNSXKXYFGPQXGCLNPML

SEQ ID NO: 187530 - protein, 69 aa, Triticum aestivum
  unsure (1)..(69): unsure at all Xaa locations
  Clone ID: PAT_TA_81948.pep
KKLCGYGYMPISIARDTLSNQAIGMSNGHAASPSFHGALLFIFHFFHVTXKMYFRHVRSTLHIISRTLL

SEQ ID NO: 187531 - protein, 147 aa, Triticum aestivum
  unsure (1)..(147): unsure at all Xaa locations
  Clone ID: PAT_TA_81949.pep
DEMGLTFTKLFSRLFAKKEMRILMVGLDAAGKTTILYKLKLGEIVTTIPTIGFNVXTVXEYKNISFTVWXMSGGQGQVRHCGXHYSXNTQGSSLVVDSNDRTVLFXARDXLHKMLNEMXTYAXLLVFANKHXLPXAMNLPEIXDNLG

SEQ ID NO: 187532 - protein, 109 aa, Triticum aestivum
  unsure (1)..(109): unsure at all Xaa locations
  Clone ID: PAT_TA_81950.pep
GQQGHTDTATHGTPSTGGTYGQHEHTGVTDKETQGTGGIDKKKDAMENIKEKLPGGHGDHQQTAGTYWQHGHTGMTGTETHGTTATXGGQQGHNETTGHWGHTAPDGTX

SEQ ID NO: 187533 - protein, 83 aa, Triticum aestivum
  unsure (1)..(83): unsure at all Xaa locations
  Clone ID: PAT_TA_81951.pep
ASSLGFPPAVRRHGSPQRRRKVFPPCSNVAAXIEKTNXGKPXKLLNLLLPXNSGGXYHXWXLGPPLLKXMVSGTGXXKXXKVF

SEQ ID NO: 187534 - protein, 79 aa, Triticum aestivum
  unsure (1)..(79): unsure at all Xaa locations
  Clone ID: PAT_TA_81952.pep
EIEIASKIQQVYVRPPSSSVXXYFIALLVLGEIXGKQCVAXXPSRNNSPSSYLGCMYVRPPIYECFLFXGPNWMFGTXK

SEQ ID NO: 187535 - protein, 65 aa, Triticum aestivum
  Clone ID: PAT_TA_81953.pep
LRIGVPENEQCCPLLGGLADLDAAVCLCTAIRANILGIQLNVPIDLTLLLNQCGKKCPSDFTCPI

SEQ ID NO: 187536 - protein, 121 aa, Triticum aestivum
  unsure (1)..(121): unsure at all Xaa locations
  Clone ID: PAT_TA_81954.pep
DVEYLKANKPPTWEYAVSKVLLEKAASKFAVENGISLATVLPVFTLGRGAGLQRPRTSVPVTLSLLSGHXDTVHILISLQSGNRSRVHIQLWTLCXAXVFXXXXHPXSGKVICCTTHNALP

SEQ ID NO: 187537 - protein, 149 aa, Triticum aestivum
  unsure (1)..(149): unsure at all Xaa locations
  Clone ID: PAT_TA_81955.pep
ELCAESSSATMKGTKLAAILILQAVLGHGSPLRTSTPTSFPQVLQQLQVLLRGSDVLRRRPTPXVPKGCSGVPRWVSXQPXKCGAXPGYEXNRXNGPXGGPXXXYGXVXARXXIFPXXKFNKLGXKXHXIVPKLCVFTNNILQXSXSSR

SEQ ID NO: 187538 - protein, 75 aa, Triticum aestivum
  Clone ID: PAT_TA_81956.pep
ITGTGINPARSLGAAVIYNNEKAWDDHWIFWVGPFIGAAIAALYHQYVLRASATNSGSVGSFRHPLDSTAGRRLR

SEQ ID NO: 187539 - protein, 162 aa, Triticum aestivum
  unsure (1)..(162): unsure at all Xaa locations
  Clone ID: PAT_TA_81957.pep
IWWELWWNRTLNHTRGHLIELVNSTNVLISNVTLRNSPFWTVHPVYCRNVVIKDLTILLPWNAPNTXDGFDPXTPXXEXCVRGLAISESGDDLXLLSKRGWDXYGISXRKPNSNIYIPAXSSTNLLLPCGFNQFPVGYKLLVRDSYGSRNGPGVHNNHRKVT

SEQ ID NO: 187540 - protein, 96 aa, Triticum aestivum
  unsure (1)..(96): unsure at all Xaa locations
  Clone ID: PAT_TA_81958.pep
VAGLAKYPKKVIRKDSAKKTAKKSRVKVFLKLVNFTHLMPTRYTLDVDLKEVGSGAPDPSPPKDKKVGARQGPPKANSEERSKTGQEQWSFNQXRF

SEQ ID NO: 187541 - protein, 57 aa, Triticum aestivum
  unsure (1)..(57): unsure at all Xaa locations
  Clone ID: PAT_TA_81959.pep
DVKTNSINLVHXXLSXIGGQXIXXKLPSXDSGHXLXLXLXPYXXXCFENXXANLRQP

SEQ ID NO: 187542 - protein, 101 aa, Triticum aestivum
  unsure (1)..(101): unsure at all Xaa locations
  Clone ID: PAT_TA_81960.pep
MXGSGGXSKPRWGLXAYXRLAKXVALKFISLAGMILSFAQVIFVVGFVXLQHHGAWXCALTQILVSSNIISSRHPXLQVGRLPPIKLILDLLGKSGNTCAL

SEQ ID NO: 187543 - protein, 71 aa, Triticum aestivum
  unsure (1)..(71): unsure at all Xaa locations
  Clone ID: PAT_TA_81961.pep
SLTDXXSKPPXSLVKWARKFDRLMXRIXSAXHSIQHNPWNIKFQKFSLRGATHIPLVLCNQDLQILXLKNS

SEQ ID NO: 187544 - protein, 76 aa, Triticum aestivum
  unsure (1)..(76): unsure at all Xaa locations
  Clone ID: PAT_TA_81962.pep
SPMKSIFQVTFAAFKNMSLEIPADSSLLYEARSKNTHKRGPRLAHTDDFRFLDKAAVILDLPFGQQQLPXSWEDLL

SEQ ID NO: 187545 - protein, 87 aa, Triticum aestivum
  unsure (1)..(87): unsure at all Xaa locations
  Clone ID: PAT_TA_81963.pep
LAINTGAAAGEAIKQSPSMPTTPTTPVTPSSSTPPRGGSVWRSVFHPGSNLATKSSGANSSDRPQPXPTVYDWFYSDETRTRSNTAK

SEQ ID NO: 187546 - protein, 145 aa, Triticum aestivum
  unsure (1)..(145): unsure at all Xaa locations
  Clone ID: PAT_TA_81964.pep
MNKNKKLVKKLAKKYHAFLASEAIIKQIPRLLGPGLNKAGKFQLWVSHQESLGVQXLMRPRPQQFQLEKGVCMGVAVWHLGMEEKQIFPKRADERHSSSLXLXEDWENXRCLYLKDTWESVPFQSPAFVSQGIDTGTLCFITFPA

SEQ ID NO: 187547 - protein, 104 aa, Triticum aestivum
  unsure (1)..(104): unsure at all Xaa locations
  Clone ID: PAT_TA_81965.pep
TAALNVXSILCPIXXMCVLLXVISIXFSGIPPPXRXXDLENCLXFXXKGXPXKPLTTRLEPTEKAKFXRSWXPXQCNXPXXXVXAIYXFSGFXXKKXXXFKKKK

SEQ ID NO: 187548 - protein, 119 aa, Triticum aestivum
  unsure (1)..(119): unsure at all Xaa locations
  Clone ID: PAT_TA_81966.pep
TLNLEIPKRQLXYLKLQXKXPNTKKXLIPLLHVPFFPSFGTTSICIMVAAATPICSSHYLPKQEDALHAAVAAPCYCLHGWLVHHQLRCRSRRAPCPCLGAANGTNWMGWRRGDVEEGG

SEQ ID NO: 187549 - protein, 124 aa, Triticum aestivum
  unsure (1)..(124): unsure at all Xaa locations
  Clone ID: PAT_TA_81967.pep
MAPVKLYGATLXWNVTRCVAALEEXAGVEYELRPHQTSGTGEHKSPDHSPRNPFGQVPTXQDGXLVLFXSTCXFKYXAGKDKPXLFKEGTRHGFFPWRPTNGVLTHFFLNNFGEPLKGMKFKLK

SEQ ID NO: 187550 - protein, 131 aa, Triticum aestivum
  unsure (1)..(131): unsure at all Xaa locations
  Clone ID: PAT_TA_81968.pep
AIGVSATKGEAWRNLWTIGLHKIFAAVAMGIALLRMIPKRPFLMTVLYSXLAFAVSSPVGVGIRNPPSDATAEGRPAXDGTYATPWGIATGIFXYVAIQPPPWAKGYRPHXPITSDXPLQLCAQPAPCGPE

SEQ ID NO: 187551 - protein, 56 aa, Triticum aestivum
  Clone ID: PAT_TA_81969.pep
VNKDDGGNQPEFLGTADEDKNAMDLGYSEVERSRRLEFMMAKRRSRKNIIFDLGWK

SEQ ID NO: 187552 - protein, 115 aa, Triticum aestivum
  unsure (1)..(115): unsure at all Xaa locations
  Clone ID: PAT_TA_81970.pep
QRLIFAGKQLEDGRTLADYNIQKESTLHLVLRLRGGMQIFVKTLTGKTITLEVESSDTIXDNVKAKIQDKEGIPPXDQQRLIFAGKHLRMAALXADYNIQKXPHFTWVLPFCVAN

SEQ ID NO: 187553 - protein, 126 aa, Triticum aestivum
  unsure (1)..(126): unsure at all Xaa locations
  Clone ID: PAT_TA_81971.pep
MARTKQTARKSTGGKAPRKQLATKAARKSAPATGGVKKPHRFRPGTVALREIRKYQXKSTELLIRXXPFQRSSGKXXQGFQRPTPFPSSRRLPRSKKAARAYSVRSFXGHNFCASTPXRHIIXKNP

SEQ ID NO: 187554 - protein, 125 aa, Triticum aestivum
  unsure (1)..(125): unsure at all Xaa locations
  Clone ID: PAT_TA_81972.pep
PGALQYLSGVILFEETLYQSTKGGKPFVDILKAGNVLPGIKVDKGTIELAGTNGETTTQGFDDLXGKRCAKYYEAGCRSAKWRASSKIRRTXHPQSPSDQNVKGLVPIHICQENGLGAIVGPESC

SEQ ID NO: 187555 - protein, 112 aa, Triticum aestivum
  unsure (1)..(112): unsure at all Xaa locations
  Clone ID: PAT_TA_81973.pep
MAAIRRLIPSFNRVLVEKVVQPKKSAGGILLPETSKQLNSXGKVIAVGLGTRDKEGKLIPVALKGRGPFLLPXYGGLESTCSPRKXLLYKRRRILGPPTIKCVETAMQEERF

SEQ ID NO: 187556 - protein, 97 aa, Triticum aestivum
  unsure (1)..(97): unsure at all Xaa locations
  Clone ID: PAT_TA_81974.pep
GSEGVKGTIFFTQEGEGPTTVTGSVTGLKEGLHGFHVHALGDTXNGCMSTGPKLNPRSSMGNLKKANVFLLKFDVVPTIIFLNPLDQINFCLPFSMG

SEQ ID NO: 187557 - protein, 192 aa, Triticum aestivum
  unsure (1)..(192): unsure at all Xaa locations
  Clone ID: PAT_TA_81975.pep
SVFAGVGERTREGNDLYREMIESGVIKLDGKQSESKCALVYGQMNEPPGARARVGLTGLTVAEHFRDAEGQDVLLFIDNIFRFTQANSEVSALLGRIPSAVGYQXLATDLGRLQERITTTKKGXITSVQTIXVPADDXTNSALLHFAHLIYNVLHRFELGILRRSWITSKCCPVWEKAGQKSKNSRYIWKVP

SEQ ID NO: 187558 - protein, 109 aa, Triticum aestivum
  Clone ID: PAT_TA_81976.pep
IWFGAQACVRRAAQPGWLVFVEFLRAAVTSLFLVVCAWPFSARWRWQASDPCLLADDSASDEDPALFLSVPAVTASTDVVFLLGGTAVELVLLFVPHGSWSPGENLRFG

SEQ ID NO: 187559 - protein, 44 aa, Triticum aestivum
  Clone ID: PAT_TA_81977.pep
LPLFSDWILGRVRYVSITHSITVKHPLYSHRVCCNCTYCSSFFA

SEQ ID NO: 187560 - protein, 174 aa, Triticum aestivum
  unsure (1)..(174): unsure at all Xaa locations
  Clone ID: PAT_TA_81978.pep
KLKTAMMTTPVLVLPNFDQQFCIETDACATGIGAVLTQGGHPVAFYSKALGVKNQSLSIYEKEFLAIMVAVEKWRAYLQRGPFIIKTDHRSLCQLEDQXLTTDVQKKAMTKLVGXQFQFQYKKGSENLAADASPRVGHLLTMTTTSSNQPVWXQEVINLMNGSHAQELLKNTIL

SEQ ID NO: 187561 - protein, 58 aa, Triticum aestivum
  Clone ID: PAT_TA_81979.pep
RNITGNPEVRVNKMGRAAGVLENHEEGRRYAEHGLRAYVQDKTPEIMPGINKFFTSPK

SEQ ID NO: 187562 - protein, 168 aa, Triticum aestivum
  unsure (1)..(168): unsure at all Xaa locations
  Clone ID: PAT_TA_81980.pep
ERLISVPTERFVEFHCLEELEVVYCRNICSRSLVAPSLKRLVLGCSGDLAHNIECCSLTTSSYIIPATLHTPTTSSHPNXFXIARCXPPYILWNQRSSLLLPIVGCIAKRIHPPCXLTGXPLTGXXNXNPXXPPXNKMLPAXXSLYCTXAQFXPXRXXSXSLXKDWRL

SEQ ID NO: 187563 - protein, 176 aa, Triticum aestivum
  unsure (1)..(176): unsure at all Xaa locations
  Clone ID: PAT_TA_81981.pep
VFLVNIHFPPDYPFKPPKVSFKTKVFHPNINSNGSICLDILKEQWSPALTISKVLLSICSLLTDPNPDDPLVPEIAHMYKTDRXKYETTAAAGTQEYPWVETCILGQLNVPSKKNLHVSSICSGGCIRSSKINAFGSAYIATSGNISYNLSLACGLLTCWIGNVISCSDCQIKKKK

SEQ ID NO: 187564 - protein, 113 aa, Triticum aestivum
  unsure (1)..(113): unsure at all Xaa locations
  Clone ID: PAT_TA_81982.pep
RRTITCSANPPTIQTALVLTPCPVDGGAEQQQQPAEPDGEPPVRQEQRRRASDLHRAPAACPAPPARARPVPVGRPECTSGXWLPLXXXAAPDKGXRKXFWNLMNPDGXTSYH

SEQ ID NO: 187565 - protein, 112 aa, Triticum aestivum
  unsure (1)..(112): unsure at all Xaa locations
  Clone ID: PAT_TA_81983.pep
PPPLXFFGIKGFKGRRXVYFLGSPXGTAARPQFKSHYVTTHPGGRTGPINIHIXTARATGVLGRTEAEQRGAPAGPHHVVPPPTLLLPAELASTPAGGQRQRNSIPNPRQPR

SEQ ID NO: 187566 - protein, 55 aa, Triticum aestivum
  Clone ID: PAT_TA_81984.pep
RLLGDAPISVAVPVTNATTFAATAVAAALLGEATRAAPAALGTALIVLGVWVCIS

SEQ ID NO: 187567 - protein, 147 aa, Triticum aestivum
  unsure (1)..(147): unsure at all Xaa locations
  Clone ID: PAT_TA_81985.pep
GAEYVVESTGVFTDKDKAAAHIKGGAKKVIISAPSKDAPMFVCGVNEKEYNLTSDIVSXNASCTTNCLSPSLAKVXNDSFGIVXVLMTTVHXMTATPKTVXWPSQQDWKSGKXATLNHSQGPPKFKPNFEFTGSFSTSVLTLITPPN

SEQ ID NO: 187568 - protein, 56 aa, Triticum aestivum
  unsure (1)..(56): unsure at all Xaa locations
  Clone ID: PAT_TA_81986.pep
NMDKATSLKPLAERQSWIHFSFAXAIXSACIFFISISLSILXXFLSXWXXIXXWXL

SEQ ID NO: 187569 - protein, 109 aa, Triticum aestivum
  unsure (1)..(109): unsure at all Xaa locations
  Clone ID: PAT_TA_81987.pep
SDAIFRQSHAGLLNLCIVVLIAVNSRLIIENLMKYGLLIRAGFWFXSARSLGDWPLLMCCLTLPIFPLAALMTGELGQKKXIXDHVSILPHIIITTTVLILSGXVILKV

SEQ ID NO: 187570 - protein, 67 aa, Triticum aestivum
  unsure (1)..(67): unsure at all Xaa locations
  Clone ID: PAT_TA_81988.pep
KMYPDLTEQGXSAAAEVAAVVVLGVAPENKAGQFEVAAGQSGEGCSCGDNCKCNPATVNCMHPTLYV

SEQ ID NO: 187571 - protein, 141 aa, Triticum aestivum
  unsure (1)..(141): unsure at all Xaa locations
  Clone ID: PAT_TA_81989.pep
MSDTDEHHFESKADSGASKTYPQQAGAIRKXVGHIVIKARPCKVVEVSTSKXLGKHGHAKCHFVAIDIFNGKXNXEDIVPSSHNWXLPHVDRQDYQLXIDITDDGYVXLLTEDXNTKDDLNFHDKFCLGKLRRIDGRTDPS

SEQ ID NO: 187572 - protein, 108 aa, Triticum aestivum
  unsure (1)..(108): unsure at all Xaa locations
  Clone ID: PAT_TA_81990.pep
HCVAFRRVSSLGPGRCWSKXGCXKFQSLQHGVPKVITFREDIGCQGSRFLSRSSIFCKWIQWEXIDLPPKXNMDTHVFSIYTHARAPRYLHVRCGPSFLSSIEMKYHC

SEQ ID NO: 187573 - protein, 85 aa, Triticum aestivum
  unsure (1)..(85): unsure at all Xaa locations
  Clone ID: PAT_TA_81991.pep
LIFAGKQLEDGRTLADYNIQKESTLHLVLRLRGGMQIFVKTLTGKTITLXEVESSDTIXDNVKAKIQXDKEGIPPGPSXASIFAG

SEQ ID NO: 187574 - protein, 56 aa, Triticum aestivum
  unsure (1)..(56): unsure at all Xaa locations
  Clone ID: PAT_TA_81992.pep
FFFLNMQXDTHTCRRICNYVCMYVQCTHTYSTACILQTQHNTGYGTQQDHYTNLSS

SEQ ID NO: 187575 - protein, 66 aa, Triticum aestivum
  Clone ID: PAT_TA_81993.pep
LVREIAQDFKTDLRFQSSAVSALQEAAESYLVGLFEDTNLCAIHAKRVTIMPKDIQLARRIRGERA

SEQ ID NO: 187576 - protein, 67 aa, Triticum aestivum
  Clone ID: PAT_TA_81994.pep
FYLRVVMLDTIIVDYLFNSTICINLATERSLYVPPFFNFQVLLHGAIHRYYRCTKVYIFERLEGGAV

SEQ ID NO: 187577 - protein, 99 aa, Triticum aestivum
  unsure (1)..(99): unsure at all Xaa locations
  Clone ID: PAT_TA_81995.pep
STINDMTSTNTNANHAWLISRRAALLRQLNEXGVXRRRCVRCPCEGSLLVLGEAVQQAHSAFRRRLPYVVAVLPVRGAHASNSLSFTAFGSPWILGDXP

SEQ ID NO: 187578 - protein, 129 aa, Triticum aestivum
  unsure (1)..(129): unsure at all Xaa locations
  Clone ID: PAT_TA_81996.pep
YKNISFTVWDVGGQDKIRPLWRHYFQNTQGLIFVVDSNDRDRVVEARDXXHRMLNEDXLRDAVLLVLLTXNLPKAMXNAAEXXWXLGLIPXAQRHWYIPKNLAXXGEELYEGLDWLSNNIATIIFQIKD

SEQ ID NO: 187579 - protein, 68 aa, Triticum aestivum
  unsure (1)..(68): unsure at all Xaa locations
  Clone ID: PAT_TA_81997.pep
YRDDFYEYRHVILXXEMVSCLPKNRLMSEKEWRNLGVTQSPGWVHYMQYSPEPHVLLFRRAIDDENNK

SEQ ID NO: 187580 - protein, 91 aa, Triticum aestivum
  unsure (1)..(91): unsure at all Xaa locations
  Clone ID: PAT_TA_81998.pep
XVESSDTIDNVKAKIQDKEGIPPDQQRLIFAGKQLEDGRTLADYNIQKESTLHLXVLRLRGGMQIFVXKTLTGKTITLGGWLRTPSDNVKG

SEQ ID NO: 187581 - protein, 90 aa, Triticum aestivum
  unsure (1)..(90): unsure at all Xaa locations
  Clone ID: PAT_TA_81999.pep
VKTCSTPRDLKSHKDIDSPELERQDSPKSIHVDQRPKYGSKQPKIIKKILTTLREETNKLRVNNSPXRATRGKVHPPKSTEXLVLDDPRA

SEQ ID NO: 187582 - protein, 66 aa, Triticum aestivum
  unsure (1)..(66): unsure at all Xaa locations
  Clone ID: PAT_TA_82000.pep
QKRKHVTTASVPXNSXPNLATTVVAPXQALNSPXGNANPRSHDTQPSPINNTTXRPSLXKXFTAXP

SEQ ID NO: 187583 - protein, 173 aa, Triticum aestivum
  unsure (1)..(173): unsure at all Xaa locations
  Clone ID: PAT_TA_82001.pep
ATQISKKKKFVSDGVFYAELNEMLTRELAEDGYSGVEVRVTPMRTEIIIRATRTQNVLGEKGAGSRESPPSVQXKRFNSPGERRLTLRPKKSSTRGLCAIAXQARSLRLQLLXSLSXSRKACXGVLPFXLMEIGAKVXEALXMATQGPXDQSXXFKRTVHXXTGQPXNEYMRN

SEQ ID NO: 187584 - protein, 120 aa, Triticum aestivum
  unsure (1)..(120): unsure at all Xaa locations
  Clone ID: PAT_TA_82002.pep
MQIFVKTLTGKTITLEVESSDTIDNVKAKIQDKEGIPPDQQRLIFXAGSSWEDGRTLADYNIQKXSTLHLVLRLPWWHAILRETSLGKTITLXGLXSDTXDNXQGKFKDKXGSPRTTRLI

SEQ ID NO: 187585 - protein, 105 aa, Triticum aestivum
  unsure (1)..(105): unsure at all Xaa locations
  Clone ID: PAT_TA_82003.pep
QSRWPSRREPPSLARGGHRARLPMRPKEAPLXTGADSERAASLEGPGPGDSSSFLXGLLKESFXSSXLMGLPLAAAFXXHAPKGNTLHPLLXKRXGDYPNASXGP

SEQ ID NO: 187586 - protein, 73 aa, Triticum aestivum
  Clone ID: PAT_TA_82004.pep
HIDILTNNTGQQGTEHDSLCSNCTIPRTDQSNRGWRGKLGEVQRTEKVQTSDLTHACPTNIQSTHTHTPCHVG

SEQ ID NO: 187587 - protein, 136 aa, Triticum aestivum
  unsure (1)..(136): unsure at all Xaa locations
  Clone ID: PAT_TA_82005.pep
LRLCQLIPSGMRLGVWGRVVGAPVGRAFFFGGKHIAKNAVHLGDDGIVMWFRCPWRCTSTFLSKQIIQMXSQAPXDKAVHMGPVQLNQQHTCGLELRXAFGXXMXSXSIPLPXVPGPGVCKCKLLXKYXESTXKKK

SEQ ID NO: 187588 - protein, 88 aa, Triticum aestivum
  unsure (1)..(88): unsure at all Xaa locations
  Clone ID: PAT_TA_82006.pep
MSCNCGSGCSCGSDCKCGKMYPDLTEQGSAAAQVAAVVRAPAWLLENKAGHSEVAXGHPGEGASCRDNXKCNPLQLVLHAPLTLLLWC

SEQ ID NO: 187589 - protein, 140 aa, Triticum aestivum
  unsure (1)..(140): unsure at all Xaa locations
  Clone ID: PAT_TA_82007.pep
MAAKEPMRVLVTGAAGQIGYALVPMIARGVMLGADQPVILHMLDIEFAAEALKGVKMELIDAAFPLLKGXVVATTXDVVEACTGXVNVAVMVXGGSPRXEGMERKDVYDEKVSILQXQTSVLELQPQQGLGVANQQTQCP

SEQ ID NO: 187590 - protein, 90 aa, Triticum aestivum
  unsure (1)..(90): unsure at all Xaa locations
  Clone ID: PAT_TA_82008.pep
FFFXWXQHSCISNLFEHSKNAXYTHPNNILXRVDQVEHCIYPLHYXECNMMPSKYVVNEHAGLHLFFPFNGKGKXCVIDGILQGYNYHNL

SEQ ID NO: 187591 - protein, 67 aa, Triticum aestivum
  unsure (1)..(67): unsure at all Xaa locations
  Clone ID: PAT_TA_82009.pep
MXXAVAVLTGSEGVKGTIFFTQEGXXPXXVSXXVTGLKEGLHGFHGXTXFGTPXSGXXXHXPDFRPA

SEQ ID NO: 187592 - protein, 149 aa, Triticum aestivum
  unsure (1)..(149): unsure at all Xaa locations
  Clone ID: PAT_TA_82010.pep
QWYLTHYGVEIGRKKKAAAAAKKEAAEGQEAEVAAAATEEAKKSNNVQRKLEKRQQGRTLDSHIEEQFSGGRLLACISSRPGXQCGRADGYILGGQGLXXLHEELQKKKGKVPQLKPKTAACYSLVFLKFRPFILQHTEHIFCKLFHPS

SEQ ID NO: 187593 - protein, 125 aa, Triticum aestivum
  unsure (1)..(125): unsure at all Xaa locations
  Clone ID: PAT_TA_82011.pep
GPIMTAELIKETEELVLRTGSVGAGCSQLLSDMQAFKAANPGCVLEDFIRWHSPPDWXEDRAASNATVGEGSSRRGRLSDRMQTKEGNFVXKELWEAAKPIPXLLEQTPLYDENLLWRHICLGNF

SEQ ID NO: 187594 - protein, 111 aa, Triticum aestivum
  unsure (1)..(111): unsure at all Xaa locations
  Clone ID: PAT_TA_82012.pep
GGDTNINTAFATSLKANCPQSGGNTNLANLDTTTPNAFDNAYYTNLLSQKGLLHSDQVLFNNDTTDNTVRNFASNAAAFSSAFTTAMIKMGNIAPLXTGTXGSXAQCSKVN

SEQ ID NO: 187595 - protein, 92 aa, Triticum aestivum
  unsure (1)..(92): unsure at all Xaa locations
  Clone ID: PAT_TA_82013.pep
KTSRKRALITCHXGKQEHFHGVRVYMMLPWMDEVAAVEAWIISAWAEQEACSCGCCHGLSPMQTPPSINQLYKLDISSQSAQEAAPAPVLHI

SEQ ID NO: 187596 - protein, 82 aa, Triticum aestivum
  Clone ID: PAT_TA_82014.pep
PASARNPRARNRAPRPPTDRPIPAARALPRRGIPIDALSSRPGNRFLPLYKIEQFAEMGGVIGKGDTPRYSSSSYKVRAEDG

SEQ ID NO: 187597 - protein, 116 aa, Triticum aestivum
  unsure (1)..(116): unsure at all Xaa locations
  Clone ID: PAT_TA_82015.pep
XFFXFDLCIRKQENGSGHCPIFFLFFFLPSIKDLYFIFRSDFLHWIERQLLLLFITSLAAPPSVRLGCSSTGQNGHRAARARAVGCTLPCGAPAPVRVASRPAPGCRPHCAMHRAP

SEQ ID NO: 187598 - protein, 115 aa, Triticum aestivum
  Clone ID: PAT_TA_82016.pep
PPPLGTPVLIFSAFKESTQTHVQNLERQGKWMASSVKEKDITELREAEYLAKEISHRLPSKGRVVPTPKPNERVVFIPHLVRGLGFPLHPFIRGLMFYYGLDFHDLAPNSFLNIS

SEQ ID NO: 187599 - protein, 136 aa, Triticum aestivum
  unsure (1)..(136): unsure at all Xaa locations
  Clone ID: PAT_TA_82017.pep
MIFTCKVCETRSVKMASRDSYDNGVVVARCGGCNNLHLMADRLGWFGQPGSIEDFLAEQGQDVKKGDTDTLSFTXEDLAGSQGQIQGTFLVKISLAAVISWASGPSSSYNKTVTSLNETFANYSLISKLLKVDYNC

SEQ ID NO: 187600 - protein, 91 aa, Triticum aestivum
  unsure (1)..(91): unsure at all Xaa locations
  Clone ID: PAT_TA_82018.pep
SVTRQCNPQFYTHMTKTSQKFEMAEKLLISGTDGELMHCWIVHWTGLMILVLFTRMRRACMRCKDWVYXXEIYWXIMRGILFQGSXEADYF

SEQ ID NO: 187601 - protein, 129 aa, Triticum aestivum
  unsure (1)..(129): unsure at all Xaa locations
  Clone ID: PAT_TA_82019.pep
PDQQRLIFAGKQLEDGRTLADYNIQKESTLHLVLRLRGGMQIFVKTLTGKTITLEVESSDTIDNVKAKIQDKEGIPPDQQRLIFRWASSXEDGPHXLQDYNIQEGSTFTLVLRSXGGMQSSNLHWQTSP

SEQ ID NO: 187602 - protein, 124 aa, Triticum aestivum
  unsure (1)..(124): unsure at all Xaa locations
  Clone ID: PAT_TA_82020.pep
MVLDPNGIAEYDHTVYAQAGRSYYQVVIDVAMKQQYMRVAKVPADLMVVDLSCNRFSGFIPRSIGNLTYLHVVNLSHNAFRGKIPRELGQLXRIESLDLSWNRLVGEIPQELAMLTHLNGSTLL

SEQ ID NO: 187603 - protein, 133 aa, Triticum aestivum
  unsure (1)..(133): unsure at all Xaa locations
  Clone ID: PAT_TA_82021.pep
XXPAFGPGTGPTFNRPCYRAXPLALXXGPGPAVLAVLGPVPIXSHVALGNRILVGVATRCREPEKKHLDARWRERKAREREGAAWREAEAWWREGTTARGRGAAARGCARRGSRGRRRRRGGRGAAQGRKRDG

SEQ ID NO: 187604 - protein, 117 aa, Triticum aestivum
  unsure (1)..(117): unsure at all Xaa locations
  Clone ID: PAT_TA_82022.pep
MARLNSKAVAAAVVLAAVVLMMAGREGSAALSCGQVGSKXAPCVGXTGKRASXLRKDCCPGVQXAEXLGPQXPGRKIACKCLKXLATXIKXNNXXKAPGXPXXCGVXLPFPIKMSNK

SEQ ID NO: 187605 - protein, 140 aa, Triticum aestivum
  unsure (1)..(140): unsure at all Xaa locations
  Clone ID: PAT_TA_82023.pep
SLLRLLVLKFVLSMSASKDVLALASLEVDLSSIEPGSTVTVKWRGKXVFIRRRTDDDIKLGQQVGMLHPCATQXQDAERVXKNPXWWWVXGVXCIXLGCIPFPNXXNXGGGFCPFQGPNXESXGKSRKGPAPXTQLSSLG

SEQ ID NO: 187606 - protein, 178 aa, Triticum aestivum
  unsure (1)..(178): unsure at all Xaa locations
  Clone ID: PAT_TA_82024.pep
MDPPMPMSLVFPSTDPPKPAALLSMDLLLEEAFRAMARAAEQFRSLGEKQAKRLMVAGAGGGKLREVATQLXQVRDLLXAVDDGGSPRRRRRILLRIDDXLDEMEYTSRLPLEPLQIQIQSQPSLRLKLSIPQNNSMGSLPWSQPDPNIRLVNNQQSPLQLHARIKLWTGTKHNLITS

SEQ ID NO: 187607 - protein, 107 aa, Triticum aestivum
  Clone ID: PAT_TA_82025.pep
LPNLAILRLRKDSFEGEEVHLHFRWGESFPSLMVLELSSPGKLKSVEFQKGATPKLELLQYYDQPDHDQEDLVSKENDDHLKEVPAFCFPGANISGKQRNFARGWQL

SEQ ID NO: 187608 - protein, 92 aa, Triticum aestivum
  unsure (1)..(92): unsure at all Xaa locations
  Clone ID: PAT_TA_82026.pep
FFHILLAISXLPDQTEXKRXDLRSKNHPPRSSXPPNIYRXCHKEKCEXNPGXGIPRYXXRTCPQXAMXQFNSRLXAPXRSTQKTXPNXQLGG

SEQ ID NO: 187609 - protein, 77 aa, Triticum aestivum
  unsure (1)..(77): unsure at all Xaa locations
  Clone ID: PAT_TA_82027.pep
MGGGNAQKSKMARERNLEKLKGGKGSQLEANKKAMNIQXCKICMQTFICTTSEAKCKEHAEAXHPKSDSSNAPPTQE

SEQ ID NO: 187610 - protein, 78 aa, Triticum aestivum
  unsure (1)..(78): unsure at all Xaa locations
  Clone ID: PAT_TA_82028.pep
DNVKAKIQDKEGIPPDQQRLIFAGKQLEDGRTLADYNIQXKESTLHLVLRLRGWPIKVLGDGLCFGSGSQRLCFCTVH

SEQ ID NO: 187611 - protein, 98 aa, Triticum aestivum
  unsure (1)..(98): unsure at all Xaa locations
  Clone ID: PAT_TA_82029.pep
MAKSSFKLEHPLERRQAEATRIREKYSDRIXDRWRRLGKSDIPDIXDKKXYLGPADLTVWXSXYVVXRKRXKLXRLRSIFIFGGKILPTDSALIPXFX

SEQ ID NO: 187612 - protein, 132 aa, Triticum aestivum
  unsure (1)..(132): unsure at all Xaa locations
  Clone ID: PAT_TA_82030.pep
LQAPWGDLLQVCRKAELIDVGYEELIVKTNKVLLHKVDMEAQELVEINSLHHNVLFXGRNHLYALIAEXEYPATGRNLCPFPPDDEQHNLGXLKTNPPDISVLNLXKMIXEGILSPLXANWPXPIWIHPSLT

SEQ ID NO: 187613 - protein, 188 aa, Triticum aestivum
  unsure (1)..(188): unsure at all Xaa locations
  Clone ID: PAT_TA_82031.pep
IVFLSRKRVTIFDLFHKLVLRLLLYGVCNMYTYMLAKENHLFPLYQDKKTNLDSINYLGDSRSHVRETVMQRRPPTSSLMMLRALGHRALPSLKSRHGGHTVLVCLDHSSPQTSLNKCPXPIVRCXXRGFPPITHCLATRSTGNEANXRTRTXNIXTDXRXRSLXXPXXQGLLHITXWPXPTKARKXX

SEQ ID NO: 187614 - protein, 61 aa, Triticum aestivum
  unsure (1)..(61): unsure at all Xaa locations
  Clone ID: PAT_TA_82032.pep
EKAPYVAKANKLKGEYNKAIAACNKGESAAAAAPKKAAAKEVEEEDEEESDXSNRRLNDDE

SEQ ID NO: 187615 - protein, 82 aa, Triticum aestivum
  unsure (1)..(82): unsure at all Xaa locations
  Clone ID: PAT_TA_82033.pep
TXPSXSSXSSNSXXRSAPXTSPXLSDPSSYRXILXTYIIXVLVTXLHXIRTHXTXIFYVPVQALXXKCLRGSLVXHACLINX

SEQ ID NO: 187616 - protein, 89 aa, Triticum aestivum
  unsure (1)..(89): unsure at all Xaa locations
  Clone ID: PAT_TA_82034.pep
APPSSSSSAHASSADAPCGPTPRPTSPPPGRWLRAPRPSTSTSIPHCGSRFARFKNTCSGLGLSLLLXSNNDYTLNFHSKEYPMLQXFG

SEQ ID NO: 187617 - protein, 207 aa, Triticum aestivum
  unsure (1)..(207): unsure at all Xaa locations
  Clone ID: PAT_TA_82035.pep
VVGTHGYIAPEYASEGLFSTKSDVFSFGVLLLEIISGKRTAGFYQYGKFFNLTGYAYQLWQEAKWHEMVDQVLGVDYPVTEVMKCVQVALLCVQDSADDRPSMSDVVAMLSGEGLTLPEPRQPXYFNVRLSKLTXSNSSFGEXXYINNVALTDEDGNNKGGNQYNITIHGTSNQQEGIQLFMNNPAIKFKYFGSNYLSRQFQKLAQI

SEQ ID NO: 187618 - protein, 136 aa, Triticum aestivum
  unsure (1)..(136): unsure at all Xaa locations
  Clone ID: PAT_TA_82036.pep
MARTKQTARKSTGGKAPRKQLATKAARKSAPATGGVKKPHRFRPGTVALREIRKYQXKSTELLIRKLPFQRLVREIAQDFKTDLRFQSSAVSALQEAAEGYLVGLFEXDTNLCAINAKRVTSCQGHQLAAASWRKA

SEQ ID NO: 187619 - protein, 58 aa, Triticum aestivum
  Clone ID: PAT_TA_82037.pep
MPNNMNIHNNYLKIEEESFIGQDCVCTWHMTSASYLNKQLFHRWFNVEGCAWEFIPYH

SEQ ID NO: 187620 - protein, 114 aa, Triticum aestivum
  Clone ID: PAT_TA_82038.pep
AVLDCTGAGAGRAADRSTPSPCPASSQTRLWRFKEFTLLDNSCIYEVLLVGEPSSAILMCSMARTTADQAMATRKLVVKVVGAHGLAHSKRGLPSAFVVLSFDSQAVPHECQGE

SEQ ID NO: 187621 - protein, 111 aa, Triticum aestivum
  unsure (1)..(111): unsure at all Xaa locations
  Clone ID: PAT_TA_82039.pep
XCLVSATTLAYSHDPVLAYDKVCDSLPGADRVVEHEHIDDRITKYSGKYCDCQTHRGFHNIVENCSHTFMHLQVGSMTSHHCFLLIDVILIGRASFFRGSTCRWRVDMHIK

SEQ ID NO: 187622 - protein, 135 aa, Triticum aestivum
  unsure (1)..(135): unsure at all Xaa locations
  Clone ID: PAT_TA_82040.pep
IVQARHLGFPIAILWFASGVYHDVPIAGVGAPPSSSPRENPPSHRIFYFFQHFGEIASALFVTGRFVQVHTSFFQCIARSRSLARIPSLGCSATSWTPSARRTPVEIRCCNTSRKRPATRXNXRXIVLXELXTWT

SEQ ID NO: 187623 - protein, 147 aa, Triticum aestivum
  unsure (1)..(147): unsure at all Xaa locations
  Clone ID: PAT_TA_82041.pep
KKKGSVSFVIDCTKPVEDKIMEIASLEKFLQERIKVAGGKAGNLGDSVTVTRDKSKVTVTSDGAFSKRYLKYFDKEXYXKKHNVRDWFRVIXAANKERNVLRLPVLXIAEXKGEEXDLALLYCMLVIFELDLILLITTTVVSRNMNG

SEQ ID NO: 187624 - protein, 47 aa, Triticum aestivum
  unsure (1)..(47): unsure at all Xaa locations
  Clone ID: PAT_TA_82042.pep
RSKLHXXSLTAVLHYXFIIXPTQTXXXVXTKXIPXQXRRQXXIIEQC

SEQ ID NO: 187625 - protein, 79 aa, Triticum aestivum
  Clone ID: PAT_TA_82043.pep
VLCFPFKRKVEPHMQFVHLLVHNCFISKPYVGQSRLHSRTDIHHSSLLLIRHFLLLNLFYLRNLFYDMYSQLSQEDGTR

SEQ ID NO: 187626 - protein, 130 aa, Triticum aestivum
  unsure (1)..(130): unsure at all Xaa locations
  Clone ID: PAT_TA_82044.pep
VDVDIGANPSAEGGGDDEGVDDQAVKVVDIVDTFRLQEQPAFDKKQFISHMKRYIKNXSAKLEGDDLDAFKXKNVDPPQSIFLSKLKDLXFLWLGESMHDDGGVXVPLLQGGTADSTSLYFAHGLKEXXC

SEQ ID NO: 187627 - protein, 193 aa, Triticum aestivum
  unsure (1)..(193): unsure at all Xaa locations
  Clone ID: PAT_TA_82045.pep
MVSLKLQKRLASSVLKCGKGKVWLDPNEVNEISMANSRQNIRKLVKDGFIIRKPQKIHSRSXRARRAHEAKQKGRHSGYGXKRRGTREARSPXVLWMRRMRLLKRLLPKYRXAKKIXDKHMLHDMLPEXQGNMFKEQKASMENXHNSKAXKAREKPLXDHFEASRQDKDQXRNXKEEGRPLSQHGIKTTKQAK

SEQ ID NO: 187628 - protein, 150 aa, Triticum aestivum
  unsure (1)..(150): unsure at all Xaa locations
  Clone ID: PAT_TA_82046.pep
SSGATGKGSLTIGVVGSVLGVILLACLAGLIWYVRYGRNQPNTIGRAEKFTYQRLGSCDAVTSQWTETLEKGAFWRRLQRHTGCCEXEKLDVGYKKECAYYVQFXAKXPFIKXFEIYDPLXIAHHTPCXAGAXXESPACXTTMVIHFXSS

SEQ ID NO: 187629 - protein, 161 aa, Triticum aestivum
  unsure (1)..(161): unsure at all Xaa locations
  Clone ID: PAT_TA_82047.pep
VITMELHPSQKYIATKPACCDNVSPQNLHVAIXFATNLGPLQQVCCHKICPCERACHEXHSLVLGIATKXFVGICVXPNGGLXAIYSKPRENLAIHPCCHDTKKLHYLCHXLCHLGTFTWCDRSYATLYYATKIMHXRFLXEHIPRTSNRAQLPQQDNGTG

SEQ ID NO: 187630 - protein, 127 aa, Triticum aestivum
  unsure (1)..(127): unsure at all Xaa locations
  Clone ID: PAT_TA_82048.pep
KAEKAPAGKXPKAXKRLPAGKTASKEGGGXKRGRKKGKKSVETYKIYIFKVLXQVHPDIGISSKAMSIXNPSSNDIXSXKLPXEAAKXPRXNKNPTSLXGDSXSVRSLPGELXQXAFSEGTSQFTPP

SEQ ID NO: 187631 - protein, 130 aa, Triticum aestivum
  unsure (1)..(130): unsure at all Xaa locations
  Clone ID: PAT_TA_82049.pep
MAPVKLYGATLSWNVTRCVAALEXEAGVEYEIXVPINFXGTGEHKTPDHLRQGTPSGQGASLQDGDLYSSQQLLFSXTPXRKXNXPDCLKEGDIKXSXMGVFWSKWEPIHYTAVLPILFXXLXHXXFGDH

SEQ ID NO: 187632 - protein, 99 aa, Triticum aestivum
  unsure (1)..(99): unsure at all Xaa locations
  Clone ID: PAT_TA_82050.pep
PVCKLTCACFAPSVHNCDHKWEVLAAVPFQMQXSRSSDFDLLGKLDTSPFQRRPVXVQFLQRRYASREVFPKKAAXLTSIANFLTXPGYXXPFXEITSV

SEQ ID NO: 187633 - protein, 88 aa, Triticum aestivum
  unsure (1)..(88): unsure at all Xaa locations
  Clone ID: PAT_TA_82051.pep
LILQAVLVMGLLSHVNADFFPKCCNNCRSFSGVDVCDDAHPKCPQGCSACRVVSTSPEMWRCADMKSTVXDGTCGGTLQRTDPGSCPA

SEQ ID NO: 187634 - protein, 214 aa, Triticum aestivum
  unsure (1)..(214): unsure at all Xaa locations
  Clone ID: PAT_TA_82052.pep
IDLXXICTAPLXYFWSIAAPHXDRLFFLGPWIHGIGMTXXXLXXXGVPGIXWXSSCHXSRHRLFWTXXWSRSQPRDCXXRSLXHGSGAVDGVLELFVLAQALDQRGRREVQDWPIPRENPGAHSGDGRRGPLPRGLISTSFFHLFTRSGFLVRICQINKAKGKKPRNSHQARLLHLLDCKTHSHRLRRDCCVYQIKRIKRKKTEKKKKKKKKKT

SEQ ID NO: 187635 - protein, 78 aa, Triticum aestivum; identical to SEQ ID NO: 106980
  Clone ID: PAT_TA_82053.pep

SEQ ID NO: 187636 - protein, 130 aa, Triticum aestivum
  unsure (1)..(130): unsure at all Xaa locations
  Clone ID: PAT_TA_82054.pep
VRSFGIRRNEKIACYVTIRGEKAMQLLESGLKVKEYELLRRNFSDTGCFGFGIQXEHIDLGMKYDPSTGIYGMDFFGGCSERAGYRVSRPPQVQARVRYPPEGTKGGPMXWSKSITFILNNPMPTKRTYL

SEQ ID NO: 187637 - protein, 156 aa, Triticum aestivum
  unsure (1)..(156): unsure at all Xaa locations
  Clone ID: PAT_TA_82055.pep
NDVKNYWNTKLKKRLLGGRRKDRGAGTQQHRQGELDGANNDGEQQPLSASAMERXQLCMQLQEMQNPXSSIGNHNNPCTCGQPSTIIWPPSTINNSNSNSSAAQLRTLAKEFILMDSGGTHDPRKRCSRSKCTNRLRSLNGHDTRKQGVMGTYRNP

SEQ ID NO: 187638 - protein, 107 aa, Triticum aestivum
  unsure (1)..(107): unsure at all Xaa locations
  Clone ID: PAT_TA_82056.pep
EQVKLEASSRRATALPHGFSASDDSITQVSLEEVLRVSRPTSFPMKGFEQPKGVSXYREHPPKKDERXEENWMGLRRKXFVMVLLFQSNNITFGYLVEWSDPSRERX

SEQ ID NO: 187639 - protein, 87 aa, Triticum aestivum
  unsure (1)..(87): unsure at all Xaa locations
  Clone ID: PAT_TA_82057.pep
CINVXDSQFIFCXXSVGXPSQLFTLHIVAVVKRTFXEDPIGKILLRTRXCRXVRGMKPFXRKXFPRLDNIXLYIQFNIAHSSPRRLA

SEQ ID NO: 187640 - protein, 70 aa, Triticum aestivum
  unsure (1)..(70): unsure at all Xaa locations
  Clone ID: PAT_TA_82058.pep
RXLRPRPPSPPRXPPPRRRPPTPRCPPLXRPPRTCXPRPPXSSPXRAAXPLVSAPXXCWPXXRXPSTPSI

SEQ ID NO: 187641 - protein, 130 aa, Triticum aestivum
  unsure (1)..(130): unsure at all Xaa locations
  Clone ID: PAT_TA_82059.pep
PDHLPYSRSRRRRRCRRRRHRRGEVHRLEESGSSGAQPSAQLTRINAGSRGSSASAPVDLCGRHHGHXDTYTIPFFLSSPHYFFSWLAXKDDNTVQTGRXTTIDVCMYVCMLINTCGLCVVPXSIPASLQ

SEQ ID NO: 187642 - protein, 64 aa, Triticum aestivum
  unsure (1)..(64): unsure at all Xaa locations
  Clone ID: PAT_TA_82060.pep
ERERERERERERGXXLLMVLVSVVCXYHKCPLHVXXMNKWWCMWXEXRIGCICYAWXXIXPYLC

SEQ ID NO: 187643 - protein, 71 aa, Triticum aestivum
  unsure (1)..(71): unsure at all Xaa locations
  Clone ID: PAT_TA_82061.pep
MKPLFRSRSPLLTGSRLIFLPLATQMFQFAKFEKSKERRLATELGYGFPIGDPWITEXLSPWPFASESVLP

SEQ ID NO: 187644 - protein, 99 aa, Triticum aestivum
  unsure (1)..(99): unsure at all Xaa locations
  Clone ID: PAT_TA_82062.pep
KPHRFRPGTVALREIRKYQKSTELLIRKLPFQRLVREIAQDFKTDLRFQSSAVSALQEAAEAYLVGLFEDTNLCAIHAKRVTIMPKDIQLAPRXRWRKA

SEQ ID NO: 187645 - protein, 194 aa, Triticum aestivum
  unsure (1)..(194): unsure at all Xaa locations
  Clone ID: PAT_TA_82063.pep
GCILCVVGSTTIVLHAPAEREIESVAEVWDLATEPGFLLYAAIVLTAAFVLIFHFVPQYGQTHIMVYIGICSLFGSLSVMSVKALGIALKLTFAGMNQXLVYPQTWXFTLVVVACIVTQMNYLNKXLDTFNTXVVSPFXYTSYSVDILAXVIMSRTGSQNPIKCHGSVVVPSGLLLTRQMGDGSTDNQSDRIYN

SEQ ID NO: 187646 - protein, 167 aa, Triticum aestivum
  unsure (1)..(167): unsure at all Xaa locations
  Clone ID: PAT_TA_82064.pep
TLHLVLRLRGGMQIFVKTLTGKTITLEVESSDTIDNVKAKIQDKEGIPPDQQRLIFAGKQLEDGRTLADYNIQKEXTLHLVLRLRGGMQIFVKTXTGKTITLEVESSDTIDNVKAKSKTRXGIPPDXXRLIFXGNXFRMAXTLADYNIQKIHPLVVGALNGSGLVKA

SEQ ID NO: 187647 - protein, 81 aa, Triticum aestivum
  unsure (1)..(81): unsure at all Xaa locations
  Clone ID: PAT_TA_82065.pep
ILIXQAVXVMGLLSHVXANFFPKCXNNCRSFSGVXVXXDSHPKCXQXCSACRVVXTXPEMWRCADMKSTVXRXXSGXXTKY

SEQ ID NO: 187648 - protein, 78 aa, Triticum aestivum
  Clone ID: PAT_TA_82066.pep
KKYPNKAYLLYRPCWAANLSRRGEFHSVCPEMGCTFLKDIKPGISFNFFHYKILNSIDFYVWTISWILYLYKLFFKIV

SEQ ID NO: 187649 - protein, 180 aa, Triticum aestivum
  unsure (1)..(180): unsure at all Xaa locations
  Clone ID: PAT_TA_82067.pep
QPTPSWAREPLFEKAVTPSDVGKLNRLVVPKQHAEKHFPLKRTPETTTTTGNGVLLNFEDGEGKVWRFRYSVLGTAVKSYVLTKGWXSRFVREKDLRCRATPSVFSVLPRTGKEKHSSSDCKEEHDRTAICVAAAVVGDVKGEHSASLGFRVTSRIRCKRGGQGRIIKNARIPAVSSKDH

SEQ ID NO: 187650 - protein, 100 aa, Triticum aestivum
  unsure (1)..(100): unsure at all Xaa locations
  Clone ID: PAT_TA_82068.pep
PXFLNMDQRXXQLDALIFSRSLLAXCELRXYTIQNSCPRWDVXSAKLPKVISDRALGRMTENLVPTNKLSLAPSKFIVNTLPYLVYRSLIVTQTLFKNRR

SEQ ID NO: 187651 - protein, 54 aa, Triticum aestivum
  Clone ID: PAT_TA_82069.pep
FLFSHGKFFVLVAIANFIFSCHDKFFVRTMGNFNLNIMANLHFIEHGKFYYVAS

SEQ ID NO: 187652 - protein, 102 aa, Triticum aestivum
  Clone ID: PAT_TA_82070.pep
SSSMASILFKSASISSSVAWPQRGQHCCLSSISVPDVTPGSSRLTLAKTSCSNLQQQQLETQIEDNCVIRESKPSGDYIMNFYRPKYALCKKTESRKRTRCP

SEQ ID NO: 187653 - protein, 144 aa, Triticum aestivum
  unsure (1)..(144): unsure at all Xaa locations
  Clone ID: PAT_TA_82071.pep
XXQSRAWLYANVGTHLXLPXXMXKXARENPLEAGGEXXGELLGIXGRRGFTAVXMCAXFTESXCERRKVQSWRKVRGVRMTGGAEGLHWREKLPGEARXGCCSLAAALLGQGAPGEIGPGKCXPFFSISVYLNKQLHEKKRPGG

SEQ ID NO: 187654 - protein, 29 aa, Triticum aestivum
  Clone ID: PAT_TA_82072.pep
SRRFSIFCVVVIESLVMNFIYHFVNPHCV

SEQ ID NO: 187655 - protein, 121 aa, Triticum aestivum
  unsure (1)..(121): unsure at all Xaa locations
  Clone ID: PAT_TA_82073.pep
ITDFQGNQYPSMCTENXKRLKIDWKLKLSSTWKDLTVGCCKTSXCGPSCSWFXXNINLWXIXNXHINLXSIXRXNTIXNRLXHNSWXSSXVXIHGXXEXPYIEATSXRXXPXXXXTXSKDK

SEQ ID NO: 187656 - protein, 138 aa, Triticum aestivum
  unsure (1)..(138): unsure at all Xaa locations
  Clone ID: PAT_TA_82074.pep
FWXGVAAPXGXGXSXLRXLKXPXGPEPSGDXXPCSAPVPPRASVAPGGYRPRPPRHGGARRISMLHGRSRHGGRKDGGGQHPSWPGSLRDGAQHAAYCLAALSTLPFLPTRHGRQRPTPGARHEXSQGGPSIGHATTL

SEQ ID NO: 187657 - protein, 80 aa, Triticum aestivum
  unsure (1)..(80): unsure at all Xaa locations
  Clone ID: PAT_TA_82075.pep
DHXIKXTWXYMVDHMXNNNRSYELIFVFISFIIXEEYVLDPIFPFSLMMMKCNLTGTMMKFWKXNKMQCDRFETTKKHKN

SEQ ID NO: 187658 - protein, 54 aa, Triticum aestivum
  Clone ID: PAT_TA_82076.pep
SPLILQYDCFHDFQKRNILKVECSWTDLNPFEPRKVDADCPQSFGDMNSRWERV

SEQ ID NO: 187659 - protein, 131 aa, Triticum aestivum
  unsure (1)..(131): unsure at all Xaa locations
  Clone ID: PAT_TA_82077.pep
SRFXXHSAVXDLXSVPVFVQPIQDLCXNLHFXVHKFICITXXGSKVCQXHQXGISVRREGTIAQNVSLSIEIPTRXFXVWXMFSRSKKXGVQDHLKPLVIDRVEAVGADAFLQWRRQQVWVAVNVXAEHGS

SEQ ID NO: 187660 - protein, 77 aa, Triticum aestivum
  Clone ID: PAT_TA_82078.pep
SETDGQDRSSEHEMLFRSPLDLNYCCLCDLVASAAALLSICWLITGWMYPSSLSLCPSYSSCLGTCHPHACLSKYNS

SEQ ID NO: 187661 - protein, 192 aa, Triticum aestivum
  unsure (1)..(192): unsure at all Xaa locations
  Clone ID: PAT_TA_82079.pep
TDYMTYMFKYDTVHGQWKHHEVKVKDSKTLLFGQKEVAVFGCRNPEEIPWAAAGAEYVVESTGVFTDKDKAAAHIKGGAKKSSFLLPTKDAPMFVCGVNEXGYKXSDIXIVXNANCNNNWPCXLXAXGINDKVGIVXGLMTKVNAXMTXTQKTVNGPPTRAGKWKGCKKTSNMVPKGFEPLTETRLPSVSSL

SEQ ID NO: 187662 - protein, 51 aa, Triticum aestivum
  Clone ID: PAT_TA_82080.pep
GANWQCNAPLVGQGISFSVTSTNGQTLYMYNLVPAWWGFGMTFTSNQQFGY

SEQ ID NO: 187663 - protein, 103 aa, Triticum aestivum; identical to SEQ ID NO: 107316
  Clone ID: PAT_TA_82081.pep

SEQ ID NO: 187664 - protein, 149 aa, Triticum aestivum
  unsure (1)..(149): unsure at all Xaa locations
  Clone ID: PAT_TA_82082.pep
GTRKTMAAIRTAISHVQNLITGVTKGFRYKMRFVYAHFPINASITAANRGIEIRNFLGEKKVRKVDMLDGVTXLRSEKGQGMXLLDXNKSTRLRSAALINQEMQLKNKXSGILGRILTRGQSRRKCENQKPCSACLNRLGPGWNNFPKR

SEQ ID NO: 187665 - protein, 156 aa, Triticum aestivum
  unsure (1)..(156): unsure at all Xaa locations
  Clone ID: PAT_TA_82083.pep
TYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVXPKDVNAAVXTSKTKRTIQFXVDWCPXGFKCGINYQATSVXPSGDLAXVQXAVS

SEQ ID NO: 187666 - protein, 180 aa, Triticum aestivum
  unsure (1)..(180): unsure at all Xaa locations
  Clone ID: PAT_TA_82084.pep
DSKTLLFGEKEVAVFGCRNPEEIPWAAAGAEYVVESTGVFTDKDKAAAHIKGGAKKVIISAPXKDAPMFVCGVNEKEYKSDIDIVSNASCTTNCLAPPAXVINDKFGIVXGLMTTVQAMTATQKTVDGXNKDWRSGKAAXFNINPNNTGAQXCWXVLPKLTEVDWGSSTVFVVTLNQTTI

SEQ ID NO: 187667 - protein, 186 aa, Triticum aestivum
  unsure (1)..(186): unsure at all Xaa locations
  Clone ID: PAT_TA_82085.pep
LGISVPMMSSSPLFANAPPEKKGVKNFAIDFLMGGVSAAVSKTAAAPIERVKLLIQNQDEMIKAGRLSEPYKGIGDCFGRTIKDEGFGSLXWRGNTANVIRYFQXXVLNFXFKXYFKEDFNXKXGXDGYWXWFXGXNLASGXCNWCFPVLYPFSWQKSKVEEKGWLFTQINGRAYGTPVEHATGVL

SEQ ID NO: 187668 - protein, 131 aa, Triticum aestivum
  unsure (1)..(131): unsure at all Xaa locations
  Clone ID: PAT_TA_82086.pep
DNPRKMSYVVGYGKRYPRRLHHRGASTPNNGVRYSCTGGNKWRDAKGKDPHVLTGAMVGGPDKHDKFKDARIXYAQNEPTLVGNAGSXRRLXAITSSGRGLGVRAVRQEHISTPFPPMFPAXPPPPATGTV

SEQ ID NO: 187669 - protein, 65 aa, Triticum aestivum
  Clone ID: PAT_TA_82087.pep
FIIVIAIGRALRTVQFSESVKCRLKRKASDIAVLRYLYYTYTKVNTVSWDTHCISLHYTLPFERT

SEQ ID NO: 187670 - protein, 113 aa, Triticum aestivum
  unsure (1)..(113): unsure at all Xaa locations
  Clone ID: PAT_TA_82088.pep
IFAGKQLEDGRTLADYNIQKESTLHLVLRLRGGMQIFVKTLTGKTITLEVESSDTIDNVKAKIQDKEGIPPDQQRLIFAGKQLEDGRTLXADYNIQXKESTLHLGAPSPLVGN

SEQ ID NO: 187671 - protein, 69 aa, Triticum aestivum
  Clone ID: PAT_TA_82089.pep
ERWPPLESSPEVFNQFMWSLGVPRGEAEFHDVYGLDADALAMVPQPVLAVVFCFPDPEDSRPSKTSLNY

SEQ ID NO: 187672 - protein, 151 aa, Triticum aestivum
  unsure (1)..(151): unsure at all Xaa locations
  Clone ID: PAT_TA_82090.pep
NNELVRTQTLVKNAIVQVDAAPFKQWYLTHYGVEIGRKKKAAAAAKKEAAEGQEAEVAAAATEEAKKSNNVQEEALRSASRDVHWDSHIXGAFXGGKAGWACISSRPGQCXXADGVHXLXGKGLEFYMKEXQKKKGXGATLSKTAACYLVS

SEQ ID NO: 187673 - protein, 80 aa, Triticum aestivum
  Clone ID: PAT_TA_82091.pep
CGKWHLHIIVMLLFWRKPKAIIRTCNQTLYYYSSSIWLLCYIGVLPGFLAGYKLTGQCSRPSKSYDIVMWNSSNLYKVRS

SEQ ID NO: 187674 - protein, 100 aa, Triticum aestivum
  unsure (1)..(100): unsure at all Xaa locations
  Clone ID: PAT_TA_82092.pep
YISTPXLXXCEEMLXXITSNDSSSHLRAXNDTXFXXQEXXQKXXXSSLRSQXXGLKDAXXXSRXSSXQGTXGQGAMXXPAXKASLAQXNLPCLXXGGRSX

SEQ ID NO: 187675 - protein, 188 aa, Triticum aestivum
  unsure (1)..(188): unsure at all Xaa locations
  Clone ID: PAT_TA_82093.pep
TMSEDEDEGPPMIMEAAPMDMSSNGHDMMGFGPLVPTDTERSLMERVRQELKIELKQGFKSRIGDVREEXXXRRRAGKLPGDTTTILKQWWQEHAKWXYPTEDDKANLLKRLGLQLKQXNNWVINQXEPNWAQQSPRHQPNQSLKVLQNCKYIHAYIYLTLTHNFRDTHTERERIRSNHCKPIIIRDT

SEQ ID NO: 187676 - protein, 113 aa, Triticum aestivum
  unsure (1)..(113): unsure at all Xaa locations
  Clone ID: PAT_TA_82094.pep
KRRATGGKQKAWRKKRKYELGRQPANTKLSSNKTVRRVRVRGGNVKWRALRLDTGNFSWGSEAVTRKTRLLDVXYNSVRTMSLVRTQTLVKNAIGASLMHPFSNNGYLTHYGV

SEQ ID NO: 187677 - protein, 137 aa, Triticum aestivum
  unsure (1)..(137): unsure at all Xaa locations
  Clone ID: PAT_TA_82095.pep
MKFIAAYLLAYLSGNASPSAEDLTSILESVGCEIDNEKMELMLSQVKGKDITELLAAGXGRXCCGPSGGGGVGCFNWLPLLLGGAAAPGKLSPKKEEKSXEKEESDDDMGSSVPTKLWGLVPEPLGKETRNGLTFIN

SEQ ID NO: 187678 - protein, 110 aa, Triticum aestivum
  unsure (1)..(110): unsure at all Xaa locations
  Clone ID: PAT_TA_82096.pep
KIPCIHTGYRWTNNILCSYCTSLAWVSXSVSHDVSNNVGRSFFPKHWNVXNTPIPWQSMGXKATHAKPGPQLPPSXHFPFCLXNLXLXHFFLGXTFLMANFXEPTXWGTG

SEQ ID NO: 187679 - protein, 108 aa, Triticum aestivum
  unsure (1)..(108): unsure at all Xaa locations
  Clone ID: PAT_TA_82097.pep
MVVVVATASPGGPEALQVCALLTSGGYAEKVVVPAGQLLPVXREGASLTDXPEVASTVWVHHFHANHLSLRXTFLIHGGSKWNPGTFNYTRIQKHLWEMLHTETLFFG

SEQ ID NO: 187680 - protein, 101 aa, Triticum aestivum
  unsure (1)..(101): unsure at all Xaa locations
  Clone ID: PAT_TA_82098.pep
RGGVGGAHQGAAAAARGRAVPGVAVPAPHRGQVAAQEPPPALPARRERRAHRQRRLGDPIRRCIRDRSAAATLVKASARAGRWLLWEHGISTARQRPMSXI

SEQ ID NO: 187681 - protein, 54 aa, Triticum aestivum
  unsure (1)..(54): unsure at all Xaa locations
  Clone ID: PAT_TA_82099.pep
SYLVTKLSIVLPELKTGKCDDITVNALXKXICQNPPPQXXSPFGKXPXKKXGGK

SEQ ID NO: 187682 - protein, 109 aa, Triticum aestivum
  unsure (1)..(109): unsure at all Xaa locations
  Clone ID: PAT_TA_82100.pep
FFXEAPILFXXRRXKKMVLXQGXHEHPEKKSTSXKXXFQLEERRKERSEQLTSSLSXRGEGGVGGRRRDPVDRLEHVLHGGPLAGRRGAAREPQPQAARQRLLPALHLP

SEQ ID NO: 187683 - protein, 55 aa, Triticum aestivum
  unsure (1)..(55): unsure at all Xaa locations
  Clone ID: PAT_TA_82101.pep
EEAIDRRSLARMIYRNWSLLSSTVVIWGSVGAAGLAGIFLFGXKEKFQXFFXRXX

SEQ ID NO: 187684 - protein, 46 aa, Triticum aestivum
  Clone ID: PAT_TA_82102.pep
ITLDSSYHSSRATNGPCEGYIQPTLMHASELNNDIVTTQMQIVPGR

SEQ ID NO: 187685 - protein, 53 aa, Triticum aestivum
  unsure (1)..(53): unsure at all Xaa locations
  Clone ID: PAT_TA_82103.pep
SPXWVKPYFFXTQRKAGPLPGQPXPPXQQRPASPPTPSRPPPXSGEGGNSDWG

SEQ ID NO: 187686 - protein, 53 aa, Triticum aestivum
  Clone ID: PAT_TA_82104.pep
LILTGSSSNEAPACHGHWLMAAYHLECLLEVGHDLRHGRPVHPRQAEAALRRV

SEQ ID NO: 187687 - protein, 76 aa, Triticum aestivum
  unsure (1)..(76): unsure at all Xaa locations
  Clone ID: PAT_TA_82105.pep
SRAAREEIWQAGEIVAGKPFLLQAKFGDPNYAQLKQVWSSPDNFLDLPKSSADAAQFYHTQQGYATEXLVGTXFGA

SEQ ID NO: 187688 - protein, 154 aa, Triticum aestivum
  Clone ID: PAT_TA_82106.pep
GAKRHRKVLRDNIQGITKPAIRRLARRGGVKRISGLIYEETRGVLKIFLENVIRDAVTYTEHARRKTVTAMDVVYALKRQGRTLYGFGGASISVRNPSPPRLQPNNFRPAVGCSLQTPRKLFISSFNSCYPGTMLPVQPICIPNYLGTPPKYLP

SEQ ID NO: 187689 - protein, 73 aa, Triticum aestivum
  Clone ID: PAT_TA_82107.pep
FFFWKRRPSGSASWLTGSSELSEKGSATLRKDLTSFIQFIWPQYWFHTCMLGLLGPTLAIHSLWLKFRRTERD

SEQ ID NO: 187690 - protein, 80 aa, Triticum aestivum
  unsure (1)..(80): unsure at all Xaa locations
  Clone ID: PAT_TA_82108.pep
MSCCGGNCGCGTACKCGNGCGGCNMYPEVEAAGATLLVSATATHKASSGGMEMAAENGGCGCTQXCKCGTSCGCSXCCSC

SEQ ID NO: 187691 - protein, 150 aa, Triticum aestivum
  Clone ID: PAT_TA_82109.pep
CQFKIGQHCWVNKPRRCIGHDQRVYGRDWPGRACRGTRRVVCVGVRVVHGRVRAGEHRTGCVCRLGQCVIRAQRERVIVEGSAQGARAERVAGRAERADRSARVGRCEWVGAQRCPGIKAAAVIIVSVWCCAEFVLRKWRSENPPCLRVL

SEQ ID NO: 187692 - protein, 109 aa, Triticum aestivum
  unsure (1)..(109): unsure at all Xaa locations
  Clone ID: PAT_TA_82110.pep
GXDPLFARMLAHSGIXXRIIFXEQRXSXVXXAXNTTXRVQASPRGPIKPTHTHKXFAFXXRHLDWXKGEHVTCNASVRKGCVQKVSLLDCVTPINCPVFFCTSGPPLRT

SEQ ID NO: 187693 - protein, 136 aa, Triticum aestivum
  unsure (1)..(136): unsure at all Xaa locations
  Clone ID: PAT_TA_82111.pep
MAPKAAEKKPVAVAAEKTAAGKKPKAEKRAAATKEAGGEGKTRGRKKGSKAKKGVGDVTRFYIFKVLKQVHPDVGISSQAMSIMNXFIKRIFEELAGDXAKXARYNKKPTSLPGXQXRRLVFPGDSPALSGTRPYN

SEQ ID NO: 187694 - protein, 165 aa, Triticum aestivum
  unsure (1)..(165): unsure at all Xaa locations
  Clone ID: PAT_TA_82112.pep
MSDTDEHHFESKADSGASKTYPQQAGAIRKGGHIVIKARPCKVVEVSTSKTGXKHGHAKCHFVAIDIFXMGKNXEDIVLHPHNCDSPMFDRXDYQXIXDITDDGISXFSTEIGYTKDDLNFPTDDVLLXQXKTXFADXKTYSVRIPPGXKXICLLRNPWITISWF

SEQ ID NO: 187695 - protein, 59 aa, Triticum aestivum
  Clone ID: PAT_TA_82113.pep
VSPDSAKWLEAMKSEMGSMYENKVWTLVDLPVDRQAIENKWIFKKKTDADGNVTIKKKK

SEQ ID NO: 187696 - protein, 113 aa, Triticum aestivum
  unsure (1)..(113): unsure at all Xaa locations
  Clone ID: PAT_TA_82114.pep
STLHLVLRLRGGAKKRKKKTYTXPKKQKHKHKKVKLAVLQFYKVXDATGKVTRLRKECPNADCXAGTFMANHFDRHYCXKCGLTYVYNQXALLAIALLYLPIESTHLHVSLSL

SEQ ID NO: 187697 - protein, 113 aa, Triticum aestivum
  unsure (1)..(113): unsure at all Xaa locations
  Clone ID: PAT_TA_82115.pep
RRSAGAAAEVPRGPAGARRRGGRGAPPRPQTREVQRLTVAFPCSFWRSVGWLMFGRXRDDFGSCFVLCEMKHREIRDYYFLLRKLEEXETTANIPVNVXNKDGKKEXXTKKKK

SEQ ID NO: 187698 - protein, 97 aa, Triticum aestivum
  unsure (1)..(97): unsure at all Xaa locations
  Clone ID: PAT_TA_82116.pep
PLRILLSFDRDMDCHTDGFMAVVAHHTHVWLLEEQLSPAAVLXRTXAMRLYTGEKXSXGQYVXRXEPSNYLSXRRXHLRLIHPLLAPNXCSQISIVK

SEQ ID NO: 187699 - protein, 64 aa, Triticum aestivum
  unsure (1)..(64): unsure at all Xaa locations
  Clone ID: PAT_TA_82117.pep
RQIRRKMVEIMVNQAASCDLKELVNKFIPEVIGKEIEKATSSIFPLQNVYVXRKGERFLKAPKF

SEQ ID NO: 187700 - protein, 112 aa, Triticum aestivum
  unsure (1)..(112): unsure at all Xaa locations
  Clone ID: PAT_TA_82118.pep
LIFAGKQLEDGRTLADYNIQKESTLHLVLRLRGGMQIFVKTLTGKTITLEVGSSDTIDNVKAKIQDKEGIPPDQQRLIFAGKQLEDGRTLADYNIQXKESTLHLVLRLRGGQ

SEQ ID NO: 187701 - protein, 150 aa, Triticum aestivum
  unsure (1)..(150): unsure at all Xaa locations
  Clone ID: PAT_TA_82119.pep
SLSLSLSLSLSLSLAIXKYIEEKHGKSLPANFKKMLSVQLRASAAKGKLVKVXASYKLSXAAKKDAPKPKAKPAAPKAAAKPAKGXXXKGXXEXSAKPKKAAAXTKRKAPXXXTWSQRQKIAAGXARKSKTXLPAQRRRKSRRYMNKYSL

SEQ ID NO: 187702 - protein, 72 aa, Triticum aestivum
  unsure (1)..(72): unsure at all Xaa locations
  Clone ID: PAT_TA_82120.pep
MAVGKNKRISRGRXGXKXXAVDPFTKXQWYDIXXPXLFTXRNVXNTLXSXTXGTXIASXGLNXKVFXXSLXD

SEQ ID NO: 187703 - protein, 92 aa, Triticum aestivum
  Clone ID: PAT_TA_82121.pep
QGGGRVVGPPPAPTKIPQGEQEGASEGGEAAAAEGSSSRGRGLRSPPASDGLLKPRQRNDVHSFRQILIAVLALCRHDFSLTFQLLGAEVFG

SEQ ID NO: 187704 - protein, 120 aa, Triticum aestivum
  unsure (1)..(120): unsure at all Xaa locations
  Clone ID: PAT_TA_82122.pep
AVPKKVADPFDFGGGHMDPDKATDPGLVYDVDAREYNKFFNCTVGLLHGCESYQLNLNLPSIVVPNLKDHVTVMRTVTNVGAVGTTYHAXLELPVRVVMSMEPSNDIPLKDNNKNAHLRV

SEQ ID NO: 187705 - protein, 64 aa, Triticum aestivum
  unsure (1)..(64): unsure at all Xaa locations
  Clone ID: PAT_TA_82123.pep
SXFFPLSSLPXRSGCFEGXESXWVLVALDGREXRRSTNXKSAKAFFFYGCNDKKPXKFSRKFXE

SEQ ID NO: 187706 - protein, 130 aa, Triticum aestivum
  unsure (1)..(130): unsure at all Xaa locations
  Clone ID: PAT_TA_82124.pep
YKVGEHVDVKVNGAVHKGMPHKFYHGRTGRVWNVTKRAIGVEINKQVGNRIIKKRIHVRVEHVQPSRCNEEFXKRKLNNDKLKAEAKARGEVISTKRQPXSPKPGFMVGGTTIRDGTPSRYNFVNSRVVN

SEQ ID NO: 187707 - protein, 99 aa, Triticum aestivum
  Clone ID: PAT_TA_82125.pep
RLFETACTSGSTRVTPARCGDQSEHMTPPGIFLCRRFCLRRGLCPPHRQLSMSTVISRLDPIWPEIAQRSRLTGRAKQRQQRRCRRRLHRRYVRTPPDP

SEQ ID NO: 187708 - protein, 72 aa, Triticum aestivum
  Clone ID: PAT_TA_82126.pep
ATGVAIGICAFSLLRNITGNPEVRVNKMGRAAGVLENHEEGRRYAEHGLRAYVQDKTPEIMPGINKFFTSPK

SEQ ID NO: 187709 - protein, 97 aa, Triticum aestivum
  unsure (1)..(97): unsure at all Xaa locations
  Clone ID: PAT_TA_82127.pep
IHVGLPILLLXSTLVDKLLKYNQXTSAXIETALVDMLFPPSHXXNSVFXXSIVSTNTLIXCQSLACSSXQLLGNXXVSSLADLSXLQFHLXAWAAXG

SEQ ID NO: 187710 - protein, 84 aa, Triticum aestivum
  unsure (1)..(84): unsure at all Xaa locations
  Clone ID: PAT_TA_82128.pep
RNPFAPKSWIVWYMSRYXRSEFRPSDYMFRLLYRDHPRRRIVRRTSASARKFIGKVRQGWTMQHIASMYGSLDAGMLAADKSMH

SEQ ID NO: 187711 - protein, 171 aa, Triticum aestivum
  unsure (1)..(171): unsure at all Xaa locations
  Clone ID: PAT_TA_82129.pep
EEMGLTFTKLFSRLFAKKEMRILMVGLDAAGKTTILYKLKLGEIVTTIPTIGFNVETVEYKNISFTVWDVGGQXDKIRPLWXRHYFQXNTQGLIFVVXDNNDRDRVVXEARDDSHRMLNEDDLXXAVCLCLANXKXFPNAMNAAEXTDSLAASLRQRHWYIKHFAQQGKDV

SEQ ID NO: 187712 - protein, 83 aa, Triticum aestivum
  Clone ID: PAT_TA_82130.pep
LMEITDVPQFPLSEEKDAEVRGAAQELVQVCQTLKGGLDSLERQVREMFHQIVHTTIEIYNCLSMPNCSAKKFPRAKHRYMFI

SEQ ID NO: 187713 - protein, 91 aa, Triticum aestivum
  Clone ID: PAT_TA_82131.pep
GNLRDSMADLVGAVINKSYLSMKSSFTKGLHDYWEWKPLSLEHLKYAAIVSENFIFYDFLSLYFCFTTTIVLFPLYVYLHFHPFFVLRMGM

SEQ ID NO: 187714 - protein, 140 aa, Triticum aestivum
  unsure (1)..(140): unsure at all Xaa locations
  Clone ID: PAT_TA_82132.pep
PVSTATIQLENIGCSGSLSHMTHLHPSLYVLTVGFRQAEAHQESRMPTXHPPSARTRTTQTSAFFNPTVQQPIQHRGSLHWASLVGTSGIXGSGGDIMVFDAXTNHSDGAXQPTCXVEFSTWRELLVGGRYKSLKVRGSH

SEQ ID NO: 187715 - protein, 164 aa, Triticum aestivum
  unsure (1)..(164): unsure at all Xaa locations
  Clone ID: PAT_TA_82133.pep
AACFLXIXMXIIMSSWSENYGDQSEXXDLMSQFKVAAKAIXSDXKIALLGAIQSLFEGSMYTFVFXWTPALSPNDEHIPHXFIFATFXLSSMLGXSIASRLLARKMKVEXYMHIVFAXSAFNXFLPVAXSFWXRPLSEXXRISXXGXLQLLGFCXFESADFAST

SEQ ID NO: 187716 - protein, 56 aa, Triticum aestivum; identical to SEQ ID NO: 134756
  Clone ID: PAT_TA_82134.pep

SEQ ID NO: 187717 - protein, 100 aa, Triticum aestivum
  Clone ID: PAT_TA_82135.pep
RQATIDREPQKEVWIGEVQLWSSAEASFSPRTREDIPNITMEATLTMGGSSHNHNGPKMGNGNGGNNGQNRFNPTTPAKKVLITLLVSNAGKNGHYPPMS

SEQ ID NO: 187718 - protein, 118 aa, Triticum aestivum
  unsure (1)..(118): unsure at all Xaa locations
  Clone ID: PAT_TA_82136.pep
FFFXNLRLNPIASTMGIFTLHYWIISSVSCLLTGFNRSHLQLYTRASMDGIIQLASATRLTANTESRSAGTRKYSVASPSSRLHRRSAKIATAVLAFLGAGGHVAASQGILHPSPLGV

SEQ ID NO: 187719 - protein, 71 aa, Triticum aestivum
  Clone ID: PAT_TA_82137.pep
KWSKILSFGKIPMLNLFQRFCSTYIDLYSSRQGRGTPTVNEQTNPTQKNQTSLCELRANNNSTCAAEMDRA

SEQ ID NO: 187720 - protein, 85 aa, Triticum aestivum
  Clone ID: PAT_TA_82138.pep
KAVALQLNWLTQHHAVPRRSTRPPPSTLTQPAPPPAALAPHTLTLATAAAGSSAAAAAASTGASSAAAGAAGSASAAGAASSFTS

SEQ ID NO: 187721 - protein, 128 aa, Triticum aestivum
  unsure (1)..(128): unsure at all Xaa locations
  Clone ID: PAT_TA_82139.pep
HESFFSQTKTNPATMSGRGKGGKGLGKGGAKRHRKVLRDNIQGITKPAIRRLARRGGVKRISGLIYEETPRXLKXFLRELIRDAVTYTXTPPAKTXTAMDSSMPQRRPPTFRSNLYGPLWESPFQCFL

SEQ ID NO: 187722 - protein, 81 aa, Triticum aestivum
  Clone ID: PAT_TA_82140.pep
IDTHPDPMTQPNIHGSSSEPNNHHTHGPRELRRLQNTVSTTNQLCQRVLGYHGSGPLDADLRIAGSRYQRLHQLIDPRMIF

SEQ ID NO: 187723 - protein, 120 aa, Triticum aestivum
  Clone ID: PAT_TA_82141.pep
YIEEKHGKALPANFKKMLSVQLRSSAAKGKLVKVKASYKLSDAAKKDSPKAKPAAKPAKDAAKAKKTVAAKPKKTAAAGTKRKAPEKKKLVTKGQESPAARQGEPKRPSPAAKKTQGPAA

SEQ ID NO: 187724 - protein, 88 aa, Triticum aestivum
  unsure (1)..(88): unsure at all Xaa locations
  Clone ID: PAT_TA_82142.pep
SRVRPKLDTSTRTAGVSLENGNLSRKDAGGISFEREFPHLSSEDNDGKQDISRVPSPGXISTPLQXSIPLVTAXLDGWXSVLAEVPGT

SEQ ID NO: 187725 - protein, 84 aa, Triticum aestivum
  unsure (1)..(84): unsure at all Xaa locations
  Clone ID: PAT_TA_82143.pep
MSDLDVTLPSAFDPFAEANAEDAGCRPRRKRYVHVRIQQAQRQEXLTXVQGLKKXFNYNKSSRFQEGFCCNGYPRFTRQVINLR

SEQ ID NO: 187726 - protein, 82 aa, Triticum aestivum
  unsure (1)..(82): unsure at all Xaa locations
  Clone ID: PAT_TA_82144.pep
HSLSTLPYSSTHTHLHPYLPFSTILTTISKKITCALITPHNTTFKXINPALTPPXRIKLICSLLIXIPRLISKEIISSKVXK

SEQ ID NO: 187727 - protein, 130 aa, Triticum aestivum
  unsure (1)..(130): unsure at all Xaa locations
  Clone ID: PAT_TA_82145.pep
WMRRMRVLRRLLRKYREAKKIDKHMYHDMYLKVKGNMFKNKRVLMESIHKSKAEKAREKTLSDQFEAKRAKSKASRERKCXEGKERLAQGPRDHAPAPAAAAPAQAATAPKEGKNEGLIRTLSFWYQGLT

SEQ ID NO: 187728 - protein, 75 aa, Triticum aestivum
  unsure (1)..(75): unsure at all Xaa locations
  Clone ID: PAT_TA_82146.pep
CSMYKREFCKRSYNASNRHGRQPQKTKTYYSLCPEILVGQMDESRRILVIDTPNCSHLSDKYFGTEGVHVYVMXN

SEQ ID NO: 187729 - protein, 86 aa, Triticum aestivum
  Clone ID: PAT_TA_82147.pep
RVFFFFFFFLQLRHFRVPIGRQPFRGFLRDRFTLRRLTERRKPSTGRRSCFSQDFSLLMSAFSLLISPGLVTKNLPRLTERPATDT

SEQ ID NO: 187730 - protein, 132 aa, Triticum aestivum
  unsure (1)..(132): unsure at all Xaa locations
  Clone ID: PAT_TA_82148.pep
MVKAVAVLTGSEGVKGTIFFTQEGEGPTTVTGSVTGLKEGLHGFHVHALGDTTNGCMSTGPHFNPAGHVHGAXEDEIRHAGDLXNVTXGXDGVAXIXITDWHIPLXGQXXXGPXVVLQGXPDDXXXGGILRE

SEQ ID NO: 187731 - protein, 79 aa, Triticum aestivum
  unsure (1)..(79): unsure at all Xaa locations
  Clone ID: PAT_TA_82149.pep
AEYGSLGKASRKSDVFSYGIMILEVFTXRRPTDATFGAQPXTLRQWXVNRAFPQSLSKVIDGQLLQDPLLSCGLGQWLS

SEQ ID NO: 187732 - protein, 132 aa, Triticum aestivum
  unsure (1)..(132): unsure at all Xaa locations
  Clone ID: PAT_TA_82150.pep
LNLGPQYNDQIKKVVEGLYKCFIETDAILLEINPLGLTIDGKVLICDQKMNVDDNAAYRXPEIAQMEDITQKDTKEIEADKNALNYIALXDGNIGCMVNGAGLAMATMGFDSIQRMGMPANSWDCGGKADDR

SEQ ID NO: 187733 - protein, 158 aa, Triticum aestivum
  unsure (1)..(158): unsure at all Xaa locations
  Clone ID: PAT_TA_82151.pep
MSKRGRGGSAGNKFRMSLGLPVAATVNCADNTGAKNLYIISVKGIKGRLNRLPSACVGDMVMATVKKGKPDLXKKXMPAVIVKQRKPWRXKDVSSSTSKDNAGSMVKPKXGEMKGLPSLGPXWKEXADWWPRLPTQRTHRLSRTTRRLDNSSLSYLWP

SEQ ID NO: 187734 - protein, 84 aa, Triticum aestivum
  unsure (1)..(84): unsure at all Xaa locations
  Clone ID: PAT_TA_82152.pep
VSGVSAYTGGIWVAALQAAAAMAHIVGDGDAECCFRARYLRAKRVYGEELWNGTYFNYDNSGGKTSRPSKADQXAGQWYTLCGS

SEQ ID NO: 187735 - protein, 83 aa, Triticum aestivum
  Clone ID: PAT_TA_82153.pep
FFFFRYGYHLLFDRTDQKFLLQSSVCLLRERMVVQCNIDNGQHHLIQSAGICQEVLSDFIRREVLAHSYALHNQHINTLHIWQ

SEQ ID NO: 187736 - protein, 185 aa, Triticum aestivum
  unsure (1)..(185): unsure at all Xaa locations
  Clone ID: PAT_TA_82154.pep
QRRLYEQGGLRAEGIFRINPENSQEELVRDRLNSGIVPYGIDVHCLSGLIKAWFRELPSGVLDPIPPEQVMQCQSEEDVLRVAKCLPTKXSGLLDWGRXLMADVLQXEKINKMNAXNIXMVFQPNFTQXGNPLTALMYAXQMMNFLKDANREDLKDREDPIWTSSCPKGPSDETANLACVIHVRR

SEQ ID NO: 187737 - protein, 141 aa, Triticum aestivum
  unsure (1)..(141): unsure at all Xaa locations
  Clone ID: PAT_TA_82155.pep
VTGSVTGLKEGLHGFHVHALGDTTNGCMSTGPHFNPAGHVHGAPEDEIRHAGDLGNVTAGXADGVANINVTDWHIPLTGTNSILASVSSVTLYLWKGMTLQDTGTWSLLLSDRSKVNLLQQLFNFANFFQHMFFTFKCTIP

SEQ ID NO: 187738 - protein, 137 aa, Triticum aestivum
  unsure (1)..(137): unsure at all Xaa locations
  Clone ID: PAT_TA_82156.pep
MGLTFTKLFSRLFAKKEMRILMVGLDAAGKTTILYKLKLGEIVTTIPTIGFNVETVEYKNIKLHCXGDVGGSRTRLRXLWRHYXQNTQGLIFVVDSNDRDRVVEARDELHXMLNEDDYXSVLLVFANKQVFKMHECC

SEQ ID NO: 187739 - protein, 133 aa, Triticum aestivum
  unsure (1)..(133): unsure at all Xaa locations
  Clone ID: PAT_TA_82157.pep
KGRYAQRVGTGAPVYLAAVLEYLAAELLELAGNAAKDNKKSRIIPRHLLLAVRNDEELGKLLAGVTIAHGGVIPKINPVLLPKRTPEKXGKEPKSPXKTTKSPKKTPKLKSMRSILMFFVVRWCSCNGFVSSC

SEQ ID NO: 187740 - protein, 71 aa, Triticum aestivum
  unsure (1)..(71): unsure at all Xaa locations
  Clone ID: PAT_TA_82158.pep
GSRPPHFCKSSGAVSRNILQELQKMGIIDVDPKGGRLITSQGRRDLXDQVAGTVPAESDQVESPPMQPCSG

SEQ ID NO: 187741 - protein, 120 aa, Triticum aestivum
  unsure (1)..(120): unsure at all Xaa locations
  Clone ID: PAT_TA_82159.pep
MSLIAGEEFQHILRVLNTNVDGKQKIMFALTSIKGVGRRFSNIXVCKKADIDMNKRAEXSSGGMDRLMAVXVHNPRHXKVPXXSSNRKKDYKDXXFSNSXSNXLXIXSXKPLKVKXIIAA

SEQ ID NO: 187742 - protein, 104 aa, Triticum aestivum
  unsure (1)..(104): unsure at all Xaa locations
  Clone ID: PAT_TA_82160.pep
MSGRGKGGKGLGKGGAKRHRKVLRDNIQGXITKPAIRRLARRGGVXKRISRLIYEXRPRGVSRFSSENVIPRRRSPYTEHAPPQRPSTAMDVRLRRXXRQGRTS

SEQ ID NO: 187743 - protein, 112 aa, Triticum aestivum
  unsure (1)..(112): unsure at all Xaa locations
  Clone ID: PAT_TA_82161.pep
NSLRXKKNMXGRILVGQPVTRRGLEGFSTHGFGPGSMGAVAGWTGWESALVGLGGGSNEGEGSWLRVWIGEDPKEEVAGTQWLAGRGDRGKLGEGIPMWEVEWRRRRGGWDS

SEQ ID NO: 187744 - protein, 76 aa, Triticum aestivum
  unsure (1)..(76): unsure at all Xaa locations
  Clone ID: PAT_TA_82162.pep
MSCNCGSGCSCGSDCKCGKMYPDLTEQGSAAAQVAAVXSVLGVAPGEQGGAFEVARPGSXRGCSCGDNCXCNPCNC

SEQ ID NO: 187745 - protein, 134 aa, Triticum aestivum
  unsure (1)..(134): unsure at all Xaa locations
  Clone ID: PAT_TA_82163.pep
QRLIFAGKQLEDGRTLADYNIQKESTLHLVLRLRGGMQIFVKTLTGKTITLGGRXSDTIXDNVKAKIQGQGGIPPDQQRLIFAGKHXKDGXLXADYNIQEGXXFNWGSFCVGNPLAWFCSGPKRCPRASQGRPS

SEQ ID NO: 187746 - protein, 145 aa, Triticum aestivum
  unsure (1)..(145): unsure at all Xaa locations
  Clone ID: PAT_TA_82164.pep
TITSNEAAPYRNRKGTLSQNVMVACDFDLNFVYVSAGWEGSASDAGVLKSAIXQGFHVPXGXYYWXDGRYANTPXFLLXYRWXPFTIXKNSRKSGLLPKNPKDXFHPXASRLXGHISVHXVFGKAFXIXKXGITHLHKSLMAEFH

SEQ ID NO: 187747 - protein, 71 aa, Triticum aestivum
  unsure (1)..(71): unsure at all Xaa locations
  Clone ID: PAT_TA_82165.pep
PXPIIXWXVLLRRGNQPTXVLXXKKXFPXPPPSALPRQAAAGLASSPYWRQVAYIDQLWCPHMSLYIVNYS

SEQ ID NO: 187748 - protein, 66 aa, Triticum aestivum
  unsure (1)..(66): unsure at all Xaa locations
  Clone ID: PAT_TA_82166.pep
ERVMCITYHRSVKYSTVLRNKQIFCACILASCFHSLCTSGSMCLFSECLGXSFRNLGGYTVTPXLS

SEQ ID NO: 187749 - protein, 56 aa, Triticum aestivum
  unsure (1)..(56): unsure at all Xaa locations
  Clone ID: PAT_TA_82167.pep
XVHVIRIMITTLNVYTVVAIYYLRHMGIYRIHYLVYPAPFKLFRWYSFVILHLLPC

SEQ ID NO: 187750 - protein, 66 aa, Triticum aestivum
  unsure (1)..(66): unsure at all Xaa locations
  Clone ID: PAT_TA_82168.pep
SSFFFFFXFFFXFFFFFTIPRWDXGXDNXXXATNNNGSEVFXIDIXLLHXKPKGXSXIKLVXLTHT

SEQ ID NO: 187751 - protein, 98 aa, Triticum aestivum
  unsure (1)..(98): unsure at all Xaa locations
  Clone ID: PAT_TA_82169.pep
PLILILRNRLKYALTYREVQSILMQRHIMVDGKVRTDKTYPAXGFMDIISIPKTXENYRFCYDTXGRFRLXSVKDEDANXXSARQAXQFWPKXIQSKL

SEQ ID NO: 187752 - protein, 84 aa, Triticum aestivum
  unsure (1)..(84): unsure at all Xaa locations
  Clone ID: PAT_TA_82170.pep
AGNLGDSVTVTRDKSKVTVTSDGAFSKRYLKYLTKKYLKKHNVRDWLRVIAANKERNVYESGTQHXLENEARRRFRVHVICSAG

SEQ ID NO: 187753 - protein, 108 aa, Triticum aestivum
  unsure (1)..(108): unsure at all Xaa locations
  Clone ID: PAT_TA_82171.pep
EKRVEGLTVELIAAKGSLELAHAAHHDAEERRIGAVLAKEQDCLAWDRELVQAQEEVQQLNNKLLSQNDXEEELGSKLRXCMAQSDLQICGRVYCAKNFKIKDMILKI

SEQ ID NO: 187754 - protein, 112 aa, Triticum aestivum
  unsure (1)..(112): unsure at all Xaa locations
  Clone ID: PAT_TA_82172.pep
NKYSAIYKEQXTNPKKRRRRQXMICIYSLPIPPVGNNWXLIXXXTRRLNFRYGTAPQQLXTVNAPXXLSXTLSPSXGGAASIXMADSLXSVVDGCGHTSDHSRLYAXXDXRX

SEQ ID NO: 187755 - protein, 167 aa, Triticum aestivum
  unsure (1)..(167): unsure at all Xaa locations
  Clone ID: PAT_TA_82173.pep
HFIXKXTGHAGYSVQHXHRGPRDRXGPKDFLXXKXXNWHPTEXNKXGREGXFVXINGTVXGHQGDXGGKIPGLPXESLLXFEGLREXETRRKGIPSXKVASAENGKSLMAPGRAMFPPEXSSAPPLGVHIGPPSPNEQTWAPCRATRACNIFEGRRTPRPHRRHEHP

SEQ ID NO: 187756 - protein, 78 aa, Triticum aestivum
  Clone ID: PAT_TA_82174.pep
ALYILLTPPLKHGDEFTTVSTPPSIPQQQVFFYPFPLPLYRSNKYFFTPFRTRSSRHKAASRRVTNEQRAKTYRKCQK

SEQ ID NO: 187757 - protein, 93 aa, Triticum aestivum
  unsure (1)..(93): unsure at all Xaa locations
  Clone ID: PAT_TA_82175.pep
MTKRTKKAGIVGKYGTRYGASLRKQIKKMEVSQXHSKYFCEFCGKFAVKRKAVGIWGCKDCGKVKAGGAYTMNTASAINVRSTIRRLREQTEA

SEQ ID NO: 187758 - protein, 173 aa, Triticum aestivum
  unsure (1)..(173): unsure at all Xaa locations
  Clone ID: PAT_TA_82176.pep
DYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTINLEVESXDNIDNVKARSRQGGHPPDXQRLIFAXKQLXDGPTXRLSRGSTQSSASGSILDSRIHLR

SEQ ID NO: 187759 - protein, 120 aa, Triticum aestivum
  Clone ID: PAT_TA_82177.pep
FFFFIYSMLILSGSMLYTTQWVKFIYKQYEWVKFRISDISSMRSVKKLVFYFGEDILIGEYYVRTSTQLIFQVYNQAFSEVSISAANSPMAVLGSMTGTATASSPSPSLTATKNVPPRCT

SEQ ID NO: 187760 - protein, 144 aa, Triticum aestivum
  unsure (1)..(144): unsure at all Xaa locations
  Clone ID: PAT_TA_82178.pep
MARTKQTARKSTGGKAPRKQLATKAARKSAPATGGVKKPHRFRPGTVALREIRKYQXKSTELLIRKLPFQRLVREXAQDFKTDLRFKSSAVSALQEAAESXLVGLFEDTTCAXHAKRVTSCQGHQLAADRGKRARRNLNHILVL

SEQ ID NO: 187761 - protein, 148 aa, Triticum aestivum
  unsure (1)..(148): unsure at all Xaa locations
  Clone ID: PAT_TA_82179.pep
RSQLEAAFLKKNLNTVDMVALSGAHTIGKAQCSNFRTRIYGGDTNINTAFATSLKANCPQSGGNTNLANLDTTTPNAFDNAYYTNLLSQKGLLHSDQVLFNNDTNDNTVRNFASXAAAFXNAFTTAXIKMGNIAPLTGPRAXXVNCSR

SEQ ID NO: 187762 - protein, 62 aa, Triticum aestivum
  unsure (1)..(62): unsure at all Xaa locations
  Clone ID: PAT_TA_82180.pep
CKCGKMYPDLTEQGSAAAEVAAVVVLGVAPENKAGXFEVAAGXSGXGCNFGDNCKLQPLATV

SEQ ID NO: 187763 - protein, 102 aa, Triticum aestivum
  Clone ID: PAT_TA_82181.pep
SIQVTHANYYGTNQSYHIRKHRQPSRSQTSVCVAVRRKRRTIDEISNIESSEDQKRASLRRNAGGGREDGAGLHAHAGAAGPGRGGGRRPPPRGYRGWSRRR

SEQ ID NO: 187764 - protein, 102 aa, Triticum aestivum
  unsure (1)..(102): unsure at all Xaa locations
  Clone ID: PAT_TA_82182.pep
GTRDRPYGHCLVAGLAKYPKKVIRKDSAKKTAKKSRVKVFLKLVNFTHLMPTRYTLDVDLKEVAPGXRSLNSXDXKXGAAKAAKGXXQEKFKNXKKLNFVKV

SEQ ID NO: 187765 - protein, 80 aa, Triticum aestivum
  unsure (1)..(80): unsure at all Xaa locations
  Clone ID: PAT_TA_82183.pep
MSCCGGNCGCGTACKCGNGCGGCNMYPEAEGRRRHPPPSPPPPPTRRSSGGMEXAGXENGGCXCTQCKCGXSCGCSCCSC

SEQ ID NO: 187766 - protein, 123 aa, Triticum aestivum
  unsure (1)..(123): unsure at all Xaa locations
  Clone ID: PAT_TA_82184.pep
SYTCRCRVYSCHGSQHHGRQRRRKLQLLGLSPPPLQQXNXGTATPIRFTPDLTGRLLXQXRRAFXHASHPARPXXXTWFPQXVYXPRSRXLAPQXTXQLNKRWVXXRXAIRXAMDIXGNMWGM

SEQ ID NO: 187767 - protein, 94 aa, Triticum aestivum
  Clone ID: PAT_TA_82185.pep
EGDTVHPHLDASTAFHRALTTWASWVDRYIDPRKTQVFFRSSSPSHFSGGEWNSGGHCRESTMPLNDTPCKAGAREKCDLWDKLAKQMKILVTF

SEQ ID NO: 187768 - protein, 90 aa, Triticum aestivum
  unsure (1)..(90): unsure at all Xaa locations
  Clone ID: PAT_TA_82186.pep
YMTDLDKQQIVRVRTLGDYALFIGHNYTCCLSTQDYPGLLRNHVYFTDDDXYWLIDSKDNXRRDVGILDLEDLSATDVVSPQPWLNWAIP

SEQ ID NO: 187769 - protein, 147 aa, Triticum aestivum
  unsure (1)..(147): unsure at all Xaa locations
  Clone ID: PAT_TA_82187.pep
MARTKQTARKSTGGKAPRKQLATKAARKSAPATGGVKKPHRFRPGTVALREIRKYQXKSTELLIRKLPFQRLVREIAQDFKTDLRFQSSAVSALQEAAEAYWLACSRTQLCASSQRVTSCPRTSTCKPPGARLSFNSPPQYGYNSLS

SEQ ID NO: 187770 - protein, 72 aa, Triticum aestivum
  Clone ID: PAT_TA_82188.pep
VACASSVSLLLPLIAGCLRPMTKCCFPPSELLPLCCRPLPLSQLPLLHEAIYCYAAYFSSNFPMETWVLQLL

SEQ ID NO: 187771 - protein, 92 aa, Triticum aestivum
  Clone ID: PAT_TA_82189.pep
LNSYQSPPPPIQLPHVKSPPVSSTSPQPLHHYSSPPPSLPNSYQSPPPPIQLPHVKSPPVSSTPPQPLHHYSSPPPSLLNSYQSPPPPSHLS

SEQ ID NO: 187772 - protein, 51 aa, Triticum aestivum
  unsure (1)..(51): unsure at all Xaa locations
  Clone ID: PAT_TA_82190.pep
MAAAASSSAWKARWLRPEAYPIFAATGVAVGICVMQLVRNITTNPEVRVXK

SEQ ID NO: 187773 - protein, 65 aa, Triticum aestivum
  Clone ID: PAT_TA_82191.pep
AMATLELTVARLLYYFDWSLPNGIRPEELDMDMIVGATARRRNQLHLIAVPYNVPIRSLKPDVCD

SEQ ID NO: 187774 - protein, 57 aa, Triticum aestivum
  Clone ID: PAT_TA_82192.pep
KMYPDLTEQGSAAAQVAAVVVLGVAPENKAGQFEVAAGQSGEGCSCGDNCKCNPCNC

SEQ ID NO: 187775 - protein, 76 aa, Triticum aestivum
  Clone ID: PAT_TA_82193.pep
ALLLELTGELKKEASVQQLITDINELLLDKRLPNRTIFFLLQIYLRSWGQKMSIFRPPRVCSEIWVRCPIAFRAPP

SEQ ID NO: 187776 - protein, 79 aa, Triticum aestivum
  unsure (1)..(79): unsure at all Xaa locations
  Clone ID: PAT_TA_82194.pep
MGHSNVWNSHPKNYGPGSRVCRVCGNSHGLIRKYGLMCCRQCFRSNAKGHWFIKXRLKWNLKGRNFQWGLQFFSNPTGF

SEQ ID NO: 187777 - protein, 131 aa, Triticum aestivum
  unsure (1)..(131): unsure at all Xaa locations
  Clone ID: PAT_TA_82195.pep
ITKQRRSSRGKSGQKRGFSLMPSMRRSPSLLGQQNCPRTHGAGHFVRNAKIVMMIPPVTPPPMKFGXYKELGPILRQXSARRNPSEKXFLLGDYSEKGVVGXTATARHDPXKTLXPXHXFTVVLETALGAL

SEQ ID NO: 187778 - protein, 79 aa, Triticum aestivum
  Clone ID: PAT_TA_82196.pep
ALLDGADERLDGEYDRAEVERVMVAGLWCAHPDPSARPSMRAAMAVLQSKDANQAAGAPRQLCPPTYGPLVAQPAVFVC

SEQ ID NO: 187779 - protein, 142 aa, Triticum aestivum
  unsure (1)..(142): unsure at all Xaa locations
  Clone ID: PAT_TA_82197.pep
MAPKAEKKPAAAEKTPAAEKTTAGKKPKAEKRPPKSKEGGADKKKKKAKKSVETYKIYIFKVLKQVHPDIRISSKXMSIMNPFIXNDIFRESPXRSAQXARLQQEPTXTSREFQTPXRFSFPGEXRQXAFPXXXRLHNLTPP

SEQ ID NO: 187780 - protein, 108 aa, Triticum aestivum
  unsure (1)..(108): unsure at all Xaa locations
  Clone ID: PAT_TA_82198.pep
IDNVKAKIQDKEGIPPDQQRLIFAGKQLEDGRTLADYNIQXKESTLHLXVLXLRGGMQFSVXKTLTGKTITWRSXPPDTIXDNSKARFQDKEXSQPDNNVSTFAWKQL

SEQ ID NO: 187781 - protein, 147 aa, Triticum aestivum
  unsure (1)..(147): unsure at all Xaa locations
  Clone ID: PAT_TA_82199.pep
ERFLLESYIEDNDTVKWCPSTPHCGNAIRVKGDIHCEVECTCGRQFCFNCSSXEAHSPCSCVMWDSGFKKCRDESRDCELVTVNTKPVPSVINPVGEKWWLNLVXXKFGXHIRWXVWXXTXKIXTWAXFTGKIFGXFXXFSQQDTRE

SEQ ID NO: 187782 - protein, 133 aa, Triticum aestivum
  unsure (1)..(133): unsure at all Xaa locations
  Clone ID: PAT_TA_82200.pep
LPSLATTHSQGGCLAAAATAGAAPAASAATAAAGARCSPTWRPPPARPPWSCPPPPTRGAPAGSRWPAGRPAAATAPRASAAPRAAAPAATATEPGAXKPAGKGNTDXEEKQASYHITTPTYNTLTAASLRAR

SEQ ID NO: 187783 - protein, 153 aa, Triticum aestivum
  unsure (1)..(153): unsure at all Xaa locations
  Clone ID: PAT_TA_82201.pep
VFLAAEERGLFLAAVAGVFLATAAATGVFLATAAAGLSLAAVVAARLRGGGEAAAATAAWSKGKGAPKVPPSPTPTSSAXTDAPSSPTRSRSHRQHQEKASTRDDLEEQRKAILPLKTEKRKLVGLKKIQCTNAKCNVWXIWGXLIGXISXXY

SEQ ID NO: 187784 - protein, 170 aa, Triticum aestivum
  unsure (1)..(170): unsure at all Xaa locations
  Clone ID: PAT_TA_82202.pep
GKYTYNGEQYDAIAPPQGAAYDKCREDVTKALKINAPCQAKNCTFNGAWNGGGGPGQADLYVTSSFYYMAADVGLIDSEATSGKTTLRRSKAAAREDFAPMGSMGTKGNLPKGRFRXTXLICMDSFYNXPCPLDGFGLSPTXGIXVAQXXNMGXXNPWPTSRLSTTNNIM

SEQ ID NO: 187785 - protein, 76 aa, Triticum aestivum
  unsure (1)..(76): unsure at all Xaa locations
  Clone ID: PAT_TA_82203.pep
MXDVEYRCFVGGLXWATDXXSLQNAFSXYGDVIXSXIITDREXGRSRXFGFXTFAXXEAXXQAXXVMNXQYXDXAS

SEQ ID NO: 187786 - protein, 135 aa, Triticum aestivum
  unsure (1)..(135): unsure at all Xaa locations
  Clone ID: PAT_TA_82204.pep
MARTKQTARKSTGGKAPRKQLATKAARKSAPATGGVKKPHRFRPGTVALRXDSASTRKSTELAHPQXPXQRSSGKFAKDXXDRLRFXXSXXSACKEAPQGYSXGLFXGXQLXXHSXXTVNIMPKNSIRSLKLRWG

SEQ ID NO: 187787 - protein, 119 aa, Triticum aestivum
  unsure (1)..(119): unsure at all Xaa locations
  Clone ID: PAT_TA_82205.pep
GXXXRSPRXNSXSXXKYIIXXEADRSQSYRGMDGSYXXIXAEPHHTLIRYMSKLSVTXPXCGSIXEEXRXXXDSSXIXKVLASALXPLLELTXAXEHAVXPMLAVIXLTVAVXPXXELA

SEQ ID NO: 187788 - protein, 68 aa, Triticum aestivum
  unsure (1)..(68): unsure at all Xaa locations
  Clone ID: PAT_TA_82206.pep
IXKLPKXXYLGGTILKVLKFKGXYXREKLSYVNFLVEKFVTQHPCFTTGRRLRQPKHLTPASNVTWTW

SEQ ID NO: 187789 - protein, 101 aa, Triticum aestivum
  unsure (1)..(101): unsure at all Xaa locations
  Clone ID: PAT_TA_82207.pep
IGVGERERIRSYFLATRRSLGGEIPASTTMGQKGRRRQNLTRNGVNRKKGPLYQQFAMVIXKNGETLTYSMPYFQKKLACCNXQGAXVFFKGRRFKXXKXK

SEQ ID NO: 187790 - protein, 84 aa, Triticum aestivum
  Clone ID: PAT_TA_82208.pep
GNAAGLAVLFQRLVLRNQELRRFFIFRRMHASLAWYQISQILLGCERASVCSPLDSHHFFSSGQFQIYRALRPVSLANMSSGKD

SEQ ID NO: 187791 - protein, 53 aa, Triticum aestivum
  Clone ID: PAT_TA_82209.pep
GTEGVYGIVSMCILFNFNFEIVYLIRYLAIFYCHNSAIITNIFILYFIIKKKK

SEQ ID NO: 187792 - protein, 117 aa, Triticum aestivum
  unsure (1)..(117): unsure at all Xaa locations
  Clone ID: PAT_TA_82210.pep
MSDTDEHHFESKADSGASKTYPQQAGXIRKGGTHPSSKARPCKVXFEVSTSKTGKHGHAKCHLVAXIDIFNGKEVXDIVPSSXNCDVPXVDRQDYQLIYITDDXMXLLTESXNTXGD

SEQ ID NO: 187793 - protein, 158 aa, Triticum aestivum
  unsure (1)..(158): unsure at all Xaa locations
  Clone ID: PAT_TA_82211.pep
VPGRQAPHMDQEISDERNACFRRFFPHGGPEMNELKQQFANFSLMGXGFNGFDSIEDRSLLRAXKQWWGIHGNSAPALRTIAPKLLGQPTSSSCSERNWSTYGMIHNTLRNKLXPARAEDXXFGHQNLRLIQXNTRYIPGHGDITVLGGLTPATEHTN

SEQ ID NO: 187794 - protein, 91 aa, Triticum aestivum
  unsure (1)..(91): unsure at all Xaa locations
  Clone ID: PAT_TA_82212.pep
NLEMLEELDISNNQIRVLPDSFGMLQHLRVLRAEENPLQVPPREIALKGAQAAVQVHGXNMLPRKLQSHSQRRRKNWAXFCISPKPKQKKA

SEQ ID NO: 187795 - protein, 87 aa, Triticum aestivum
  unsure (1)..(87): unsure at all Xaa locations
  Clone ID: PAT_TA_82213.pep
SEKXFRLXIQNXVQGSFFXGQXXFAGCFSALCNLQFAXLKYXGTYCMXKTRHDLLFSCIIGGFRVLRSSSSYMINHVTYRPREWTLG

SEQ ID NO: 187796 - protein, 101 aa, Triticum aestivum
  unsure (1)..(101): unsure at all Xaa locations
  Clone ID: PAT_TA_82214.pep
MKGTKLAAILILQAVLVMGVLSHVNADFFPKCCNNCRSFSGVDVCDDAHPKCPKGCSACRVVSTSXPEMWRCAXDMKSTVXGPAVDLQERVNPGYIFSPKI

SEQ ID NO: 187797 - protein, 125 aa, Triticum aestivum
  unsure (1)..(125): unsure at all Xaa locations
  Clone ID: PAT_TA_82215.pep
EAPVRQPLFPPFSGHLATPPTPSTSLSNAALXRPPIRLPARPRPIELFLPRFASMWVCIIXATTRXFSTPGGYIQERLPXSRXXSLLKILACXISXEEDTLFMXXSFPFGAMGLXWXXXNLXIQQ

SEQ ID NO: 187798 - protein, 79 aa, Triticum aestivum
  Clone ID: PAT_TA_82216.pep
STELLIRKLPFQRLVREIAQDFKTDLRFQSSAVSALQEAAEAYLVGLFEDTNLCAIHAKRVTIMPKDIQLARRSPGERA

SEQ ID NO: 187799 - protein, 124 aa, Triticum aestivum
  unsure (1)..(124): unsure at all Xaa locations
  Clone ID: PAT_TA_82217.pep
VKTLTGKTITLEVESSDTIDNVKAKIQDKEGIPPDQQRLIFAGKQLEDGRTLADYNIQEGVDLHLVLKFRGXIIXXLAVLAPKXNQEXIXCXXLXXALNPRCXLPXKILAKEQIRPKKILDQHF

SEQ ID NO: 187800 - protein, 72 aa, Triticum aestivum
  Clone ID: PAT_TA_82218.pep
YYAPVEAIELCCLQGEPFGYECAEEMSAEIRMQWKCLIMLPFSCPLTIIEYHMCVGVNATNNLNCQPKYTYQ

SEQ ID NO: 187801 - protein, 113 aa, Triticum aestivum
  unsure (1)..(113): unsure at all Xaa locations
  Clone ID: PAT_TA_82219.pep
NXRTLRAVRSPGKRLXVFAPRRDVGCRMPRRAQRMKARGRQGSDGRCQRRVQGSKVLAQVADATATGAKPALGATQTGEVLAQRRLAGQRCGYRRRRSRSGCRPEVVEGVLAG

SEQ ID NO: 187802 - protein, 104 aa, Triticum aestivum
  unsure (1)..(104): unsure at all Xaa locations
  Clone ID: PAT_TA_82220.pep
XSHXHSNXXXWHGXHTHTXXTDRHNLNSINLNMADXQQNRRDLLXXHVRRAAXHHSDVEQRXRTGGXVSRTQAMDGRXERVTRAGGEXPAXAPPPCRRRRRGRG

SEQ ID NO: 187803 - protein, 140 aa, Triticum aestivum
  unsure (1)..(140): unsure at all Xaa locations
  Clone ID: PAT_TA_82221.pep
MAPKAEKKPAAKKPAEEEPAAEKAEKAPAGKKPKAEKRLPSAGKTSAKDGDKKSKKKSKKSVETYKIYIFKVLKXVHPDIGISSKXMSIMNXFINDIFXEVAGEAAKSALQQEPTXTPASSDSSGSLPGELAKHASKAQG

SEQ ID NO: 187804 - protein, 159 aa, Triticum aestivum
  unsure (1)..(159): unsure at all Xaa locations
  Clone ID: PAT_TA_82222.pep
ATRTQNVLGEKGRRIRELTSVVQKRFNFPENGVELYAEKVVNRGLCAIAQAESLRYKLLGGLAVRRACYGVLRFVMXESGAKGFEXIVNGKSRAQESXSMXFKGRXTYSSGNPFNEYIDAAXALLLXTGXLVQXEIIFXWDPRXLCLHPAADFHTTKER

SEQ ID NO: 187805 - protein, 85 aa, Triticum aestivum
  unsure (1)..(85): unsure at all Xaa locations
  Clone ID: PAT_TA_82223.pep
MSCNCGSGCSCGSDCKCGKXMYPDLTEQGSAAAQVAAVXVSSALAPENKAGHXRLAAGXSGEGCXXRGQLQIQPCNCLSCMHTTV

SEQ ID NO: 187806 - protein, 108 aa, Triticum aestivum
  Clone ID: PAT_TA_82224.pep
PNPQINLKLDPRLKKDEVARNLIVGRGCWFRRRGSVIPICLYLLVTRTGDGVHKGSGPSQLPCLATWTTTASKPNRPPLNPVATACPCQDLALSSALALQPSQHLRAA

SEQ ID NO: 187807 - protein, 89 aa, Triticum aestivum
  unsure (1)..(89): unsure at all Xaa locations
  Clone ID: PAT_TA_82225.pep
PPFIIGVACXCAXYGDAHRXGLAVGAHVVAVVGADADRDSGXLWMERKEMQDYVRYIVSGKTNQCVDRDRITPPLVVSIQCTVPLVLGT

SEQ ID NO: 187808 - protein, 93 aa, Triticum aestivum
  unsure (1)..(93): unsure at all Xaa locations
  Clone ID: PAT_TA_82226.pep
VGQXSKDQALGNACSFSLRVAFGSGTMKILSCLKACCSGLSSAVHWXRDLHWTQGSLAVRASPCVYPNWTSKQVITCAKCIKVKSVHKMGPTW

SEQ ID NO: 187809 - protein, 125 aa, Triticum aestivum
  unsure (1)..(125): unsure at all Xaa locations
  Clone ID: PAT_TA_82227.pep
FSITQXWKXPXFLSXSXPSRXFLVVEKRSXGEGGXVXARAERCRCSATCTXWPSAAPQPATTGLAVCLRPRAVGIGPLPSAYIYAYGCCRHSPVGVDHVSVDVSDRRRSIAVGIGAYADGLGIAV

SEQ ID NO: 187810 - protein, 133 aa, Triticum aestivum
  unsure (1)..(133): unsure at all Xaa locations
  Clone ID: PAT_TA_82228.pep
MSDTDEHHFESKADSGASKTYPQQAGAIRKGGHIVIKARPCKXVEAPPPRLGKHGHAKXLVSIDIFNGKELXDIVPXSHNCDFPNFDRQDYQLIDITDEVFNLLXEIXTLRMTELPTDEFSWQIKTDXLMEGL

SEQ ID NO: 187811 - protein, 57 aa, Triticum aestivum
  unsure (1)..(57): unsure at all Xaa locations
  Clone ID: PAT_TA_82229.pep
KKSSDLGKXHQELKKXYQIWKKXNGIKKXALEFEKNIXFKKXVDWENIEEEEGKINX

SEQ ID NO: 187812 - protein, 59 aa, Triticum aestivum
  Clone ID: PAT_TA_82230.pep
SPESRRRHHPTNLTEVKLLQHEVAMSDRVGNPKFLSLVRCVGDLRHDVLACCTPCHKSR

SEQ ID NO: 187813 - protein, 127 aa, Triticum aestivum
  unsure (1)..(127): unsure at all Xaa locations
  Clone ID: PAT_TA_82231.pep
ICNLRKEPRFVILKLCQKKWACLSFLIRRTLLVLICFVMPGLKLSSKWKKKKSWINPAHSRIPNXLGLGNTLHQDINGSHINNCKKFXAMLENFRXTKLXQFXXIXGQYWXRNACNXGXFVLKXKXR

SEQ ID NO: 187814 - protein, 142 aa, Triticum aestivum
  unsure (1)..(142): unsure at all Xaa locations
  Clone ID: PAT_TA_82232.pep
MAPKADKKPAAESKVEKAAEKTPAGKKPKAEKRVPAGKTAAKEGGEGKTRGRKKGSKAKKSVETYKIYIFKXEQVHPDXGISSKACHHDXFINXSSXTXREXGKLARYNKNHIIPGNXTXRFFFPGXPXKXLQGTRRHNLLS

SEQ ID NO: 187815 - protein, 88 aa, Triticum aestivum
  unsure (1)..(88): unsure at all Xaa locations
  Clone ID: PAT_TA_82233.pep
TTFXDSQGQQNGKKXVVADGATIKMRDHPGRVQRTTPGPRAPKTMPPKKGTTTDRRHRPIQRSGFHPEQEDGRRARYTVSSGGVRVAV

SEQ ID NO: 187816 - protein, 80 aa, Triticum aestivum
  unsure (1)..(80): unsure at all Xaa locations
  Clone ID: PAT_TA_82234.pep
LXXTEQIFXMXIXTXXXCXCANXXXTXXLHXFXTIXSCGLPGICTSIMLQPYTGXHNSLRFCTIATLQHKIGXFHXXVTW

SEQ ID NO: 187817 - protein, 155 aa, Triticum aestivum
  unsure (1)..(155): unsure at all Xaa locations
  Clone ID: PAT_TA_82235.pep
PDQQRLIFAGKQLEDGRTLADYNIQKESTLHLVLRLRGGMQIFVKTLTGKTITLGGLSPQDTIXDNVKAKIQXDKEGSPPDQQRLIXXGKQLQDGRTXADYNIQEGXTLHXXLKSVXGMQIFXETSTGXDINLEVXPLTHXQXEXKFKDKEDPPD

SEQ ID NO: 187818 - protein, 127 aa, Triticum aestivum
  unsure (1)..(127): unsure at all Xaa locations
  Clone ID: PAT_TA_82236.pep
MAPKAEKKPVAEKAEKTTAAKKTKAEKRPPASKEGGXKKGKKNPKKSVGDLQVYIFKXWLKQVHPDIRISSXKGMFIXESFINDIXPELPPAXGNXXSFNKNPQSLQGISNSFRFSSPXGXPQXAFP

SEQ ID NO: 187819 - protein, 61 aa, Triticum aestivum
  unsure (1)..(61): unsure at all Xaa locations
  Clone ID: PAT_TA_82237.pep
HQGNVTQLCKYLLPXISLIRXQVQSPMLFLXMRSYKLQQGSRMFKAMDPKTSWTGSRSRIF

SEQ ID NO: 187820 - protein, 97 aa, Triticum aestivum
  Clone ID: PAT_TA_82238.pep
GVFYLITHAWYLGTMCDASSKFSIAQAFYSRVVKFSSSRVTSSNTSPLHTHQNSSCTRAHTHPPQPSLSPEPLARSPPPPPQGSIGQHPAIYTCSYH

SEQ ID NO: 187821 - protein, 110 aa, Triticum aestivum
  unsure (1)..(110): unsure at all Xaa locations
  Clone ID: PAT_TA_82239.pep
MSRGGSAGGGQSSLGYLFGDGEPAKPAAAPAAKPAPAEKPAPAAADVAKQIQAGHPGXRANNYYRXQXGKNNGNFLTDXXSTKVXXLPCGGXPLGTFFGGMDVKIRLMNN

SEQ ID NO: 187822 - protein, 117 aa, Triticum aestivum
  unsure (1)..(117): unsure at all Xaa locations
  Clone ID: PAT_TA_82240.pep
GGYNPLAKQGQQFYHIRNVYNSHTYKXHGHLESAETCLHACRQTDRDAQPRTQIITLKLVRSEIAMNAMDGLCIDDAERFSVLDDDVVHVDGGEVGEVPGEGDEVEAAALVELQQRR

SEQ ID NO: 187823 - protein, 81 aa, Triticum aestivum
  unsure (1)..(81): unsure at all Xaa locations
  Clone ID: PAT_TA_82241.pep
MSCCGGNCGCGTACKCGNGCGGCNMYPEVEXAAGATLLXVSATATHKASPAGLEMAAXENGGCGCTQXKXRTSCGXPCCNC

SEQ ID NO: 187824 - protein, 58 aa, Triticum aestivum
  Clone ID: PAT_TA_82242.pep
DSIFIDSILLLGELSRIPYIFFLIHHLGKVIFTEVSNSFNSLKFIYLSLSRSNKAKLA

SEQ ID NO: 187825 - protein, 151 aa, Triticum aestivum
  unsure (1)..(151): unsure at all Xaa locations
  Clone ID: PAT_TA_82243.pep
MSTVTSKLKNGSNLGKDGKGFGDVILNPSLQKRVNQLANATANTKLHQAPFRNMLFYGPPGXLGKTMAARELLRXTGLDMHWMTGGXMFAPLXLQAITKVXQXIXWGKEXISYPLNDELTFLLRTGQAYMSELKGPPFRRDIQGCLTTTKA

SEQ ID NO: 187826 - protein, 135 aa, Triticum aestivum
  unsure (1)..(135): unsure at all Xaa locations
  Clone ID: PAT_TA_82244.pep
TGRHLVILHDWKRDKIVFESMDFSRLRSLTVFGRWKPFFISESMMLLRVLDLXEDASGIEYADLGEHIKMVRPLXXLSLQGRHEIXHLPRYMXNLKQLQLLIQGNSVSTCQENHQQELQSYPGTCQLIRTPTTVN

SEQ ID NO: 187827 - protein, 73 aa, Triticum aestivum
  unsure (1)..(73): unsure at all Xaa locations
  Clone ID: PAT_TA_82245.pep
LNFGQYLHXLPRKMNKEKDVKTEGMNNDQXYNXKGHNFRTEHKXPTFXNNLXPQXLDXINKSIFXPTKVHGVX

SEQ ID NO: 187828 - protein, 144 aa, Triticum aestivum
  unsure (1)..(144): unsure at all Xaa locations
  Clone ID: PAT_TA_82246.pep
QSPSKSYTHQPFLALTYTVNDRYGHGYVEKEGDGRSQRRRPGMRCSLRRRGRREDPEGLRPDGARRRRXEKREERVLVHVGMLTEPRVLALLEMSAQRFGYGNRASEDSXRRXTGXXXRPVANGGRXKILLRXXTIGXSRPHNF

SEQ ID NO: 187829 - protein, 109 aa, Triticum aestivum
  unsure (1)..(109): unsure at all Xaa locations
  Clone ID: PAT_TA_82247.pep
XTGRDFXGFKVXHLGXRKEAPEGGLFGDFXKPXAGCPXIAPCXYKFIXXGXHGLXACHLITSFPCLVSGTKQVGASEFLTKQGLRLTTAKELHGTVDAPAPCASTDVLG

SEQ ID NO: 187830 - protein, 75 aa, Triticum aestivum; identical to SEQ ID NO: 106874
  Clone ID: PAT_TA_82248.pep

SEQ ID NO: 187831 - protein, 77 aa, Triticum aestivum
  Clone ID: PAT_TA_82249.pep
LASPSATRPRHFTQLHPRPVVPPTARCCPYHHRHTRGKLMLEGEGTTRKFGTGGEDTDVVKVSSPDTLHVLQDAHCF

SEQ ID NO: 187832 - protein, 84 aa, Triticum aestivum
  Clone ID: PAT_TA_82250.pep
EKFADEKFVHKHTKPGILSMANAGPNTNGSQFFICTVPCNWLDGKHVVFGEVVEGMDVVKNIEKVGSRSGTCSKQVVIADCGQL

SEQ ID NO: 187833 - protein, 68 aa, Triticum aestivum
  unsure (1)..(68): unsure at all Xaa locations
  Clone ID: PAT_TA_82251.pep
CQVCERIAREISAQVAAKQQALPPSKKVPEIEIIDIAENVCNLKKQEADWXLRIDIVEKGDRLIFWPF

SEQ ID NO: 187834 - protein, 134 aa, Triticum aestivum
  unsure (1)..(134): unsure at all Xaa locations
  Clone ID: PAT_TA_82252.pep
KVEKAAEKAPAGKKPKAEKRLPASKEAAGGEGKTRGRKKGSKAKKGVETYKIYIFKVLKQVHPDIGISSKGHVHHESFINDIFREVPXESXQLPRYNKKPPSLQEISNSVRSLPPGVPXXAFPXGTRRHLLLID

SEQ ID NO: 187835 - protein, 124 aa, Triticum aestivum
  unsure (1)..(124): unsure at all Xaa locations
  Clone ID: PAT_TA_82253.pep
LTSIHRKHVLITKFVKILIFEIAEFPRTGHSTSHRTQLLPLSSTSMLTSLRRNHILDHKVVKTWIFRXRQIPRMVFPPSATPNPDLSSTSSFTISTKHIKITKLRNLLSEXSYRPRRTNPDLID

SEQ ID NO: 187836 - protein, 120 aa, Triticum aestivum
  unsure (1)..(120): unsure at all Xaa locations
  Clone ID: PAT_TA_82254.pep
ADGATAAIVVINPNNPCGVVYSTQHLLQIAETAKELGIXVIADEVYAHMVFGASXFVPMASYAHIAPVITIGSISKRFMLPRWVSVGLDPVNGTSSITATENATERRTPLFQFPNSFWLT

SEQ ID NO: 187837 - protein, 92 aa, Triticum aestivum
  unsure (1)..(92): unsure at all Xaa locations
  Clone ID: PAT_TA_82255.pep
NFFVVGQGFGNYDPVNDPTRFNLVDPVERNTVGVPAGGWVAIRFLADNPXVWFMHCHLEVHTTWGLRMAWLVQDGSLPNQKLLPPPSDLPKC

SEQ ID NO: 187838 - protein, 128 aa, Triticum aestivum
  Clone ID: PAT_TA_82256.pep
LVPNSARARPDLVLSSGVCQPAPLQVGRGDAAGPEPNGYAGRAGASRCRWDAHAVFDVPNSSSLSPGRRMATTGSDPRWEPQDRTMPATMPQGAPCFASSPSIEDGPNASRTISFIKDMYKEALDVCE

SEQ ID NO: 187839 - protein, 136 aa, Triticum aestivum
  unsure (1)..(136): unsure at all Xaa locations
  Clone ID: PAT_TA_82257.pep
RRHPDVDRRDRRRARGHGGPDVQLLHGGAVRAADAHLRAAAGDDKGHHPRAQRRRADQLQAPRARLLARPQGGQLQRRARAAADFVGQVRHQPDAVSAMIETSTTSTTLCLCTSIITXNFPTCSSKLDKSXRIVLD

SEQ ID NO: 187840 - protein, 101 aa, Triticum aestivum
  unsure (1)..(101): unsure at all Xaa locations
  Clone ID: PAT_TA_82258.pep
ENKVSFKDTHAQITSTKLNDHARYIAQTVHKQKXKLHRLAVXHXRADXXHXGGXXIPNXWTRETAKGFNAASNRSAPGSSCPGPELHGRSKRTAASQLHYC

SEQ ID NO: 187841 - protein, 89 aa, Triticum aestivum; identical to SEQ ID NO: 130083
  Clone ID: PAT_TA_82259.pep

SEQ ID NO: 187842 - protein, 93 aa, Triticum aestivum
  Clone ID: PAT_TA_82260.pep
QHTYKAKNRHLHNPKPRYNADDPKKGQSNLSLFKGNLAPSSAWKPVSLDVEEWRTISLYLFNNLIEVRPTSSKISVHCFTTSNFFELLLFLDI

SEQ ID NO: 187843 - protein, 138 aa, Triticum aestivum
  unsure (1)..(138): unsure at all Xaa locations
  Clone ID: PAT_TA_82261.pep
LLPIDPAVFQLSPMGGGGFIIDSGTTFTALEECAFVVLVRAVAARVGLPLASGAHLGLSLCFAAPEGKTEAVDVPRLVFHFDSADMALPRESYVVEDRNAGVACLGMVNMRGMSVLRNLQQQSMHFLYXLEGGVLXFN

SEQ ID NO: 187844 - protein, 40 aa, Triticum aestivum
  unsure (1)..(40): unsure at all Xaa locations
  Clone ID: PAT_TA_82262.pep
RETSLEFFFFFFFFFFFFFFFFFLFFFFFFLFLPLXFLPS

SEQ ID NO: 187845 - protein, 151 aa, Triticum aestivum
  unsure (1)..(151): unsure at all Xaa locations
  Clone ID: PAT_TA_82263.pep
AKIQDKEGIPPDQQRLIFAGKQLEDGRTLADYNIQKESTLHLVLRLRGGMQIFVKTLTGKTITLEVESSDTIXNVKAKIQDKEGIPPDQQRLIFAGKQLEDGRTLADYNIQKESTXHLVLRLRCGNKCLAMELLMSLGSSVVFCVPVLIVS

SEQ ID NO: 187846 - protein, 48 aa, Triticum aestivum
  unsure (1)..(48): unsure at all Xaa locations
  Clone ID: PAT_TA_82264.pep
GVLRINNFGITHDRKXLDPGVTGLKFHAFTLLRGVLRRQQSQLEPHSL

SEQ ID NO: 187847 - protein, 125 aa, Triticum aestivum
  Clone ID: PAT_TA_82265.pep
FSSPAVRIFSAENVRQQLQESMRDYIRASVGINDKGKLTVPALLQSYGKGTVEDSLLADWICRQLTPAQVAAVQDTTSSRKQRLLGFRSFTVVPFDSTFRYLFLPDDQRADADRSPQWRETRVTF

SEQ ID NO: 187848 - protein, 43 aa, Triticum aestivum
  Clone ID: PAT_TA_82266.pep
THKAGTPHVRAICPTIIPLHHPKFTGRVHCYYAKAGGHTLFRK

SEQ ID NO: 187849 - protein, 94 aa, Triticum aestivum
  unsure (1)..(94): unsure at all Xaa locations
  Clone ID: PAT_TA_82267.pep
RRAAATQPLAINTAAGEAIKQSPSMXXTPTTPVTPSSSNAXRGGSVWRXAFSTPGSNLATKSLGANLFDRPQPNXPTVYDWFTANXTKTKSNHR

SEQ ID NO: 187850 - protein, 61 aa, Triticum aestivum
  Clone ID: PAT_TA_82268.pep
KRRGIINFGLVHTQVGWVILSPNQQYLLHTQHMLHALLTHRLRSRPSIAPIGRTQNAQIRH

SEQ ID NO: 187851 - protein, 125 aa, Triticum aestivum
  unsure (1)..(125): unsure at all Xaa locations
  Clone ID: PAT_TA_82269.pep
SHPLFQALLEEAEEAFGYADAGPLELPCNTEAFAKVLEIXKEGEAMWPXXGGTTFLKGKLLSGHFXTSWAIFSSRSXXMSFGFGLSXFITFNFXFSPIPQITSSKFLNNXNSPXXXNKFSNXPEF

SEQ ID NO: 187852 - protein, 81 aa, Triticum aestivum
  unsure (1)..(81): unsure at all Xaa locations
  Clone ID: PAT_TA_82270.pep
GTAFGERPPAQQERIPEFRLXPIXPGLCAKXLGTEYLXGEKTRLLGEEXDKVFVAMXQGKQHRMAARSASKEWNGEPLPIC

SEQ ID NO: 187853 - protein, 102 aa, Triticum aestivum
  unsure (1)..(102): unsure at all Xaa locations
  Clone ID: PAT_TA_82271.pep
QRTVPAAVPAIVFLSGGQSEEEATLNLNAMNKLQTKKPWNLSFSFXGRALQQXSTLKGLAGKTETRXKARRVLGEVKGNSEATFGTXKGEPTLWEXAPEPPN

SEQ ID NO: 187854 - protein, 100 aa, Triticum aestivum
  unsure (1)..(100): unsure at all Xaa locations
  Clone ID: PAT_TA_82272.pep
NTDLTVTRLSAAAATNNASAGSPSHSSSSSASSSPSSVYVLXASPPPGAHAQSWPSACWQSPPQATARASRXXGLRPRHLNNXKSLRMSNXXXKDCFXXL

SEQ ID NO: 187855 - protein, 108 aa, Triticum aestivum
  unsure (1)..(108): unsure at all Xaa locations
  Clone ID: PAT_TA_82273.pep
TKAVYRHFQFTALVLPTVQFHYTINPPQPTKXVSALNWXNXSXPSKLSSSSXHXHHHPHSXXFNKXXEQFRLVSPLXPFRGGKXNPSKFPXXTLPLNLXVQFXTYFKX

SEQ ID NO: 187856 - protein, 108 aa, Triticum aestivum
  unsure (1)..(108): unsure at all Xaa locations
  Clone ID: PAT_TA_82274.pep
RXLCRRXYGXGIGGHPAQPRNXRFVIAKTWLXXKLXFLXDSFLRPWGLGVSPGIDFVNCSFRIVILLRGITVKFPVRSFLVLLPGIIWSNSPGICPSYKLGNTSYSWK

SEQ ID NO: 187857 - protein, 46 aa, Triticum aestivum
  unsure (1)..(46): unsure at all Xaa locations
  Clone ID: PAT_TA_82275.pep
NCGKLTICLWTELNHRMXAREXFNALTFLCDARHEGATLHCATPHR

SEQ ID NO: 187858 - protein, 54 aa, Triticum aestivum
  unsure (1)..(54): unsure at all Xaa locations
  Clone ID: PAT_TA_82276.pep
XSSPGXXSRHXVXCGALGXSSLXXQMXDTXTCIHPXXTLPFTXRXGGXPHGXLC

SEQ ID NO: 187859 - protein, 88 aa, Triticum aestivum
  unsure (1)..(88): unsure at all Xaa locations
  Clone ID: PAT_TA_82277.pep
HACSSSIKDRFLLLIHLFKYLFFLICNSSYLFLAEVQWLLTCIIYFLTQTNLICQGNNKIRMDQXPKHMLHGFQGXMYTSRNPIFTXX

SEQ ID NO: 187860 - protein, 89 aa, Triticum aestivum
  unsure (1)..(89): unsure at all Xaa locations
  Clone ID: PAT_TA_82278.pep
GAKRHRKVLRDNIQGITKPAIRRLARRGGVKRISGLIYXETRGVLKIFLENVIRDAVTYTEHARRKTVTAMDVVYALKRXGRTLYGFXG

SEQ ID NO: 187861 - protein, 102 aa, Triticum aestivum
  unsure (1)..(102): unsure at all Xaa locations
  Clone ID: PAT_TA_82279.pep
QTKSTSGEEEIRMRLSFPLVAGAVVAGVISGNVIFGQPLKKYWARXTSKQRTRAAKKKGQKWVRLNGRYPSMFPPESMSPYLSPQDKTSQNKTNTVMLKCLG

SEQ ID NO: 187862 - protein, 160 aa, Triticum aestivum
  unsure (1)..(160): unsure at all Xaa locations
  Clone ID: PAT_TA_82280.pep
ATPASRPLSPPHASLPLPSSAAAAAATMGRGKFKGKPTGRRNFSTPEEIASGNSGRPRSFKKNVAEAXRRKKEEVRKNLREERIPKDDGEXRKKHKGTEXVIQIXNPKLGEKQKNIKAXKEADLGKTXELXRRXKKGDXKQKSHERYMNLKEQXKTEQXK

SEQ ID NO: 187863 - protein, 47 aa, Triticum aestivum
  unsure (1)..(47): unsure at all Xaa locations
  Clone ID: PAT_TA_82281.pep
GRPXVKVPXVVVVXSMMKDIPCXPGAXLRRXXARCXVEVSASTXVXC

SEQ ID NO: 187864 - protein, 148 aa, Triticum aestivum
  unsure (1)..(148): unsure at all Xaa locations
  Clone ID: PAT_TA_82282.pep
LSGDELLSDSFPYRELENGVLWEVDGHWVVQGAVDVDIGANPSAEGGGDDEGVDDQAVKVVDIVDTFRLQEQPAFDKKQFISHMKRYIKNLTAKLEGDDLDVFKKNVESATNIFLTKLKGPQXLVGENNHDXALXFPXXKEELSTSTF

SEQ ID NO: 187865 - protein, 45 aa, Triticum aestivum
  Clone ID: PAT_TA_82283.pep
FLSDCEIEMLPAFFPSLILLHLFLNQLSMVSVCLRVMRRSLIKKK

SEQ ID NO: 187866 - protein, 143 aa, Triticum aestivum
  unsure (1)..(143): unsure at all Xaa locations
  Clone ID: PAT_TA_82284.pep
EEFKQKNPKNKSVAAVGKAAGERWKSLSESEKAPYVAKANKLKGEYNKAIAAYNKGESAAAAAPKKAAAKEVEEEDEXESDKSKSEINDDDDDXGSDEDXDDDNEEDHLSKLLPADKSGAAKRDCRGVISYPSPLEFPSSLTS

SEQ ID NO: 187867 - protein, 55 aa, Triticum aestivum
  Clone ID: PAT_TA_82285.pep
VFFFFFFFFFFGQARIHIFVLLLNEDFICCLISYHKGMIGRYTQYNPPHRKLWHT

SEQ ID NO: 187868 - protein, 68 aa, Triticum aestivum
  Clone ID: PAT_TA_82286.pep
RWYPMITKSLRKETTFVPRERAPSKTTHPLALTSKVNKDTYIISTRPLKYTRLHCQHRTASGPAKSPE

SEQ ID NO: 187869 - protein, 59 aa, Triticum aestivum
  unsure (1)..(59): unsure at all Xaa locations
  Clone ID: PAT_TA_82287.pep
PXSTPKQTLQHWGKYSLLASQNWIIPRSIHTPNQGYMLLNVADFNCPKTILIHSGQRHG

SEQ ID NO: 187870 - protein, 121 aa, Triticum aestivum
  unsure (1)..(121): unsure at all Xaa locations
  Clone ID: PAT_TA_82288.pep
VHCVESGKDAISLLQPPHCFHACFMDVQMPEMDGFEATRQIREMEKKANEEKREQSSSGEGSTFVEWHLPVLAMTADVIQATYEECMKSGMDGYVSKPFDEQQXLYQAVSRLVVGTTDSGS

SEQ ID NO: 187871 - protein, 78 aa, Triticum aestivum
  unsure (1)..(78): unsure at all Xaa locations
  Clone ID: PAT_TA_82289.pep
PXRTPALMLCLAVLREEGLTXEAQESFQDRRVQSTHLWLLRTTASVGQAQAAKSTRVTDDSFLYCYIFGGGTNDPLQD

SEQ ID NO: 187872 - protein, 60 aa, Triticum aestivum
  unsure (1)..(60): unsure at all Xaa locations
  Clone ID: PAT_TA_82290.pep
HIPCYSAVVDCSINTLIKVPKKIKREFTVIVMNPANSSTMKSIFINIIMLSHTHMRXXXA

SEQ ID NO: 187873 - protein, 100 aa, Triticum aestivum
  unsure (1)..(100): unsure at all Xaa locations
  Clone ID: PAT_TA_82291.pep
QXYQSINQAVNPXTGRVWWMVHAVQEKADTHLFFLLXYLFLFCSSMESPKKKKERNPNRITYLTETQTIHRSLARLITAMQIPNQIKSCSGDRLTDLPID

SEQ ID NO: 187874 - protein, 157 aa, Triticum aestivum
  unsure (1)..(157): unsure at all Xaa locations
  Clone ID: PAT_TA_82292.pep
TLGPAVREGEHVFGVAHIFASFNDTFIHVTDLSGRETLVRITGGMKVKADRDESSPYAAMLASQDVAVRCKELXGITALHIKLRATGGNKTKXPGPGAQAALKSLARSGXMKLGPXKNLPPXPNDTTRRKXXXKGXRLYSKARSKDGQFKPSNPIFR

SEQ ID NO: 187875 - protein, 63 aa, Triticum aestivum
  Clone ID: PAT_TA_82293.pep
TPPPNATAHLQRPLQSCRPLAVPEPRLPRRSRVPPPCPDSPRLAIATRSPRAAATPPRPPCPP

SEQ ID NO: 187876 - protein, 141 aa, Triticum aestivum
  unsure (1)..(141): unsure at all Xaa locations
  Clone ID: PAT_TA_82294.pep
GKAKKKAKKSVETYKIYIFKVLKQVHPDIGISSKAMSIMNSFINDIFEKLAGEAAKLARYNKKPTITSREIQTSVRLXVSPASSAKHAVSEGTKLSPHSSWISVSYCLVCLPCYPVKIPLPFKNAWPQQKKPGGGPVIPIV

SEQ ID NO: 187877 - protein, 55 aa, Triticum aestivum
  Clone ID: PAT_TA_82295.pep
RGTSPADGPSSPASLPFIAHSWVAELKTNGMLSSINQSTIPSSSRKQEMYYERSS

SEQ ID NO: 187878 - protein, 129 aa, Triticum aestivum
  unsure (1)..(129): unsure at all Xaa locations
  Clone ID: PAT_TA_82296.pep
LARDAHVRRRLWVGRAAVRGAGADVRQRHGVRDAARRRQGRRHRRVVRAGARVPAVLPGRLLRGVTGNFLPPLCVFVNVCSDLDLVECMCTLYVPMCHMSGFQLLLXKINHKMVVYKPIFFCVDKKKGG

SEQ ID NO: 187879 - protein, 96 aa, Triticum aestivum
  unsure (1)..(96): unsure at all Xaa locations
  Clone ID: PAT_TA_82297.pep
SNICIPRXXXCVVIXILQAKFYRSINQSPTQDEGXKETRENVREKQFTSQNLTKHFLVARSIINSAYTLQSGSLHVVAAAAADCWPPAFGVGLSVG

SEQ ID NO: 187880 - protein, 52 aa, Triticum aestivum
  Clone ID: PAT_TA_82298.pep
LTHTVYPEFLKDTREREGERMKLNWLTDDDTTTYTCWNFLNRFQSLMAVMDG

SEQ ID NO: 187881 - protein, 123 aa, Triticum aestivum
  Clone ID: PAT_TA_82299.pep
ADPTMDANRQPDPPAGVEPPSTAIGGDWHQPEARSRIVNKITEALKKRLPVSAPEELNQLREIAVRYENRIYTQETNQPDYFRKISLKILFMEMKTQQAARYAEVIPERNNSSKEKTGVQQAG

SEQ ID NO: 187882 - protein, 80 aa, Triticum aestivum
  unsure (1)..(80): unsure at all Xaa locations
  Clone ID: PAT_TA_82300.pep
LFMCFSHSFYIDVMISLCRNVTYVIWIWTCRSVTSISGWLVATLIRIIXGNVVAMQYLCVGYRMEFNSCGQKPDVWRCHV

SEQ ID NO: 187883 - protein, 145 aa, Triticum aestivum
  unsure (1)..(145): unsure at all Xaa locations
  Clone ID: PAT_TA_82301.pep
MQIFVKTLTGKTITLEVESSDTIDNVKAKIQDKEGIPPDQQRLIFAGKQXEDGRTLADYNIQKXSTLHLVLRLRGGAKEAQEERPYTKAKXKXKHKHKKVNSAVLQFYKXNXSTXKVTSQGRMPNTADMTFAFGLTLKSKGGPLS

SEQ ID NO: 187884 - protein, 143 aa, Triticum aestivum
  unsure (1)..(143): unsure at all Xaa locations
  Clone ID: PAT_TA_82302.pep
EEHQPEVPPLPKVELPPFPEVHLPPKPELPKVELPPVPEVHLPPKPKLPKVELPPVPEVHMPPKPELPKVELPSVPEVHLPPKPELPKXELPTFPEVHMPPSREMPKVELPPKPKCHCSRVPFPESGAKLELLTILLVILLCL

SEQ ID NO: 187885 - protein, 81 aa, Triticum aestivum
  unsure (1)..(81): unsure at all Xaa locations
  Clone ID: PAT_TA_82303.pep
MSCCGGSCGCGSACKCGNGCGGCNMYPEVEXAAGATLLVAATATHKASSGGMEXMAAEDGGCGCTQCNXGTXSCGCSCCXC

SEQ ID NO: 187886 - protein, 75 aa, Triticum aestivum; identical to SEQ ID NO: 106874
  Clone ID: PAT_TA_82304.pep

SEQ ID NO: 187887 - protein, 83 aa, Triticum aestivum
  Clone ID: PAT_TA_82305.pep
NNKKEASSLLPWCASCNLHPNKTFWQLKFKLPRNLALHLGTEVVVSRIKVPLFPECPKQLMQRGSKSGDIQSDVLLRPEVALC

SEQ ID NO: 187888 - protein, 65 aa, Triticum aestivum
  Clone ID: PAT_TA_82306.pep
FPCMCASYLAYAQLYRTPTYIQQYTHTCATSDHHLLLVVKARTCLSKHFCHLLAFLEHRIYLTVD

SEQ ID NO: 187889 - protein, 146 aa, Triticum aestivum
  unsure (1)..(146): unsure at all Xaa locations
  Clone ID: PAT_TA_82307.pep
VPXXLLAAXQYPRIXLXXXGVISWIXRRFGSXFXRXXXDXFXGXRLDTSCGLCCXXXSLTRCRFFLHFGLXXNXQAIXNRRQIXNGDFPLKSRCSLGTETGSTRCKPRRGFNRPPVERELAPESRTISGLPLASAAIVYVETRRRR

SEQ ID NO: 187890 - protein, 113 aa, Triticum aestivum
  unsure (1)..(113): unsure at all Xaa locations
  Clone ID: PAT_TA_82308.pep
NHPGQIGNGYAPVLDCHTSHIAVKFAELVTKIDRRSGKELEALPKFLKNGDAGIVKMIPTKPMVVETFATYXPLGRXAVRDMRQTVLLGXIKGVXEXXAQPVXKVTKVPSXXK

SEQ ID NO: 187891 - protein, 177 aa, Triticum aestivum
  unsure (1)..(177): unsure at all Xaa locations
  Clone ID: PAT_TA_82309.pep
MAPKAAEKKPVEKTPAGKKPKAEKKVPASKEGGGDKKGKKKAKKSVETYKIYIFKVLKQVHPDIGISSKAMSIMNSFINDIFEKLAGESAKLARYNKXPTITSREXQTXVRLVLPGESPSTLSEGTRRHKLTPPDPVLSCVCLWWMDDVPCPARTCLLYCAGVSCVDLRLIYLLVCM

SEQ ID NO: 187892 - protein, 74 aa, Triticum aestivum
  unsure (1)..(74): unsure at all Xaa locations
  Clone ID: PAT_TA_82310.pep
FFFFXVGNLYAQRCKFRATVCRLPLSIEEAARKRCQSLFLETFRVMEVYKVSYTSSRLNVHAELTSSSQRKWCS

SEQ ID NO: 187893 - protein, 140 aa, Triticum aestivum
  unsure (1)..(140): unsure at all Xaa locations
  Clone ID: PAT_TA_82311.pep
QRLAHCGCAPARPHFTGAPAWXEIGLQGGIIPVMYQRSHGEEGGXRFKIEATDYFNXVTVMNVAAAGSIKSMDVKSSXSNDWMSMSRNWGAXNWHSLANLTGKMLSFRLTDTDGQTVEFNNIVPGGWKFGQTFASKQQFK

SEQ ID NO: 187894 - protein, 54 aa, Triticum aestivum
  Clone ID: PAT_TA_82312.pep
GNPEVRVNKMGRAAGVLENHEEGRRYAEHGLRAYVQDKTPEIMPGINKFFTSPK

SEQ ID NO: 187895 - protein, 103 aa, Triticum aestivum
  Clone ID: PAT_TA_82313.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRNLYGFGG

SEQ ID NO: 187896 - protein, 62 aa, Triticum aestivum
  Clone ID: PAT_TA_82314.pep
DQGKSGRSERDDARGGGFGRAGGAEPPKLCHGGRFNRRMKFAGIHHQICPNRLSGCMLEWIS

SEQ ID NO: 187897 - protein, 60 aa, Triticum aestivum
  Clone ID: PAT_TA_82315.pep
SLMWQTFLVRRTADERILLVVFFLYIKKYATWCPLSQQTTVPTLTVELTFNVCHVSLVSS

SEQ ID NO: 187898 - protein, 172 aa, Triticum aestivum
  unsure (1)..(172): unsure at all Xaa locations
  Clone ID: PAT_TA_82316.pep
MARTKQTARKSTGGKAPRKQLATKAARKSAPATGGVKKPHRFRPGTVALREIRKYQXKSTELLIRKLPFQXRLVREIAQDFKXTDLRFQSSAVSALQEGRRXYSXGLXRTQLCAIHAKRVTLSXDINRPPIGNLSSGPGNTGNTVSVFGCVPFCCVASSQIGTEFVDFFKKK

SEQ ID NO: 187899 - protein, 99 aa, Triticum aestivum
  unsure (1)..(99): unsure at all Xaa locations
  Clone ID: PAT_TA_82317.pep
STELEITRAGXANSQFYRSXLTGXXVPXRXSSTLLXLHARTXHKXXRLXADRXXQGWMDSFXANXDDSWRWQXXPXXESYXLXTRXDXKVPSNWVLRIG

SEQ ID NO: 187900 - protein, 100 aa, Triticum aestivum
  unsure (1)..(100): unsure at all Xaa locations
  Clone ID: PAT_TA_82318.pep
ILQCPYTPFPQSTSTPYHRTVSSISYSTPTSPSIIISHPTTSTIFPFLVQSRIHGERERXRERERERXRERERERERERERERERERERERERERERERE

SEQ ID NO: 187901 - protein, 163 aa, Triticum aestivum
  unsure (1)..(163): unsure at all Xaa locations
  Clone ID: PAT_TA_82319.pep
VGYNPDKVPFVPISGFEGDNMIERSTNLDWYKGPTLLEALDQINEPKRPSDKPLRLPLQDVYKIGGIGTVPVGRVETGVIKPGYGCYLWVPLGLTTEVIRLRSQDLXWXPSGDNLAQLKTCCEDVFVQKDTGKEQLTQVYMNNWQPAANSKCVISTCDKLKHL

SEQ ID NO: 187902 - protein, 64 aa, Triticum aestivum
  Clone ID: PAT_TA_82320.pep
FFFLYIFSLKFKSYFISILPPFEMAICRNWQQLLQACQATQLDATILTNLSANQNPVLCFPLQV

SEQ ID NO: 187903 - protein, 71 aa, Triticum aestivum
  unsure (1)..(71): unsure at all Xaa locations
  Clone ID: PAT_TA_82321.pep
IVGANILAGGAFDXASMNPAVSFGPAVVSXVWENHWVYWLGPFAGAAIAALVYDICFIGQRPHXQLPXADY

SEQ ID NO: 187904 - protein, 135 aa, Triticum aestivum
  unsure (1)..(135): unsure at all Xaa locations
  Clone ID: PAT_TA_82322.pep
MAPKAAEKKPVATAEKTTAGKKPKAEKRAPATKEAGGEGKTRGRKKGSKAKKGVETYKIYIFKVLKQVHPDIGISSKAMSINESFIXNDIFENSPGDSXAKLGRYNKEXTSLGQDSSGSSPRDSPNTPLQTRHPI

SEQ ID NO: 187905 - protein, 64 aa, Triticum aestivum
  unsure (1)..(64): unsure at all Xaa locations
  Clone ID: PAT_TA_82323.pep
WNCCHRKLGISTQHTHTXQSLDXLXNKSEYVXSXSLXXVLFRXVNPYEXSXKGVESYEXGVXSL

SEQ ID NO: 187906 - protein, 85 aa, Triticum aestivum
  unsure (1)..(85): unsure at all Xaa locations
  Clone ID: PAT_TA_82324.pep
GGXXGGSXXRXXXEXARFFFIXNDCTGDLGPGXLGMXXNLMSXFXXFCIXXPXDSXXTNLPXXSPYALKLLSLSXVIIDLGILFP

SEQ ID NO: 187907 - protein, 169 aa, Triticum aestivum
  unsure (1)..(169): unsure at all Xaa locations
  Clone ID: PAT_TA_82325.pep
KKPRIMLIDRGKTRRFINAPYIVQGLEWFGFEVVKVDPKMDSSLDEFARLVDSCDAIMGAHGAGLTNMVFLRSGGVVVHIVPYGIEFMADGFYGKPEXDMGLSHVRYSISPEESTFWRNMVDHTVIKDPKPLGWMDKVGRLHVKQLPYIQGWPVCKDFTSGLVYYQRVG

SEQ ID NO: 187908 - protein, 105 aa, Triticum aestivum
  unsure (1)..(105): unsure at all Xaa locations
  Clone ID: PAT_TA_82326.pep
FEIVMTFGLVYTVYATAVDPKRGDLGVIAPIAIGFIVGANILAGGAFDGASMNPAVSFGPAVVKXVWENHWVYWLGPFAGAAIAALVYDICFIGSXHXQLPTADY

SEQ ID NO: 187909 - protein, 113 aa, Triticum aestivum
  unsure (1)..(113): unsure at all Xaa locations
  Clone ID: PAT_TA_82327.pep
MASKWVRPEVYPLFAATGVAIGICAFSLLRNITGNPEVRVNKMGRAAGVLENHEEGRRYAEHGXRAYVQDKXPEIMPXINXSSPEMKHLACQWSLLVTVVASANYSINNVVAS

SEQ ID NO: 187910 - protein, 66 aa, Triticum aestivum
  Clone ID: PAT_TA_82328.pep
SCGSDCKCGKMYPDLTEQGSAAAQVAAVVVLGVAPENKAGQFEVAAGQSGEGCSCGDNCKCNPCNC

SEQ ID NO: 187911 - protein, 123 aa, Triticum aestivum
  unsure (1)..(123): unsure at all Xaa locations
  Clone ID: PAT_TA_82329.pep
LXAXYLLAYLGGNSSPSAADVKNILDSXGAEADEXKLEFLLAELKGKDITEVIASGREKFAAVPSGGGAIAVGAPAAASGXGAAAPAADXXKEEKVXEKEESDETWFQSVTNIPPPEPVYPKR

SEQ ID NO: 187912 - protein, 57 aa, Triticum aestivum
  Clone ID: PAT_TA_82330.pep
AAWVVALTAFVLVFLPETKGVPLESMGSVWERHWYWKRFVGDGRGRGKPASSPSAST

SEQ ID NO: 187913 - protein, 66 aa, Triticum aestivum
  unsure (1)..(66): unsure at all Xaa locations
  Clone ID: PAT_TA_82331.pep
XKKGXXIXLXPXRYAXGXSLVEFGGTXXLYXSGRXFSXVSGTQVSSQTXTTXWRGIDXIXDWYRPP

SEQ ID NO: 187914 - protein, 78 aa, Triticum aestivum
  Clone ID: PAT_TA_82332.pep
CAPDIIPILMFIAHLTHLYRSLAVVPCNCAYHVVRVDSHANKFVSPAILVTQFHYHLDKLLILKEQYAAFKYMSDGKL

SEQ ID NO: 187915 - protein, 128 aa, Triticum aestivum
  unsure (1)..(128): unsure at all Xaa locations
  Clone ID: PAT_TA_82333.pep
CKVVEVSTSKTGKHGHAKCHFVAIDIFNGKKLEDIVPSSHNCDVPHVDRQDYQLIDITDDGYVSLLTESGNTKDDLXKLPTDDVLLGQIQDXGFADGKDLILSCDVPPWGEEQFCAVXGNPVGGKVAL

SEQ ID NO: 187916 - protein, 167 aa, Triticum aestivum
  unsure (1)..(167): unsure at all Xaa locations
  Clone ID: PAT_TA_82334.pep
RFGIVEGLMTTVHAMTATQKTVDGPSSKDWRGGRAASFNIIPSSTGAAKAVGKVLPELNGKLTGMAFRVPTVDVSVVDLTVRLAKPATYDXIKAAIKEESEGNLKGILGYVDEDLVSTDFQGDNRSSIFDAKXGIALNDNXVKLVSWYXNSGDTAPCVDLIRHITLK

SEQ ID NO: 187917 - protein, 88 aa, Triticum aestivum
  unsure (1)..(88): unsure at all Xaa locations
  Clone ID: PAT_TA_82335.pep
RDTLMSTQLQDTLTTNEVTSVGSIMGXWKIXLKWNXGHPRSCENXXSGPAXQXDMSXXXNSRRDSXKCXYXLEXHQXIQKGIDXNXFS

SEQ ID NO: 187918 - protein, 142 aa, Triticum aestivum
  unsure (1)..(142): unsure at all Xaa locations
  Clone ID: PAT_TA_82336.pep
MAPKAEKKPVAEKAEKTTTAKKTKAEKRPPASKEGGEKKGKKKARKSVETYKIYIFKVLKQVHPDIGISSKAMSIMNSFINDIFEKLAGESXKLARYNKKPTXTSREXQTSVRLVSLATPKHPFRGASQVNSPKLVSNPLVP

SEQ ID NO: 187919 - protein, 84 aa, Triticum aestivum
  Clone ID: PAT_TA_82337.pep
RGAPGVLGRRSRRLPRDREGVPGAPRPGVRLRGVRCVHTPQEAAAVRFILVAKHLLVIYIAGLQELLIPVQKYEYLVVMAGEGL

SEQ ID NO: 187920 - protein, 121 aa, Triticum aestivum
  unsure (1)..(121): unsure at all Xaa locations
  Clone ID: PAT_TA_82338.pep
SRFSGLIFHGGGYIAVSEAXKEAXWLKEFLSTLKIVESASXPVVVYCDNQAAIKVSRYPKFHSKIKHIEGRYHYIRDVINRLKSVSLEFLPSTDMVVDPLTKSLSQVVFGKHVQAMGLRIF

SEQ ID NO: 187921 - protein, 59 aa, Triticum aestivum
  unsure (1)..(59): unsure at all Xaa locations
  Clone ID: PAT_TA_82339.pep
CHVTXVTVVNFVLVQNRFEIKTXTKQMVNISXIKTRCXGVANNAYVXIVXKHNFRRLET

SEQ ID NO: 187922 - protein, 105 aa, Triticum aestivum
  unsure (1)..(105): unsure at all Xaa locations
  Clone ID: PAT_TA_82340.pep
AAPAASAATAAAGARCSPTWRPPPAPPPWSCPPPPTRGAPAGSRWPAGRPAAATAPPASAAPPAAAPAAAATEPAPRRPAGRGEHEDEXRRSKHHHQLTPPSVSV

SEQ ID NO: 187923 - protein, 176 aa, Triticum aestivum
  unsure (1)..(176): unsure at all Xaa locations
  Clone ID: PAT_TA_82341.pep
MQIFVKTLTGKTITLEVESSDTIDNVKAKIQDKEGIPPDQQRLIFAGKQLEDGRTLADYNIQKESTLHLVLRLRGGMQIFVKTSPARPSLWEVESSDTXDNVXGKXQDKEGIPGQXRLIXAGKQLEDGRTLRXTTSKGVNLNCVRLRGXNNLALCWLTLAPVVGPALLVSVYPLLN

SEQ ID NO: 187924 - protein, 88 aa, Triticum aestivum
  unsure (1)..(88): unsure at all Xaa locations
  Clone ID: PAT_TA_82342.pep
CCSSRKCKEKNVXKLXNQSIEVDCSIVLWFTYVRREVRSTSSSLKKLCLXKRKPCSSLTRLMQCNFQSDEVCMSICVSAHGCAAHTHA

SEQ ID NO: 187925 - protein, 77 aa, Triticum aestivum
  Clone ID: PAT_TA_82343.pep
VDRPAGQWPCVPSHGVLYRTVVGAHVRVVFFRVVVVALVVFSCMVSVSMNKIIQRLVVFIHIYNELARELHSVYIFW

SEQ ID NO: 187926 - protein, 119 aa, Triticum aestivum
  unsure (1)..(119): unsure at all Xaa locations
  Clone ID: PAT_TA_82344.pep
MSDTDEHHFESKADSGASKTYPQQAGAIRKGGHIVIKARPCKVVEVSTSKTGEXMGHAKCHFVAIDIFNGKEXEDIVPSSHNCDVPHVDRXNYQLIDITDDXFXLLTESXXTKDDLNFH

SEQ ID NO: 187927 - protein, 59 aa, Triticum aestivum
  Clone ID: PAT_TA_82345.pep
SIPYISSVILLYYACLSSFFCLCLCFCVSVRESERERERERERERERERERERERERER

SEQ ID NO: 187928 - protein, 82 aa, Triticum aestivum
  Clone ID: PAT_TA_82346.pep
VTPPLCRGVIAPLHCPFSRDRSKSSLYLCRFVHLKLANQYSAAILFHLFFEGICVDRSVVAQWILHMVVELDVHIESTCNIN

SEQ ID NO: 187929 - protein, 129 aa, Triticum aestivum
  unsure (1)..(129): unsure at all Xaa locations
  Clone ID: PAT_TA_82347.pep
VTRKTRLLDVVYNSSNNELVRTQTLVKNAIVQVDAAPFKQWYLTHYGVEIGRKKKAAAAAKKEAAEGQEAEVAAAATEEAKKSNNVQRKLXEKRQXGLHWDSHIXEEHSXVEXAGCIXLPLGXCGKADG

SEQ ID NO: 187930 - protein, 194 aa, Triticum aestivum
  unsure (1)..(194): unsure at all Xaa locations
  Clone ID: PAT_TA_82348.pep
AHRAVDFKWKDYCPVVFRNLREMFKLDTADYMISISGSDALRELSSPGKSGSMFFLXKDDRFMIXKTLRKSEVQVLLRMLRDYYRHVHTYDNTLRDXIFGLHRVKLPMXXIXIVXMGNVLHTTXNHRRFVLKGXXLXRFTDKVXSTKNTXLKDWXSTTHLTXTSWGGXLLNTCDXNEPNGKGNGRLQGPQPFRG

SEQ ID NO: 187931 - protein, 148 aa, Triticum aestivum
  unsure (1)..(148): unsure at all Xaa locations
  Clone ID: PAT_TA_82349.pep
LQAWVIWNLCNVENKMISVERIFQFSNIPSESPLVIENSRPRETWPWCGTIQIEALQIQYSPDMPMVLKGISCTFPGXERKIGVVGRTGSGKSTLIQALFXVVXPSAGRIXIXGVAXPFWELHDXRXRLSIXXQDHXLPKDVXNNLFP

SEQ ID NO: 187932 - protein, 198 aa, Triticum aestivum
  unsure (1)..(198): unsure at all Xaa locations
  Clone ID: PAT_TA_82350.pep
VLDEKAAATQAIGFFALHTKSAYAPYLEESLKILIKHSGYFHEDVRLQAIISLKHILTALRAIPAHPDILXKQKDVLDTIMNIYIKTMTEDDDKEVVAQACMSVADIMKDXFAAVELYMPRLAEATLAPLHQRXCCQQVXXDGEDDGDIDHDESSXGAFKSLPASQNDAIYLIQPCELTPMLLNSISKTRCAPTRPQK

SEQ ID NO: 187933 - protein, 88 aa, Triticum aestivum
  unsure (1)..(88): unsure at all Xaa locations
  Clone ID: PAT_TA_82351.pep
LIVSSLLRLWRSXFSGIANFNMSCREVGNHDPSSGRDTNGWASEGSSNTHKADTSSANHALAQVGASFEEQMPNTNSIAAFFHFTRHQ

SEQ ID NO: 187934 - protein, 54 aa, Triticum aestivum
  Clone ID: PAT_TA_82352.pep
TTSHLSAVRGRGCKMYSKVTFPPSSDSFLFHFSSVLFPPFRTYFPFVASLVAFL

SEQ ID NO: 187935 - protein, 38 aa, Triticum aestivum
  Clone ID: PAT_TA_82353.pep
GVTIAAGGVLPNIHSVLLPKKVGKGAGTGGSASQSQEF

SEQ ID NO: 187936 - protein, 100 aa, Triticum aestivum
  Clone ID: PAT_TA_82354.pep
SAAQVIQVLKNYSYFKQILNFKDIFRKLNKLLRELLLQPLKMQIMFYVTKLNAKGIDSYSVTFNQFHIRCVSVCVLLNLVRQLLFGTWERMLPPLLQLNA

SEQ ID NO: 187937 - protein, 62 aa, Triticum aestivum
  unsure (1)..(62): unsure at all Xaa locations
  Clone ID: PAT_TA_82355.pep
NXESRGTCNAGGCKLSIPLLHHNILPGQIQKMDEXLNLFSLHNMPTFIVNMGKTKNLCKSQL

SEQ ID NO: 187938 - protein, 135 aa, Triticum aestivum
  unsure (1)..(135): unsure at all Xaa locations
  Clone ID: PAT_TA_82356.pep
VDYCESSSCRRKKIIESFGEKVQPTLCQRTCDACKHPNQVSSHLEDLRRVPNCRFNKISPVFQTSSVDPKHFNTEFWNREDDVSISRXKIYQDSDDEEEALSNITISKLPSKGGXEXKTQALERAENAYNQPKAN

SEQ ID NO: 187939 - protein, 146 aa, Triticum aestivum
  unsure (1)..(146): unsure at all Xaa locations
  Clone ID: PAT_TA_82357.pep
MVKAVAVLTGSEGVKGTIFFTQEGDGPTTVTGSVTGLKEGLHGFHVHALGDTTNGCMSTGPHFNPAGHVHGAPXDEIRHAGDLGNVTAGADGVANINVTDCHIPXTGQNSIVGLLFSSTVTLSWKGGHNLQDTGNLCRVACGSSAQ

SEQ ID NO: 187940 - protein, 114 aa, Triticum aestivum
  unsure (1)..(114): unsure at all Xaa locations
  Clone ID: PAT_TA_82358.pep
RLIFAGKQLEDGRTLADYNIQKESTLHLVLRLRGGMQIFVKTLTGKTITLEVESSDTIDNVKAKIQDKEGIPPDQQRLIFAXGKQLEDGRTLXADYNIQEGSTLHLVLRLRGGQ

SEQ ID NO: 187941 - protein, 86 aa, Triticum aestivum
  unsure (1)..(86): unsure at all Xaa locations
  Clone ID: PAT_TA_82359.pep
XXTLVSEXYIVITLCKYFXVEIMLXRSTKGNSXRHXHPQWKSVDTGCRGHARPTXXPTHGIXEPLLXALXAGTXRQLLLXPXPNPF

SEQ ID NO: 187942 - protein, 60 aa, Triticum aestivum
  unsure (1)..(60): unsure at all Xaa locations
  Clone ID: PAT_TA_82360.pep
IXDXYETKIIRVFSVQRHYXXLLVLLKLXLYKIDATKIIXVFSVQESLXSKKVFIXNFFX

SEQ ID NO: 187943 - protein, 127 aa, Triticum aestivum
  unsure (1)..(127): unsure at all Xaa locations
  Clone ID: PAT_TA_82361.pep
VTLGGPAAAGDVVRYVDADLRRRAEEVVDRARRLCAANSVQGVVKVIDGEPRYVLCNAVEKHHADLLXSVGSHGYGAIKEGISFGSRATNCAQQRATAPHDSPSSPKPKGMIFEFSISFLLSIFLNL

SEQ ID NO: 187944 - protein, 73 aa, Triticum aestivum
  unsure (1)..(73): unsure at all Xaa locations
  Clone ID: PAT_TA_82362.pep
IGFAVFLVHLATIPITGTGINPARSLGAAIIYNKKQAWDDHWIFWVGPFIGAALAGIXHVVVIRGHPLQRTRD

SEQ ID NO: 187945 - protein, 73 aa, Triticum aestivum
  unsure (1)..(73): unsure at all Xaa locations
  Clone ID: PAT_TA_82363.pep
HDKNTSTKCYGDVLMLNKIILELGMNSRSPILRCAXRNAXNLLGXVLXVYXISIGVMYQKFXXKSPXNXQRXS

SEQ ID NO: 187946 - protein, 70 aa, Triticum aestivum
  unsure (1)..(70): unsure at all Xaa locations
  Clone ID: PAT_TA_82364.pep
XKEXEXSRXWSFLVPLNXXIPRKKXGGKNQGTICLXNQQLLIXGLCGKGWGGLQKVTNAFCIPREASNFI

SEQ ID NO: 187947 - protein, 93 aa, Triticum aestivum
  unsure (1)..(93): unsure at all Xaa locations
  Clone ID: PAT_TA_82365.pep
GTRWWRRLRRWLRRRRWRLRRPARRRLRRPVEELSGGALQLSIYLPSRRLRQQVIFMSSVLVFPVFINLDPVCPSGLWVFFDSPTPSVXLSRG

SEQ ID NO: 187948 - protein, 80 aa, Triticum aestivum
  unsure (1)..(80): unsure at all Xaa locations
  Clone ID: PAT_TA_82366.pep
MSCNCGSGCSCGSDCKCGKMYPDLTEQGXSAAAEVAAVXVVLGVAPGKQGGTFRGWPPGQSRRRACSCRDNCKLQPPATV

SEQ ID NO: 187949 - protein, 85 aa, Triticum aestivum
  unsure (1)..(85): unsure at all Xaa locations
  Clone ID: PAT_TA_82367.pep
XFPVTHCYTXXSYVSXELQXXLVVYEXSGNISYQVLHXLGSAXHXSEXITXSXTHXMXCXEKVXAXXPQILLNLLQXVTXFFFPG

SEQ ID NO: 187950 - protein, 169 aa, Triticum aestivum
  Clone ID: PAT_TA_82368.pep
EGEKKGERQKTSSTTDHRSLSPAIDSGSGEWRSIGSSSSSLTRKVCVDLSLFASSHEARKMQELARRYSQRIIDDNQKLSSELESKMHDLDSVYKHLDELASQGISHTRNYEQEKNEIMQKEKHVALLFDMFRARKEPKQNLSKINTQGQIGTCESKKMMAEQIRDYKT

SEQ ID NO: 187951 - protein, 106 aa, Triticum aestivum
  Clone ID: PAT_TA_82369.pep
ARPAWRRATQYLHPLHNAAAPPPALPQPIHPPGAITSSHHHLARPTRLEVVVVWCPTPSSTSLLQPAAVRPQPSLLLLSPRCPCCSFSHVLLLLLFSDPHCCCLLL

SEQ ID NO: 187952 - protein, 170 aa, Triticum aestivum
  unsure (1)..(170): unsure at all Xaa locations
  Clone ID: PAT_TA_82370.pep
WIPGCRLXNYFSAGAMIWILSGIGIVLLPSSMHNFMYALSITIGAANALMTVTSISMEGVLVGEDLNGCAFVYGSLSFIDKVSCGIALYILESYQGSTKISENQELAYGYSVTRLGLGLVPAVFSXLSAIVAHTMDLPEXDGDSSGASSCLTLLVTLALLKFDGNPAYNS

SEQ ID NO: 187953 - protein, 94 aa, Triticum aestivum
  Clone ID: PAT_TA_82371.pep
HFISSSLITNHVSVICNKPRYTHIYTCIFFAGIYTSIFLQSLHSRPPSHTYELSLTLTLQILRTTWHLLPDRSQFTSRRRSSPLRHPRRRRQRR

SEQ ID NO: 187954 - protein, 131 aa, Triticum aestivum
  Clone ID: PAT_TA_82372.pep
GSKAKKSVETYKIYIFKVLKQVHPDVGISSKAMSIMNSFINDIFEKLAGESAKLARYNKKPTITSREIQTSVRLVLPGELAKHAVSEGTKAVTNSPPPRQLFDPPSLHASVCTLVIMMLQLCKDCVACSAA

SEQ ID NO: 187955 - protein, 152 aa, Triticum aestivum
  unsure (1)..(152): unsure at all Xaa locations
  Clone ID: PAT_TA_82373.pep
LTGKTITLEVESSDTIDNVKAKIQDKEGIPPDQQRLIFAGKQLEDGRTLADYNIQXKESTLHLXVLRLRGGMQIFVKTLTGKTITLEVESSDTIDNVKXKIQDKEGFPGPTASIFAGKQLXDGARXADYNIQEGSTLHWCSSPWWHAIFVKT

SEQ ID NO: 187956 - protein, 111 aa, Triticum aestivum
  unsure (1)..(111): unsure at all Xaa locations
  Clone ID: PAT_TA_82374.pep
MAEGYVHAGGAELTLDSRDSPCLRPDAGPACCHDLEAYLHLLDGFMGSGRPFRADASRSVAGLLVYQAXSVKRAYVERARVLGFEPAAMPRAATANGAGTADGQYGSWHPS

SEQ ID NO: 187957 - protein, 181 aa, Triticum aestivum
  unsure (1)..(181): unsure at all Xaa locations
  Clone ID: PAT_TA_82375.pep
LMARDAVVLAGGPTWPVALGRRDGRVSIANETNQLPPPTSNFTRLSKMFGAKGLDAKDIVVLSGGHTLGTARCVSFTDRLYNFTGANNPADVDPALGRRIRGQAEVQCRSLADNTXLAEMDPGXFLTSTPXYARWKRKSKFRSRSRTPTQYSTQARLSPPILATSESWSDTRVSRERGCLK

SEQ ID NO: 187958 - protein, 197 aa, Triticum aestivum
  unsure (1)..(197): unsure at all Xaa locations
  Clone ID: PAT_TA_82376.pep
ARSAAIVMRAVRKTVDTGRTIVCTIHQPSIEIFESFDELLLMKRGGRIIYSGSLGPHSCNMIDYFEAIPCVPRIKEGQNPAAWMLNVSSNTTEYEIGXWDYAEIYRRSSLYKENXDLVDELGKPTPGIEDLHFPPIYWQNFSAQCMACLWEQRCAYWEKPGHNVARXLNTLSINYVGSCIWQTGXTIKQQQDYHIQP

SEQ ID NO: 187959 - protein, 73 aa, Triticum aestivum
  unsure (1)..(73): unsure at all Xaa locations
  Clone ID: PAT_TA_82377.pep
GSGGYGGGGGGYGGQGGGGYGQGGGGGYGQGGGGYSGQRGGGGYGGGGXGYGGGGGGYGGQRGGGDSGXXWRN

SEQ ID NO: 187960 - protein, 112 aa, Triticum aestivum
  unsure (1)..(112): unsure at all Xaa locations
  Clone ID: PAT_TA_82378.pep
EVLISTARKKEEENHRHFSALNTLENSAQQKIKKEAKRMRDEFFSFFKNFERQHAAIRMRRGASGVDVDSGNCRNASPIPDLAVSTPCNAKPTPPASGGCQGNTNSSTDVXX

SEQ ID NO: 187961 - protein, 118 aa, Triticum aestivum
  unsure (1)..(118): unsure at all Xaa locations
  Clone ID: PAT_TA_82379.pep
LGRWGVDVHTLLRLRARGCAPDHLQDEADSLATTXPNHSKQSTSRRGVSSVIQQLYWRKQIXXAGSTLGXGTLKTLGDXAXVGQWVLRFNXVPFPNXTXGPXXVKKGNGFPAXKKSAL

SEQ ID NO: 187962 - protein, 69 aa, Triticum aestivum
  Clone ID: PAT_TA_82380.pep
FFFFGTQCNSFRFHKAPLYLRAFGAKVTADLGFAPQKLQHLAQRFVAWYTRCPSYRSPQDASLSRGLWG

SEQ ID NO: 187963 - protein, 89 aa, Triticum aestivum
  unsure (1)..(89): unsure at all Xaa locations
  Clone ID: PAT_TA_82381.pep
KDHRAAATTTATTTTSTVTTTASTSPVVVKEETLAGSSSEAQARDQRAMDTVTGVLQQVDHRELMDQVFNEELQAYDTGGPANTMXTLC

SEQ ID NO: 187964 - protein, 109 aa, Triticum aestivum
  unsure (1)..(109): unsure at all Xaa locations
  Clone ID: PAT_TA_82382.pep
SIGWEVDVICSKVLSAKMLKRTKINLNEISHNSAMGLVRKAIDNGVLLTEVYIDTVGDPEKYRVKLTEKFPGIKFVVAKKADSSTLLLSGSKYSCKGTXDRALRNWVFG

SEQ ID NO: 187965 - protein, 92 aa, Triticum aestivum
  Clone ID: PAT_TA_82383.pep
LEYLAAEVLELAGNAAKDNKKTRIVPRHLLLAIRNDQELGRLLSGVTIAHGGVIPNINPVLLPKKAAEKAEKAGAAPKSPKKTTNPPRRHQG

SEQ ID NO: 187966 - protein, 146 aa, Triticum aestivum
  unsure (1)..(146): unsure at all Xaa locations
  Clone ID: PAT_TA_82384.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLXVGLFEDTNLCAIHAKRVTIMPKDIQXARRIRGERAVCMPLCQLH

SEQ ID NO: 187967 - protein, 172 aa, Triticum aestivum
  unsure (1)..(172): unsure at all Xaa locations
  Clone ID: PAT_TA_82385.pep
VKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPXDQQRLIFAGKQLEDGXTLADYNIQKXSHLTGSSARWQTPGHGLLVKLVVLGVSMDLVVSLI

SEQ ID NO: 187968 - protein, 113 aa, Triticum aestivum
  Clone ID: PAT_TA_82386.pep
DNGFKTYDAYSKRNFIMRVWYMYSMHDLPTYALFVGWCVHGRFPCPTCKGDLEFRWLQAGRKFSCFDMLRQFLDPRHKFRKDKKNFIRGRVVKNSAPPALTGQQTLGSVKLRG

SEQ ID NO: 187969 - protein, 113 aa, Triticum aestivum
  Clone ID: PAT_TA_82387.pep
PASSSFGAANTLTLPPRRPGSSAAAAGASSGAAGASSATAGASGSAGGAASSFTSSGAAGSASATASLVSVSTTAGASVSLGASASGSAAAAGSGSLASSVSAAAGATSLVSS

SEQ ID NO: 187970 - protein, 66 aa, Triticum aestivum
  Clone ID: PAT_TA_82388.pep
AGGTEDVKRYKEKAPHAEVAHPSPHHFYPLHVALGAAGEESRAELIHHSWTNTSISYSSYRFSTKI

SEQ ID NO: 187971 - protein, 85 aa, Triticum aestivum
  unsure (1)..(85): unsure at all Xaa locations
  Clone ID: PAT_TA_82389.pep
HPLVPHGXPKXXPGAGMPTXKXXLIXNFXTFFXMLVLVKRCTNGFPMKXTXDXXXTVIFMVSSRVSFLILSQKIAELNGPSSSSS

SEQ ID NO: 187972 - protein, 126 aa, Triticum aestivum
  unsure (1)..(126): unsure at all Xaa locations
  Clone ID: PAT_TA_82390.pep
GGRFLLANVYDLVMELIANHRKYGFSTASVACCGNGGRYAGIVPCGPTSSMCDDRENHVFWGPLPPQREGNVLLRQLHPSDGDSKYISXPMNLKEVFXVLRDRETPDIGSFRPGTFLRFVPQIWAC

SEQ ID NO: 187973 - protein, 119 aa, Triticum aestivum
  unsure (1)..(119): unsure at all Xaa locations
  Clone ID: PAT_TA_82391.pep
GKEPRGISQVSGGSKKALFSRMVVFENXPNGXLYXHLHHGEASQLCWLRRMKIAIGIAQGLRYLHTELQPPFPISRAELHSVYVTEXFTPKLGLFLKCWEVFQSMRKGALIQNRLFQPQ

SEQ ID NO: 187974 - protein, 134 aa, Triticum aestivum
  unsure (1)..(134): unsure at all Xaa locations
  Clone ID: PAT_TA_82392.pep
NQDKNKYNTPKYRFVVRFTNKDVTAQIVYATIAGDIVMAAAYSHELPRYGLEVGLTNYAAAYCTGXLLLAVRVLKEPLIFDXEYEGNVXATGEDFXFEPSDXRRLSRALLDVXGLIXTTTGNRCVLGPFKELWG

SEQ ID NO: 187975 - protein, 91 aa, Triticum aestivum
  Clone ID: PAT_TA_82393.pep
PPLFLSCTATRPRPSPPLAVAVTIAVPTTPRASQELHLVPLFVITVPCSAGRPRTPSMPSSSTSSFFFFFFFSPRTTSDVQSVICLLFSCL

SEQ ID NO: 187976 - protein, 81 aa, Triticum aestivum
  Clone ID: PAT_TA_82394.pep
PSVYDEYCSLILEFRKVCEKEKSGRAMMDKEIATEEEDIYCLEEIGKLAIECLKEDVEDRPDMAAVVERLVMLKKDRMLES

SEQ ID NO: 187977 - protein, 74 aa, Triticum aestivum
  Clone ID: PAT_TA_82395.pep
EVEVEAVRLLLNLHALLLGSLFVGLCLLRFVESCMFKREVVLPSTLINYRRCKMPCLHAAMNNGFMSCLLYMDF

SEQ ID NO: 187978 - protein, 196 aa, Triticum aestivum
  unsure (1)..(196): unsure at all Xaa locations
  Clone ID: PAT_TA_82396.pep
PKSIGLLSFDGGIAGCQKIIHEILTWEAKSDVKIEVLHDLKEIGSALYWMSLLDIVLRQIDTTQFMQSAPWLGLVPGSDGQVKHAYSDNTPFTTLLKCCXPSAVASSPACANPSSYLVMSKQAEAASLLYKSNLNSRSVLEYAXCFTSAAWDRHYTNGVQLKDRFNDITTSRTQRVLVASVSYLEYMTILKNKCGD

SEQ ID NO: 187979 - protein, 64 aa, Triticum aestivum
  Clone ID: PAT_TA_82397.pep
GVEFALGQALGGHMRRHRAHEQEGSTHGPVVAEREPGETRRGLLLGLDLNATPAEQAMDLSLWA

SEQ ID NO: 187980 - protein, 45 aa, Triticum aestivum
  unsure (1)..(45): unsure at all Xaa locations
  Clone ID: PAT_TA_82398.pep
TYLLKQLSHTXLLLQKWKKRQYIRDPILATXLNVTTRHSIPTVRX

SEQ ID NO: 187981 - protein, 135 aa, Triticum aestivum
  unsure (1)..(135): unsure at all Xaa locations
  Clone ID: PAT_TA_82399.pep
ATEKTPAGKKPKAEKRLPAGKTASKEAGGEGKTRGRKKGSKAKKGVETYKIYIFKVLKQVHPDIGISSKAMSIMNSFINDIFEKLAGESAKLAAXQQEPTITSXEIQTPSARLPGEXAKHASPKGTKRHKLTPPK

SEQ ID NO: 187982 - protein, 132 aa, Triticum aestivum
  Clone ID: PAT_TA_82400.pep
TLALLFLSRPLPTLTFLAMVICASQWIVLTLILSSCRSPMDFPTPPPAETTPLPTPSSIVLMAGRPQLGNNNMFTLNYRQMDAKLGTTGTLLRPSPLSLPSPSSWLLSSPSSKRLLIPFRFDCKSKRRKARL

SEQ ID NO: 187983 - protein, 97 aa, Triticum aestivum
  unsure (1)..(97): unsure at all Xaa locations
  Clone ID: PAT_TA_82401.pep
XAQLCSALIPVVLTLLSTQRTTPTFLKNMSYPKWALEGFIIANAKRYPGVWLITRCGLLFRSGFNIHNYQLCIVVLFMYGIFFRIVAFVAMVLLKKR

SEQ ID NO: 187984 - protein, 95 aa, Triticum aestivum
  Clone ID: PAT_TA_82402.pep
FSKLRILNYHLIFHIDNTHVYLWVQSFNRTQRKIGAYSFASQPFTARVMSTVILYENIHPKGIYIYIYIYIYIYIYIRIAPTQSACQRKKCKKER

SEQ ID NO: 187985 - protein, 133 aa, Triticum aestivum
  Clone ID: PAT_TA_82403.pep
MLVSFVRTEECCLGLIAFLGSLGTQWFTQLNSMQSLNHLWVSWLKWVSNTTARQTVLILLSYVDWTDKNRTHHLCQQSGNPLSTKLKLRIIEIPWANDDVTELALWMVLLLQSALIPGAHDGPACRGGAVDHR

SEQ ID NO: 187986 - protein, 90 aa, Triticum aestivum
  Clone ID: PAT_TA_82404.pep
MSCNCGSGCSCGSDCKCGKMYPDLTEQGSAAAQVAAVVVLGVAPENKAGQFEVAAGQSGEGCSCGDNCKCNPATVKLHAPYVLCCESIRE

SEQ ID NO: 187987 - protein, 50 aa, Triticum aestivum
  Clone ID: PAT_TA_82405.pep
IKCVSCPPRRRILPCRFLDPEADTHDHDRLAVYRFCIFKSVSGSKRNNSA

SEQ ID NO: 187988 - protein, 75 aa, Triticum aestivum
  unsure (1)..(75): unsure at all Xaa locations
  Clone ID: PAT_TA_82406.pep
MSCNCGSGCSCGSDCKCGKMYPDLTEQGSAAAEVAAVVVLGVAPENKAGQFEVAAGQSGEGCSCGDNCXCNPCNC

SEQ ID NO: 187989 - protein, 100 aa, Triticum aestivum
  Clone ID: PAT_TA_82407.pep
IVGGTGELAMASGVVNKRVHGKTDGGDIIELTIHGFCRKQIAPTKAGPWGGNGGSAVESDKPWKIESITILYKGVMGHLEYSLHQAKNGQQAHRQALGGN

SEQ ID NO: 187990 - protein, 47 aa, Triticum aestivum
  Clone ID: PAT_TA_82408.pep
CLNKKWILSGVNLLPAQHVSTHSRVQDGSISITNGSERHKKYTFPLA

SEQ ID NO: 187991 - protein, 126 aa, Triticum aestivum
  unsure (1)..(126): unsure at all Xaa locations
  Clone ID: PAT_TA_82409.pep
RIEEAHRLRMLDNQHLQWRCINARTDATLLVQSFTAEKTLHSAWKEISKLRDNVSSKRCKLQLQKQKLKLFAILRGEMSYLEEWAHVEETPFXSLSAAIGSTKXITSVSSFGGAXADPKCEGAVTG

SEQ ID NO: 187992 - protein, 148 aa, Triticum aestivum
  unsure (1)..(148): unsure at all Xaa locations
  Clone ID: PAT_TA_82410.pep
IFAGKQLEDGRTLADYNIQKESTLHLVLRLRGGMQIFVKTLTGKTITLEVESSDTIDNVKAKIQDKEGIPPDQQRLIFAGKQLEDGRTXQTTTSRRIHLHLVLKXRLXMQIFLKTSTXKTXXLEVXSPGNIXNXXGKXQXKGDSPXQQ

SEQ ID NO: 187993 - protein, 93 aa, Triticum aestivum
  unsure (1)..(93): unsure at all Xaa locations
  Clone ID: PAT_TA_82411.pep
MAEETNTATRPAPRLVRGVSEAGLEAWAKTHQLDNKDLQLKAEAEEVTSLAAAIKKTSKAKPPNRIFKKELALAFLLLIAATRSLLXAQXAAL

SEQ ID NO: 187994 - protein, 79 aa, Triticum aestivum
  Clone ID: PAT_TA_82412.pep
PSVRAVAALMCRNLPEGAALKLTVHRLQLHLFAVACSRLRIPAALVVAGCGIAASSAYVSSLGCVRELWVACVWYQIVV

SEQ ID NO: 187995 - protein, 81 aa, Triticum aestivum
  unsure (1)..(81): unsure at all Xaa locations
  Clone ID: PAT_TA_82413.pep
LGSSRGFINSAGLLSSLLLHIIPTSLFLHIIPASGHMWHKDSLWCSTCCITFSSGSCKVLISTFRRKTNLEDTLCGCNQLX

SEQ ID NO: 187996 - protein, 73 aa, Triticum aestivum
  Clone ID: PAT_TA_82414.pep
EKTNRLEPRVCLCVVVVGSSAWTYSVCNIDMTAHMNVGYRDRSSISFHGVQIGLAVLMAHGWTMQYSADMNLG

SEQ ID NO: 187997 - protein, 99 aa, Triticum aestivum
  unsure (1)..(99): unsure at all Xaa locations
  Clone ID: PAT_TA_82415.pep
MAPVKLYGATLSWNVTRCVAALEEAGVEYELVPINFGTGEHKTPXLARNPFGKVXTFQXGXLVXFNXXQFXVCXPAKNKPXCXKEGDIKESTXVVXWSQ

SEQ ID NO: 187998 - protein, 108 aa, Triticum aestivum
  unsure (1)..(108): unsure at all Xaa locations
  Clone ID: PAT_TA_82416.pep
XFXSHXVMLXLENXXCHWKPYGXLIIRSRSGXRWXNXCCPQEVLXFWRRGQQALSMVAFERGLRFDTHRCLSCAVGIXPLVSQPRRIKXWNKWHLLPYRGLXIKKKKK

SEQ ID NO: 187999 - protein, 54 aa, Triticum aestivum
  unsure (1)..(54): unsure at all Xaa locations
  Clone ID: PAT_TA_82417.pep
FFFLNVAEHLNIKFSKHNQLGFSSYALTQTXIVHLCTEKKGFIFLYNHTSNRRI

SEQ ID NO: 188000 - protein, 81 aa, Triticum aestivum
  unsure (1)..(81): unsure at all Xaa locations
  Clone ID: PAT_TA_82418.pep
PLTFRXAPSSDXLLYXSILEXLCFXXXGXXFLLFAYGGVCRHLSXGSVCVSYANNTXLSXTSXQIVSIIIAKKGGXTGNXG

SEQ ID NO: 188001 - protein, 85 aa, Triticum aestivum
  unsure (1)..(85): unsure at all Xaa locations
  Clone ID: PAT_TA_82419.pep
PGEIDTXVNXSIMXHKPVNWNQXIQSXRHRKGXVAAGXRKSTQKTXPSASILLTATPVDVXGEPVSKPPNQNSATRLQDEXGXXK

SEQ ID NO: 188002 - protein, 88 aa, Triticum aestivum
  unsure (1)..(88): unsure at all Xaa locations
  Clone ID: PAT_TA_82420.pep
TPPCFVAAASPPPRRSSPAWAGRQPPAGGLRASSAHXLPAATPRCMWLHHMEACYHXGRMHLNKFTRXQLLYNQASVPLVLMSSILNV

SEQ ID NO: 188003 - protein, 123 aa, Triticum aestivum
  unsure (1)..(123): unsure at all Xaa locations
  Clone ID: PAT_TA_82421.pep
RYGGTQGTTLVSVSHGGVADRSQPYRALDPHSGESLKINRLKIHPWSTKYPKHIVGALGXIGMDXSNTQRFTHTQTIHTLXMVSLTGQQYGGKCXIIYXNCXXHSLCTQHXXFKNNTSLFKKK

SEQ ID NO: 188004 - protein, 75 aa, Triticum aestivum
  unsure (1)..(75): unsure at all Xaa locations
  Clone ID: PAT_TA_82422.pep
MXCNCGSGCSCGSXCKCGKMYXDLTEQGSAAAQVAAVVVLGVAPENXAGQFXVAAGQSGXGCSCGDNCKCNPCNC

SEQ ID NO: 188005 - protein, 58 aa, Triticum aestivum
  unsure (1)..(58): unsure at all Xaa locations
  Clone ID: PAT_TA_82423.pep
SWPXLVGESIEEAREXILKGTXXGDIVVLPNGSAMTMGLRSNRVRILVDTVATAPNNG

SEQ ID NO: 188006 - protein, 100 aa, Triticum aestivum
  unsure (1)..(100): unsure at all Xaa locations
  Clone ID: PAT_TA_82424.pep
QGWRNMENXQPTIEIANKPXYRMTLHTPTELVLTIFAKGVQLTXGVDFGEQMLSVQLTPGEEHTFXPXLFQRSPHKCXYTVLSTKVNAPSKTEHNWSWYW

SEQ ID NO: 188007 - protein, 191 aa, Triticum aestivum
  unsure (1)..(191): unsure at all Xaa locations
  Clone ID: PAT_TA_82425.pep
LXVFFXXVXRPKVIVHNXXFXIGELGQXMXPGRVDLXXSXLNXXYXGSSXSSRXPXAAPCAERATWGSFRRVRXSAAXHRQAACLXXLEPRXRRLRXXTNRAPIPTXPXXAXRRQXLMTAXTAGAGTPRTRRDSGWRFXTRTTTXAGDSGQVHXPXLVRPHLSPGVLQPRXPPXLIVLQXWVGXHSQVQQQ

SEQ ID NO: 188008 - protein, 149 aa, Triticum aestivum
  unsure (1)..(149): unsure at all Xaa locations
  Clone ID: PAT_TA_82426.pep
AVFFRVXRKNDKXKXLKCNRLSKGXTLXNXVXKAAYGGLLDMDIKAHGGIISLKTMVTPVXENXGGGGRXCITXPVYPGHXLNGKQATVLXTTGTGALQXSNLTXGXGNXEREXLPDXLXAQLGNSSYKIRTGSSVALCGGIDHMVPAM

SEQ ID NO: 188009 - protein, 152 aa, Triticum aestivum
  unsure (1)..(152): unsure at all Xaa locations
  Clone ID: PAT_TA_82427.pep
TVFSATDAKRSARDSNXPNFGALPTGFAGFLXHWRHSITGTGSTRESSGRIIYNKKQAWDXHWISGLAVIRAXLAASTLVVIRASPQXRDYQQSICRHGRVDLSLSTSSYVVVVALLVIPRISTSSSRVLLRSLWTVNRCVLPPYVRSTELR

SEQ ID NO: 188010 - protein, 68 aa, Triticum aestivum
  unsure (1)..(68): unsure at all Xaa locations
  Clone ID: PAT_TA_82428.pep
FXXLSEFXYNRITIYXXTTXSCQXXLHVVRGGPFREAAWVKLPRVSGFXIFLQPXYECRCQCXGQCXX

SEQ ID NO: 188011 - protein, 84 aa, Triticum aestivum
  Clone ID: PAT_TA_82429.pep
QKKCVRLSINFTYTSQGYLSNFCSTTLVIAENITVIKNKIVSIYNFFKCSDVSKEFSTNLQYNNEKPTVQGAQFDKLANKFTQS

SEQ ID NO: 188012 - protein, 58 aa, Triticum aestivum
  unsure (1)..(58): unsure at all Xaa locations
  Clone ID: PAT_TA_82430.pep
NLKAPITXIKSEKINNXXTEXXKLILXEVNSLGXLVTIXXKLTKDFSYPAGLLXXCLP

SEQ ID NO: 188013 - protein, 110 aa, Triticum aestivum
  unsure (1)..(110): unsure at all Xaa locations
  Clone ID: PAT_TA_82431.pep
VPRGKTTCAQVDCNLRYKFKPTSLLIHXRRKEHAPSTISVXFSFHSSSMLFGKSVFLFFFTDGAFFSTFWKLLEALRYFLFPFLRFFLVSVSVFPCSFYFIFPLLVYLFF

SEQ ID NO: 188014 - protein, 54 aa, Triticum aestivum
  unsure (1)..(54): unsure at all Xaa locations
  Clone ID: PAT_TA_82432.pep
SAVTSSSIKPVFYSTRXATXLIFTTIPKIEAFHGEITTPWXPRFAPCITFKKKK

SEQ ID NO: 188015 - protein, 102 aa, Triticum aestivum
  unsure (1)..(102): unsure at all Xaa locations
  Clone ID: PAT_TA_82433.pep
INSNFRDSSRLILIFSEIIWXVSNSGESTAESAATTARSEQAARTXFYIDLRSLVTRTCIDSRPRGDGRRVLGLIQSASXPRLHRLQASMPSASIHVHNKMP

SEQ ID NO: 188016 - protein, 75 aa, Triticum aestivum
  unsure (1)..(75): unsure at all Xaa locations
  Clone ID: PAT_TA_82434.pep
MSCNCGSGCSCGSXCKCGKMYPDLTEQGSAAAQVAAVVVLGVAPENKAGXFEVAAGQSGEGCSCGDNCKCNPCNC

SEQ ID NO: 188017 - protein, 83 aa, Triticum aestivum
  unsure (1)..(83): unsure at all Xaa locations
  Clone ID: PAT_TA_82435.pep
EGTCCVCCVXHRFSSDRCGHMCTCFECXXRLFRVEGVPLCRAPIIEVTLLHHETRWYVEYTKEERKKAMESLAAKDNITWTMI

SEQ ID NO: 188018 - protein, 70 aa, Triticum aestivum
  Clone ID: PAT_TA_82436.pep
CLSNFKNIMNFKNLKFWKPFMILNYIHGFKKYSQIKNVFKLKKCSQTLNDHEHYKYPHIIDITEFKKYEF

SEQ ID NO: 188019 - protein, 135 aa, Triticum aestivum
  unsure (1)..(135): unsure at all Xaa locations
  Clone ID: PAT_TA_82437.pep
RHEARAAVATAASVVAAATAVATAAAVAATAASAAATPAASGGTERRGPPVIDLSTISSSSSASYLQCRRRRVPVSVSLESCVSFGPVVFLIASXSVALSGVNRAGYXRKETTCVTFNPXCSSGDQHPFCQWIGM

SEQ ID NO: 188020 - protein, 63 aa, Triticum aestivum
  Clone ID: PAT_TA_82438.pep
RRSEGFNLEKRRRNNNQIRANPSRIDPPETHLYMPTDDTRHIIRTGTKRTLFRLQRATAVSFF

SEQ ID NO: 188021 - protein, 53 aa, Triticum aestivum
  unsure (1)..(53): unsure at all Xaa locations
  Clone ID: PAT_TA_82439.pep
LDIHSCFVLSGYMAPEYASHGLFSVKSDVFSFGXVLVLEIISGKKIPMSVGFH

SEQ ID NO: 188022 - protein, 105 aa, Triticum aestivum
  unsure (1)..(105): unsure at all Xaa locations
  Clone ID: PAT_TA_82440.pep
MAVGKNKRISXGXGXGSXKXAVDPFTXNQWYDIXAPLLFTSRXVGNTLVSRTQGTXIASXGLXHRVFDXSLSDLXXDXDXAYXKIXLRXEDVQGMNFXTXFXGML

SEQ ID NO: 188023 - protein, 116 aa, Triticum aestivum
  unsure (1)..(116): unsure at all Xaa locations
  Clone ID: PAT_TA_82441.pep
SSLHLPLPSGFPTSRTSSWVLQHAVTRQTWSTVLALGWAAFRRTWIFSNCMRAQLESLPLIMCEVQSTWPTILSAMQCMVQSFIFLLPHQRCIHYIGGGNARRNPFXXVSNYVGCN

SEQ ID NO: 188024 - protein, 74 aa, Triticum aestivum
  unsure (1)..(74): unsure at all Xaa locations
  Clone ID: PAT_TA_82442.pep
FFFFFFFFFFFLAHSXRHXINLFXNCISNQYSMHXRCTXXAPXIPLXXXPIENFXXTXXFXXYVXLIHLXLSXF

SEQ ID NO: 188025 - protein, 116 aa, Triticum aestivum
  unsure (1)..(116): unsure at all Xaa locations
  Clone ID: PAT_TA_82443.pep
FSGIFCTSASLIAGVGALRVVRMACGMVGIFGMAATYSLLVVYTAELFPTAVRTAAMGCTAQASQMGAILAPLVVVLGEQVPFPVFGVXGIIGGXLVICLPRDYEQALYETXWKKG

SEQ ID NO: 188026 - protein, 147 aa, Triticum aestivum
  unsure (1)..(147): unsure at all Xaa locations
  Clone ID: PAT_TA_82444.pep
LGFTFTANGWXVQSYGSRCVKPPIIYGDVSRPNPMTVFWSKMAQSMTARPMKGMLTXPVTILNWXFVXNDQPRXETCYKIALAIXKEVXDLEGWVXIKVIQIDXAAFKXVCNSRXSKHAFNLDXXALXPSRITNCGXEGNHQNPNLQ

SEQ ID NO: 188027 - protein, 78 aa, Triticum aestivum
  Clone ID: PAT_TA_82445.pep
SEDVETLAAEGALAKTQRWPPMESNPPILSALGHALGLNEAYGFRDVMGYDPELFFLLPDEIFSIIQLFPSTVKTPGL

SEQ ID NO: 188028 - protein, 127 aa, Triticum aestivum
  unsure (1)..(127): unsure at all Xaa locations
  Clone ID: PAT_TA_82446.pep
GIXPLRXXKELXWAQHFXMXLXPXXAPLQGIGQXHPXVGQXXLQVSXQPSTQLGXSVALHFSTHAGIGLQSLLHGKLPALHDKLHCDAQSLHAMVAAAGHPIPNSTTTSTATTAAVLGEAISCKEAS

SEQ ID NO: 188029 - protein, 135 aa, Triticum aestivum
  unsure (1)..(135): unsure at all Xaa locations
  Clone ID: PAT_TA_82447.pep
GDKKGKKKAKKSVETYKIYIFKVLKQVHPDIGISSKAMSIMNSFINDIFEKLAGEAAKLARYNKKPTITSREXQTSVRLVLPGELAKHAVSEGHQAVTNSTPPKCRPGLLSGLWPVIEPTAMVCPKMMVPASKKK

SEQ ID NO: 188030 - protein, 97 aa, Triticum aestivum
  unsure (1)..(97): unsure at all Xaa locations
  Clone ID: PAT_TA_82448.pep
FFEGELGYKSSXXPCXKIXRXSXRGVCXAXDRLIPLIWLGFTNFKLFLKILLHACTVGDRYSLLSFPAPGAFPPSIGHSLQRQRLVTNCXIDSLAKH

SEQ ID NO: 188031 - protein, 82 aa, Triticum aestivum
  unsure (1)..(82): unsure at all Xaa locations
  Clone ID: PAT_TA_82449.pep
VDRKRNNFVAASELERAVKALMGARLRRXGRGRGEKGXGDXKAAFXXRXFXKXGPPTLRXGKLSXEIIKXANKLXXNIRRXT

SEQ ID NO: 188032 - protein, 92 aa, Triticum aestivum
  Clone ID: PAT_TA_82450.pep
MSCCGGNCSCGSACKCGNGCGGCNMYPEVEAAGATLLVSATATHKASSGGMEMAAENGGCGCTQCKCGTSCGCSCCNLLDSSVMHAPRASYL

SEQ ID NO: 188033 - protein, 59 aa, Triticum aestivum
  unsure (1)..(59): unsure at all Xaa locations
  Clone ID: PAT_TA_82451.pep
AGXPXPTRXLRKEPSRPLFMLLXEGICMSXWQGAFLIMGPGLXHNSIILNYVGTKAVVT

SEQ ID NO: 188034 - protein, 154 aa, Triticum aestivum
  unsure (1)..(154): unsure at all Xaa locations
  Clone ID: PAT_TA_82452.pep
KEWKRHLQHSLDKLRDHFCRQYVLSFIYLEGKSRLDARMYLEGNRDDLFWDSDPLPSLPFQALFGXVQQLASVAGDVPTRQRRKXXKVAXQXXTETVXSGSPNGQEFRGPFESHPTPTSLTYSPSLPNPAPPNNLLVPFQIGLPPKVPQNPPVL

SEQ ID NO: 188035 - protein, 113 aa, Triticum aestivum
  Clone ID: PAT_TA_82453.pep
MLRMMTRIWWLQRRKTFLLPRKRQSKTQIPKEKSGGKIMSRGDAKPWKQAPKPSKDELRQAVFCILGAANFATMTFGEVVKAVDKYFGKDLFKRKPLVRALIEEKEKKKKKKK

SEQ ID NO: 188036 - protein, 139 aa, Triticum aestivum
  unsure (1)..(139): unsure at all Xaa locations
  Clone ID: PAT_TA_82454.pep
CSLHLSHDNITVHHAYLRAQVQCFKEMQKMLSHDAQRSKGSSESNVSSIYVVDSNPSSGDFLFLGHLGVFXSPAERIALRAASSWQEXTIWHPLGNKEDXPGDGQEGPTGWKIPFWQKSKKSXFPKRQRXSXAXXRHPH

SEQ ID NO: 188037 - protein, 152 aa, Triticum aestivum
  unsure (1)..(152): unsure at all Xaa locations
  Clone ID: PAT_TA_82455.pep
MAAKEPMRVLVTGAAGQIGYALVPMIARGVMLGADXPVILHMLXDLNLLLKALKGVKXMSLIDAAFXLSKGVXATTDVVXACTGVNVXXXVCGIPHERKXXKEDVXTKNVXIYKAQXSALNSCXPNXKSGSNPKQCPSGRVCPTPGKNFPTK

SEQ ID NO: 188038 - protein, 55 aa, Triticum aestivum
  Clone ID: PAT_TA_82456.pep
SARGGYGQGGGGGYGQGGGGYGGQRGGGGYGGGYGGGGGGYGGQRGGDSGGQWRN

SEQ ID NO: 188039 - protein, 101 aa, Triticum aestivum
  unsure (1)..(101): unsure at all Xaa locations
  Clone ID: PAT_TA_82457.pep
TLEDIKALLSTNPNLAAPGVYETMILYISSTSXVVSAVLMVERDMEGHKFQVQRPVYYVSEVLTPVASHXYPHYQKIAYAIFMASTKTSSTTSTSVVNVAS

SEQ ID NO: 188040 - protein, 115 aa, Triticum aestivum
  unsure (1)..(115): unsure at all Xaa locations
  Clone ID: PAT_TA_82458.pep
FIMFVHGTLGYLDPESFTSRRLTDKSDVYSFGVVLLELMTRKRAIYTDSFNEKESLSYTFPLMFHQKTHHVMLDSEITDDAGMVVLGEXLNLQFTAXSQRGNDXATXKGIFQRDD

SEQ ID NO: 188041 - protein, 118 aa, Triticum aestivum
  unsure (1)..(118): unsure at all Xaa locations
  Clone ID: PAT_TA_82459.pep
KTAGNLVSPIVAHILCNMMGLPAFSSPRTRXVTSLAFLAGSISFFCLLPCYKSKTVQCXVXRSVAGMVRKWSYTKLNVGNNAHRPVVTGNEXIGXPKXQLXRGLSXLRMXKNLXTAAS

SEQ ID NO: 188042 - protein, 119 aa, Triticum aestivum
  unsure (1)..(119): unsure at all Xaa locations
  Clone ID: PAT_TA_82460.pep
LTDDQIAEFKEAFSLFDKDGDGCITTKELGTVMRSLGQNPTEAELQDMINEVDADGNGTIDFPEFLNLMARKMKDTDSRGGAQGGFKVFDKDQNXFISAAELRHVMTNSARTHRRGQMS

SEQ ID NO: 188043 - protein, 160 aa, Triticum aestivum
  unsure (1)..(160): unsure at all Xaa locations
  Clone ID: PAT_TA_82461.pep
EVSILQSKRLRNKVAGFTTHLMRRIQRGPVRGISLKLQEEERERRMDFVPEKSALEVDEIRVDKETXDMLAFLGMADLPGVERAPXVTPPPPPNVSRSTGPWWKPRLSSSASLVTLYMLKSLNVLVNNVLTQLNSSVLICWWTYFIHLYSDINVIFGKKK

SEQ ID NO: 188044 - protein, 129 aa, Triticum aestivum
  unsure (1)..(129): unsure at all Xaa locations
  Clone ID: PAT_TA_82462.pep
LKLKIKKKENGVLKLAAPKEGMKGILEFDAEVFEFAPSLHLVELKKTNGDTIEYKQLMKDEIRPALKDVVWAWQGESHPLPEKFIRGEQQQSPLPSLQQQSXLSSQQQQSXLPXQQHQQSPLPSQQPQE

SEQ ID NO: 188045 - protein, 78 aa, Triticum aestivum
  Clone ID: PAT_TA_82463.pep
DNTSSRRWKAHVEVMKNLSTGNTALFFIYYQISRRIFLMLQFSSISTSKLISHNYTGCICIMDVYVSVKVINSRLCST

SEQ ID NO: 188046 - protein, 125 aa, Triticum aestivum
  unsure (1)..(125): unsure at all Xaa locations
  Clone ID: PAT_TA_82464.pep
NKVYVLDCDRTEDYXRERERWRERERDTERERERERWSERDQQVLXXECXRSESEDCQRERKRERWRQREREREREREREIEMKGEGPTRFVCWXXATELKFXRERERVRESDIDRERERDQHTN

SEQ ID NO: 188047 - protein, 73 aa, Triticum aestivum
  Clone ID: PAT_TA_82465.pep
STPTQREWEIKVIDCPLSCYNKYVHFMENDKLSVKSFAERAQKDSNMTPSRSGTKLQKARRPAPGEMYGEEVN

SEQ ID NO: 188048 - protein, 147 aa, Triticum aestivum
  Clone ID: PAT_TA_82466.pep
LTTLMVFAHYKWFKHEGGLFHFVHSRFRDATSIQQLISCKPRQSILSKEHIVTVMFVGNFIGIVCARSLHYQFYSWYFYSLPFLLWRTQFPTVVRIILFVVVELCWNVYPSTAYSSLLLLFAHLLILFGLWSSPAEYPMSIKRTRRQ

SEQ ID NO: 188049 - protein, 55 aa, Triticum aestivum
  unsure (1)..(55): unsure at all Xaa locations
  Clone ID: PAT_TA_82467.pep
SCVYNLAVARVWPLSYIAPTSTVKTHSHDGRRGTVHALRTDAAXRLAALNNSSWL

SEQ ID NO: 188050 - protein, 66 aa, Triticum aestivum
  Clone ID: PAT_TA_82468.pep
GFEKRHQCSSRGVIEVVAVNSPFIDAKYMDPLRSWMIQYWRLMRKDHNHRRKRERRSLNAPTSSDQ

SEQ ID NO: 188051 - protein, 137 aa, Triticum aestivum
  unsure (1)..(137): unsure at all Xaa locations
  Clone ID: PAT_TA_82469.pep
MARGLKKHLKRLNAPSHWMLDKLGGAFAPKPSSGPHKARECLPLILILRNRLKYALTYREVQSILMQRHIMVDGXVRTDKTXPAGFKXINSIPKTGXRTTASFDTKGRXRLNLQGXDAKFKLCKXRXVQXWQKXIPN

SEQ ID NO: 188052 - protein, 113 aa, Triticum aestivum
  unsure (1)..(113): unsure at all Xaa locations
  Clone ID: PAT_TA_82470.pep
PTVLPSETVLTMATINGAKAVLWDNEIGSLEVGKKADLIVVNPFKWSMLPLHDCIANTVYCMRSENIESVMCNGQWIMKDXKIMNVNEEEVISSAVKRATALLXRAGINSLKG

SEQ ID NO: 188053 - protein, 133 aa, Triticum aestivum
  unsure (1)..(133): unsure at all Xaa locations
  Clone ID: PAT_TA_82471.pep
MQIFVKTLTGKTITLEVESSDTIDNVKAKIQDKEGIPPDQQRLIFAGKQLEDGRTLADYNIQXKESTLHLVLRLRGGMQIFVKTXTGKTITLEVESSDNIDNVKGKIQXDXEGIPRDNRSXFAXKQLEDGAPR

SEQ ID NO: 188054 - protein, 181 aa, Triticum aestivum
  unsure (1)..(181): unsure at all Xaa locations
  Clone ID: PAT_TA_82472.pep
GWCAXAXRXXIFHEXIRTATRXRLAGGXXXLXXYAXXRXLQRIGGAEEACCXRPXGXHRPRDRKMRXIGLTGGIASGXEHXLWXLXIGRRPCRRRGHCGSGKHPXSXIXVLQLQXMRAFXACCGYSIIXTXEXYXTQVXNYFCIXLXXXPIHXWGEKXRPKTTPXNXVVXXXVPFXRXNFX

SEQ ID NO: 188055 - protein, 119 aa, Triticum aestivum
  unsure (1)..(119): unsure at all Xaa locations
  Clone ID: PAT_TA_82473.pep
LALRDRVLLPRVSGLQRPLRGPRRRLLREADMPVLQGGDQEVVQHRVRQHVQHHAGFAVYLQCQWEQVDXCSQASGKVSKPAGEEANYRRRDASVLCCNFVWFXKFRVANSYSPSQKKK

SEQ ID NO: 188056 - protein, 82 aa, Triticum aestivum
  Clone ID: PAT_TA_82474.pep
FPIIVRRSSLCKYLLSFLLLSLSVQAYFFFFFLRNVQAYYLAVRKETTNTKHCGSGIVCFQHVSRHMSCSKPAGKHIFTELL

SEQ ID NO: 188057 - protein, 61 aa, Triticum aestivum
  Clone ID: PAT_TA_82475.pep
EFSLRFYPLTQQCLLYFAHEGLLFSISLLCKEEYISKVYCWAWDKSSVSTTCRAVLLNTLD

SEQ ID NO: 188058 - protein, 150 aa, Triticum aestivum
  Clone ID: PAT_TA_82476.pep
DKVEVASYCASVVIVISNILTDGKHLVPMISRDLPFLEGLLEVLPEVPDDDQARYALWSILSRVLAQVQGTELNSLSLDRFASLFSGKFGLIKDDLESQVVDEEKLTPEDALLKGWISRCLMAISFFKERWIEENPPKGNKDPSTMLGKC

SEQ ID NO: 188059 - protein, 80 aa, Triticum aestivum
  Clone ID: PAT_TA_82477.pep
PCCAVMTIADVGWSRRLSITGSLGNMHLLYLRLQNYLKEPFTNTSVLCYSCHNLTFDICCHFNALLAVILILLLLYSHLY

SEQ ID NO: 188060 - protein, 144 aa, Triticum aestivum
  Clone ID: PAT_TA_82478.pep
SRRFSKWVTRSSSSCNHTRANHKLAYKFYRPFPIIDKINEVVYKLQLPPQATVHPVFHISLLRQALLPGMTVEPHLSHCLDDLALPDAILQTRWRNNKDGVQEQLKIQWSATSNLGITWEDKANLMARFPHEEAWGQASSKEEG

SEQ ID NO: 188061 - protein, 98 aa, Triticum aestivum
  Clone ID: PAT_TA_82479.pep
LNMATLLDPTRTYPYRYRAAVLMDENKEEEAIGELTQALAFKPDLQLLHLRAAFQDSMGDSASTLRDCEAALCMHPQHGDTLELYNKASSKADHQSES

SEQ ID NO: 188062 - protein, 62 aa, Triticum aestivum
  unsure (1)..(62): unsure at all Xaa locations
  Clone ID: PAT_TA_82480.pep
LXXSSXIGXXPHQDVWVPLGXPHGCVGGCLLCPHVWQLSASQKNVVYCVXTCGVIRRPKKCN

SEQ ID NO: 188063 - protein, 115 aa, Triticum aestivum
  Clone ID: PAT_TA_82481.pep
HYNRSSKMHAVGFERKNIKVNHNSEGEDGSPHPRTHAGYSAAAPVTCEKNGPAGTKMMMKAGGAVAYICDRSGRSGGGFPHADLAPMSPAPPVASDPTTPAPCSPFHRTRSWFPP

SEQ ID NO: 188064 - protein, 63 aa, Triticum aestivum
  unsure (1)..(63): unsure at all Xaa locations
  Clone ID: PAT_TA_82482.pep
XFFGMKQFFYKENMKIHVESTDYHRPTTLLEEDESCKKERKKERNMRHPPSSIASLMSDLSIV

SEQ ID NO: 188065 - protein, 61 aa, Triticum aestivum
  unsure (1)..(61): unsure at all Xaa locations
  Clone ID: PAT_TA_82483.pep
SHAPPITHSSIIFNHYADLWFQFSLVRLICCYLCLTNSWDGRGNLYFLDLLXVINIALLVV

SEQ ID NO: 188066 - protein, 81 aa, Triticum aestivum
  unsure (1)..(81): unsure at all Xaa locations
  Clone ID: PAT_TA_82484.pep
EGFXKISXGXLKRXCLWWGXKXXLLLXQXSRLTRNPIWXWLNQKXAPLFFQXQSLQPSATQHDQTPNNSPGEDVIHXQPVM

SEQ ID NO: 188067 - protein, 160 aa, Triticum aestivum
  unsure (1)..(160): unsure at all Xaa locations
  Clone ID: PAT_TA_82485.pep
MAPKVAVAKKGDAKAQAAKVAKAVKSGSIKKTAKKIRTSVTFHRPKTLSKARDPKYPRISTPGRNKLDQYQXLKYPLTTESAMKKIEDNNTLXXIVDLKADKKKIKXCCQEMYDIQAKKVNTXIRPDGKKKLRELTXDYDLLDVATNHIARGRPAIACSL

SEQ ID NO: 188068 - protein, 104 aa, Triticum aestivum
  Clone ID: PAT_TA_82486.pep
PSRTSPTPFASAATSTTSFAQWHHRLGHICGSRLSSLVRSGVLGSVSGDSSLTCMGCKLGKQIQLPYPSSNSVSQRPFELVHSDVWGPALFVSKGGHKYYIIFI

SEQ ID NO: 188069 - protein, 143 aa, Triticum aestivum
  unsure (1)..(143): unsure at all Xaa locations
  Clone ID: PAT_TA_82487.pep
TLADYNIQKESTLHLVLRLRGGMQIFVKTLTGKTITLEVESSDTIDNVKAKIQDKEGIPPDQQRLIFAGKQLEDGRTLADYNIQXKESTLHLXVLRLRGGMQFSVKTXTGKTSRSSRSSDTXTCEGXVQDKEGIQPDNTLXCW

SEQ ID NO: 188070 - protein, 146 aa, Triticum aestivum
  unsure (1)..(146): unsure at all Xaa locations
  Clone ID: PAT_TA_82488.pep
AFGGCGDSVLELKSLLEENIISDLLEKADLVVKDERTLEAGGSKCSCFTDSSEMTNGTSYKLACRDNSSDNYIYCPNARDVQNGALDHFQEHWLKGEPVIVRDVLELTSGLSWXEPMVMWRLYEEKKDKSEHERPQLQSLSVLAWS

SEQ ID NO: 188071 - protein, 161 aa, Triticum aestivum
  unsure (1)..(161): unsure at all Xaa locations
  Clone ID: PAT_TA_82489.pep
MQIFVKTLTGKTITLEVESSDTIDNVKAKIQDKEGIPPDQQRLIFAGKQLEDGRTLADYNIQKESTLHLXVLRLRGGMQIFVKTLTGKTITLXEVESSDTIDNVKAKIQDKEGIPPDQQRLNFAGKQXRGWRTLADYNIQKDHINWSSPWWMQFSSRPDGD

SEQ ID NO: 188072 - protein, 96 aa, Triticum aestivum
  Clone ID: PAT_TA_82490.pep
PNPSSRDCDHRCHWRGGRECKLKHLVHPLERSNLPVLVSHLLDELVSVFSHLPQLHSFSLDSLLHVLLQYILPHIDLSHSPLNLYIGMKKQEQKNL

SEQ ID NO: 188073 - protein, 119 aa, Triticum aestivum
  Clone ID: PAT_TA_82491.pep
MEHLTALKKLDIQSCENIQSLPTLPKSLEWFQVMGCIWDALPGNMEHLTALKRLDIKSCKNILSLPTLPKSLEEFNVMNCSRDALRGNMEHVTSLKKLRSGHARICGRSQHCPSLLDDL

SEQ ID NO: 188074 - protein, 158 aa, Triticum aestivum
  unsure (1)..(158): unsure at all Xaa locations
  Clone ID: PAT_TA_82492.pep
MASKRILKELKDLQKDPPTSCSAGPAGEDMFHWQATIMGPPDSPYAGGVFLXVNIHFPPDYPFKXPPKVSXFKTKASIPNINSNGSICLDIPXXSXWXLALXIFQRPGXPTXSLAEPXXNPXVPLVPGXCPXFQXRXGQKYXXKTRXWAKNXPKNIGN

SEQ ID NO: 188075 - protein, 174 aa, Triticum aestivum
  Clone ID: PAT_TA_82493.pep
KDGLITESQTRIILEESTDCNANHLVTCNTCGSLDVPLKMLICDSCEAAFHLPCCIPCIKVVPAGEWYCQPCLKKKPKSLYGQLLEGKVKSSGNMDQRPHGMSHTEYMFNDAESYVTGGSDLVEISQAEVPKWSGPFQVTMVFTAPSELILANQETNSVQRITQQQVNGNGYNA

SEQ ID NO: 188076 - protein, 85 aa, Triticum aestivum
  unsure (1)..(85): unsure at all Xaa locations
  Clone ID: PAT_TA_82494.pep
SSPPGRVXIGIGISSVYDENSPNTLIIQGXLSAAAAGILNYMXXVDLLAEDFMNLRVQGNGRLQVIVNLSLLLGTALMSVLAIWA

SEQ ID NO: 188077 - protein, 140 aa, Triticum aestivum
  unsure (1)..(140): unsure at all Xaa locations
  Clone ID: PAT_TA_82495.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTXSGNTKDDLXLPTDDVLLGQFKTGLLMEGLICL

SEQ ID NO: 188078 - protein, 133 aa, Triticum aestivum
  Clone ID: PAT_TA_82496.pep
IGRFLKKGRYAQRVGSGAPVYLAAVLEYLAAELLELAGNAAKDNKKSRIIPRHLLLAIRNDEELGKLLAGITIAHGGVIPNINPVLLPKKTAENPPRSPSRPRRPPPQEGLVPCVLGVAGVYGWVCLRILNSK

SEQ ID NO: 188079 - protein, 66 aa, Triticum aestivum
  Clone ID: PAT_TA_82497.pep
YLYSTGHMCLDLSSPYDACQRRKIKRNKRKNFDSLHKSKYIKLKDRPFTRGKQRLPCAYLFVCSTP

SEQ ID NO: 188080 - protein, 131 aa, Triticum aestivum
  Clone ID: PAT_TA_82498.pep
HHDDPPWDMPTSELFCFYLHGRCTGLQYFKFLRLLSVYGCTNMSSWQESILLLTSLQKLELHESDMPGWLCKLSSLRELHIIKSKPPLNLSQFVYDRHQIALRIEDCQGTLKQVPSVVILGHDKTHHFCGK

SEQ ID NO: 188081 - protein, 68 aa, Triticum aestivum
  Clone ID: PAT_TA_82499.pep
TFSNPQKPNRKKDTGLLRSGEAKKFKKIKLTNGAPTHGAPYYLPAFKIQNKSKNKKKVTNGAPAHGAP

SEQ ID NO: 188082 - protein, 97 aa, Triticum aestivum
  unsure (1)..(97): unsure at all Xaa locations
  Clone ID: PAT_TA_82500.pep
WXVETXXXXINLXGDAXGINXXGQXQFXLAXXXQXPFAVXCGVFKSFVXFFLAAFLPSXRFLLQHXLFCCXXLKQXRSXNLSXXLFXSLPLLXEASI

SEQ ID NO: 188083 - protein, 166 aa, Triticum aestivum
  unsure (1)..(166): unsure at all Xaa locations
  Clone ID: PAT_TA_82501.pep
PNKKXGEFFASSQQDSISIKPWASKLQWFWXAYKHLFWCGLDGPKLEPPNGDGNPTGNQYPILNAMVWYGELHNQNFLGATIPNNERELKVTKLVDGPLGSKKYSXTSKTNKGLPGATKDFKXKDTRXVXRKRRRXXXKRKXTVLATQXXIAPXNFKNXXXTQKAX

SEQ ID NO: 188084 - protein, 104 aa, Triticum aestivum
  unsure (1)..(104): unsure at all Xaa locations
  Clone ID: PAT_TA_82502.pep
IDQQMGFTLLGVAXTPFITLFGRSLLLXNTLKWASILGPXGKTVLQLAXLSLSLXSNGXLLMFTKHFXRPMFVXPQIXPHLVRSXGKRRKLDRILMTXSSSXLI

SEQ ID NO: 188085 - protein, 154 aa, Triticum aestivum
  unsure (1)..(154): unsure at all Xaa locations
  Clone ID: PAT_TA_82503.pep
QGAVDVDIGANPSAEGGGDDEGVDDQAVKVVDIVDTFRLQEQPAFDKKQFISHMKRYIKNLSAKLEGDDLDAFKXKNVESATXYLLNKLKDLHSLLAKSMHDDGGVVFAYYKGGTADSTFLYFAHGLKKVKVLTHCMLNQSQYFLRLQTKLPQI

SEQ ID NO: 188086 - protein, 138 aa, Triticum aestivum
  unsure (1)..(138): unsure at all Xaa locations
  Clone ID: PAT_TA_82504.pep
NPWAIRRSSDRSPPPGIDHVVHLPLQVHHHRRHXRGASHACCCNSTDKRVQXRATTSTXGVQFRGRMXNNXPQXQQTPKLGTPVGKDHQXYYKXKQXRGAGXFWLWXHPXGNFNTWXLGKXXQQHXCQMQCVXPXNVI

SEQ ID NO: 188087 - protein, 152 aa, Triticum aestivum
  unsure (1)..(152): unsure at all Xaa locations
  Clone ID: PAT_TA_82505.pep
XVIRXSFILXIPNPSLVGLXKXLPGKXDNTYTXGQXGQXLDGRAEXVNPHTQAXFVGLHQIGRFVINVYSNTITRTNVXVLAALTVAGFXTCSCRPQLQPFAGLPRRATSNCPALFSGATPRTTTGGRPSAAGGLPLLPSDPGYIFPGNLQF

SEQ ID NO: 188088 - protein, 88 aa, Triticum aestivum
  unsure (1)..(88): unsure at all Xaa locations
  Clone ID: PAT_TA_82506.pep
PSPSSTARRRQPPSLFFPLHQPSTTPFHRSFRKWEKWVFFMFIYKMFNASCXIGGTEMFPWDGCANPGLKWGEGHKIKALKNPGMGAP

SEQ ID NO: 188089 - protein, 123 aa, Triticum aestivum
  unsure (1)..(123): unsure at all Xaa locations
  Clone ID: PAT_TA_82507.pep
RHEAAAVAXTAASAAATPAASGGTERRGPPVIDLSTISSSSSASYLQCRRRRVPVSVSLXSCVSFGPVVFLIASSSVXLSGVNXSWLRDGKNTCVTFXPAXSSVXKILXSMVGXXFXTNFESI

SEQ ID NO: 188090 - protein, 53 aa, Triticum aestivum
  unsure (1)..(53): unsure at all Xaa locations
  Clone ID: PAT_TA_82508.pep
SFHNNKVGHKEQXFFPSSLNQXSLYFXWXTSANIARLLHGDHSLQFFMYLSSI

SEQ ID NO: 188091 - protein, 76 aa, Triticum aestivum
  unsure (1)..(76): unsure at all Xaa locations
  Clone ID: PAT_TA_82509.pep
MSCNCGSGCSCGSDCKCGKMYPDLTEQGSAAAEVAAVVVLGVAPENKAGQFEVAAGQSGEXGCSCGDNCKCNPCNC

SEQ ID NO: 188092 - protein, 128 aa, Triticum aestivum
  unsure (1)..(128): unsure at all Xaa locations
  Clone ID: PAT_TA_82510.pep
PLNRYSXHHXFQNFRCSSXKPRXLLLLGTSYRAGYGVNGGQALSRRSTNLQILHLLLPETRLHSHCHVLSCFLAAVGGHHRTGLREGEQKGIRRRPVGTRLREGGGRQRLEPAALQEKSSCRRAAAGG

SEQ ID NO: 188093 - protein, 110 aa, Triticum aestivum
  unsure (1)..(110): unsure at all Xaa locations
  Clone ID: PAT_TA_82511.pep
IAEPSGVTRATARTRRLPPRPRRRRRRCTGRPRRRWGAPRTTSASARRCCPGAPRAARPARPTRAPSGGCSGRTPTGRTRRGFGFQPNDSSTRIMIFDTCISQSFNTXKA

SEQ ID NO: 188094 - protein, 78 aa, Triticum aestivum
  Clone ID: PAT_TA_82512.pep
LLKNIPNMVPTNKGRYVQLRKDLFFYSRWYYLFVRLSIRKKNDKPRTWAAHSMAQQRQASYFRVHAGVKTLFIATSIT

SEQ ID NO: 188095 - protein, 83 aa, Triticum aestivum
  unsure (1)..(83): unsure at all Xaa locations
  Clone ID: PAT_TA_82513.pep
SXLKKCMEXLGXXHVRXXXPPLXSXQNXGARXVHLXQTKTLLXLQXQXIKSXXHXPXYSXKLXRXNTIXQQFIKHKRXXQKRX

SEQ ID NO: 188096 - protein, 139 aa, Triticum aestivum
  unsure (1)..(139): unsure at all Xaa locations
  Clone ID: PAT_TA_82514.pep
IPPRVHLWHYDPSILEHDLSEMLREAITRPLLCLRKELHDRVAWRVIVICLVCSPLAFLEMRSLFHIWFLATGMGSVLGLCTAVVSSVXDILLEPTGWGISMELGQXIPFTHAYSQANKGITAILTGPYHADILGLVPT

SEQ ID NO: 188097 - protein, 86 aa, Triticum aestivum
  Clone ID: PAT_TA_82515.pep
KFLLYMIHARETAESPYGGKLVWHQILCGLMLRHYWNFFILLMKFHLMIHHMYLSRVIRLLQMRYCSNAFALYAYCVTCILSYDAD

SEQ ID NO: 188098 - protein, 114 aa, Triticum aestivum
  unsure (1)..(114): unsure at all Xaa locations
  Clone ID: PAT_TA_82516.pep
MSDTDEHHFESKADSGASKTYPQQAGAIRKGGHIVIKARPCKXVEVSTSKTGKHGHAKXTLXQLTFFNGKXLEDIVPSSTTVXLPNVDRQDYQLIYITDMYXXLLXENWXTKDT

SEQ ID NO: 188099 - protein, 90 aa, Triticum aestivum
  unsure (1)..(90): unsure at all Xaa locations
  Clone ID: PAT_TA_82517.pep
MKGTKLAAILILQAVLVMGVLSHVNADYFPKCCNNCRSFSGVDVCDDAHPKCPKGCSACRVXVSTSPEMWRCADMKSTVDGTCXGPCKXY

SEQ ID NO: 188100 - protein, 60 aa, Triticum aestivum
  unsure (1)..(60): unsure at all Xaa locations
  Clone ID: PAT_TA_82518.pep
NLAQTLNGRFASEIGAAVENXVXTWKLRWFSEETLLKFISVLKALYSGAVSSPLPVKCIS

SEQ ID NO: 188101 - protein, 141 aa, Triticum aestivum
  Clone ID: PAT_TA_82519.pep
TYCPDQVQPVRPALFVFGDGFTDVGNNNYLENNEVGNPVRANHSYYGIDFPNSVATGRFSNGFNLADFIAKAMGFEMSPPPYLSLNSPTKMDAGFAGSQLCFGDFWDLGETSTPDWDIPLDGPSRTSPDTIGKWVPTVSKT

SEQ ID NO: 188102 - protein, 52 aa, Triticum aestivum
  Clone ID: PAT_TA_82520.pep
FFFWTGEFTVLQKQIDSVVHGFTAPRTHHKLIDPGSKLKRLMVMARKETTRS

SEQ ID NO: 188103 - protein, 115 aa, Triticum aestivum
  unsure (1)..(115): unsure at all Xaa locations
  Clone ID: PAT_TA_82521.pep
FFFFTKTCXVGAIYVIKERQTESASNGQANAHKRMYIIPKDHGSSSRDKFLTSTCESIKHRRRSVFTTSSPGHSPSGHRRSCRRPWLVEDLGVGGRDGAVIVACAFIRRTALSCC

SEQ ID NO: 188104 - protein, 142 aa, Triticum aestivum
  unsure (1)..(142): unsure at all Xaa locations
  Clone ID: PAT_TA_82522.pep
MGMAEKSSATRKAGLITKTLDRCWSTPMRNKPAEGCFSVYVGAGRQRFVVRTVCVNHPLFRALLEXAEEVFGYAAAXPLXLPCNXXMFAGVLEQIEEEKMAGRRKCGLARGNSYRLLTGRAVIIDRDIILMIPDNSNFVNNG

SEQ ID NO: 188105 - protein, 166 aa, Triticum aestivum
  unsure (1)..(166): unsure at all Xaa locations
  Clone ID: PAT_TA_82523.pep
TIEKDSEWAIVGGTGEFAMARGVIARKVQSIQDGERHELTIDAICRMKNQPIHTKLGPWGTQGTKKHDIQDKPAHLYSVEIRYGSLIDAISFSYIDQSGQFRTAGPWGGSGGKETKIQLGPGEVVKEVSGTSMXGFVSSLKLVTNIKXTYGPFGEKRXPPSTHPCP

SEQ ID NO: 188106 - protein, 86 aa, Triticum aestivum
  Clone ID: PAT_TA_82524.pep
FVLSSPAAGLLRQPSSTPRRPVTGAANSSPAFPHLRRLAQHANHPLSIPHRIGTGSKSEGLLVAVKTCEGFINKDYCRMFGVVVVH

SEQ ID NO: 188107 - protein, 149 aa, Triticum aestivum
  unsure (1)..(149): unsure at all Xaa locations
  Clone ID: PAT_TA_82525.pep
AQHIGCLLGKGGSIIAEMRKVTGASIRIFGNEQIPRCAQRNEELVQVTGSFQSIQDALRHITGRIRDLIIPPKPHPSGGMPPYPPVGNPSHHQSRQEAPPHHSGXMPPYPKHPFRPNPPKGPFDVADHRPPGQALSHPMEWVLIGSLWW

SEQ ID NO: 188108 - protein, 121 aa, Triticum aestivum
  Clone ID: PAT_TA_82526.pep
EVQFETLPVVKSQDIFTFVFPRETCMTPSGLWPGYVVDATPEYVFFIDCPCHEYAAFGSPVFNVRGQLVGMCYAFQSRIHTWAVRKLKSYFDKYLDEKQSGRICYFKDGVQISGKKIGLPE

SEQ ID NO: 188109 - protein, 164 aa, Triticum aestivum
  Clone ID: PAT_TA_82527.pep
RFKHGVLSMPTVPVDDSTEYMFLNMMAFERLHVGAGNDVTAYVFFMDNIIDSAKDVALLSSKGIIQNAVGSDKAVAKLFNSISRDVVLEPDSALDAVQRQVNGYFRQPWNMWRANLIHTYFRSPWAFLSLAAAVFLLVMTIMQTVYTVLPFYKPDSNSPPSISD

SEQ ID NO: 188110 - protein, 114 aa, Triticum aestivum
  unsure (1)..(114): unsure at all Xaa locations
  Clone ID: PAT_TA_82528.pep
QENLCSCNVKFSSPIHVLFSVIFQAPYKLGNKILNSKCAYLPMIWLIVIAGRYCILFLTCLKRPNQFVVTFLALGFYSSIGASFCHKPCVHHFAKIVCXPSVASHAXDRCCCXQ

SEQ ID NO: 188111 - protein, 89 aa, Triticum aestivum
  unsure (1)..(89): unsure at all Xaa locations
  Clone ID: PAT_TA_82529.pep
MKGTKLAAILILQAVLVMGVLSHVNADYFPKCCNNCRSFSGVDVCDDAHPKCPKGCSACRVVSTSPEMWRFADXKSTVDGTCGGPCKKY

SEQ ID NO: 188112 - protein, 145 aa, Triticum aestivum
  unsure (1)..(145): unsure at all Xaa locations
  Clone ID: PAT_TA_82530.pep
HVSAHYTHSMVWLPASSPRWRALRKVCSGELFAPHRLDMHQSLRQEKVHQLVSHVTQLAREGVPVHVGHLAFTTALNLLSSTIFSTDLADLDDRHVKLGEFKAVLAELNVTVGLXNLSDFIPEVAWLXLQGVRRLSEGLFQXVHA

SEQ ID NO: 188113 - protein, 85 aa, Triticum aestivum
  unsure (1)..(85): unsure at all Xaa locations
  Clone ID: PAT_TA_82531.pep
ILLQGFPRXLEKDFEQHLDDVXEXNGVIGVHNVHLWNLTNTDIVGTFHLHISAEADKSVIRESASRIFQEAGVQDLTIQIECVER

SEQ ID NO: 188114 - protein, 56 aa, Triticum aestivum
  Clone ID: PAT_TA_82532.pep
NDLFVSDLILGILSLDKDVQPISGSLLVALSSETHGLEMNRASDIARINETLQILV

SEQ ID NO: 188115 - protein, 137 aa, Triticum aestivum
  Clone ID: PAT_TA_82533.pep
MESAVQRTMAPSGIRFEVEKFNGTGSFGLWQTRIKDLLAQQGCLKALLQEAKPAKMEADDWEELQLKVAETIRLCLSDQVIYHVMDENSLKKIWEKLESQFMSKTATTKVYLKQKLYEMRMQEGSDLVEYMNAFNQV

SEQ ID NO: 188116 - protein, 115 aa, Triticum aestivum
  unsure (1)..(115): unsure at all Xaa locations
  Clone ID: PAT_TA_82534.pep
SSARQPANTKLSSNKTXRRVRVRGGNVKWRALRLDTGNFSWGNEAVTRKTRLLDVVYNSSNNELVRTQTLVKNAILQVDATPFKQWYLTHYGVXIRWKKKAAAAAKKGSFLRTRS

SEQ ID NO: 188117 - protein, 148 aa, Triticum aestivum
  unsure (1)..(148): unsure at all Xaa locations
  Clone ID: PAT_TA_82535.pep
MAPQQQLLLLLLLLATPLPRPAAADDGAAGQPPLVHPFFYYSPPPPSALPLTVPPPTPTPTPCSCGPMQSPTTACNCGRMPPPXDRPPQPAGRAPRAPFRVPRADRSAAPSPDALRCRRRTSPKVVLISRCCALRFVVRTTGAMQYYH

SEQ ID NO: 188118 - protein, 64 aa, Triticum aestivum
  unsure (1)..(64): unsure at all Xaa locations
  Clone ID: PAT_TA_82536.pep
DNSXARFXQDXXNKRAADCXXQHSXXPFGKNIFWGSGQXWXAANAXXXWVDYKRYYHLNTXTCD

SEQ ID NO: 188119 - protein, 153 aa, Triticum aestivum
  unsure (1)..(153): unsure at all Xaa locations
  Clone ID: PAT_TA_82537.pep
RAAPSAPAAVPATILVQPPQPVQVQVPVSVPVKMDDSLPALPQAPMPVTVTMEGSEPLRFPXVMSPQSGIVDVXKNFLTPMFKEMIHAVXINMGSSPFGXKLPEPPHGLPMEGEKWRNSESWELEVYLKRIRTAARQVKAHRTQILHTDRFLS

SEQ ID NO: 188120 - protein, 110 aa, Triticum aestivum
  unsure (1)..(110): unsure at all Xaa locations
  Clone ID: PAT_TA_82538.pep
SPEKEASTMSGRGKGGKGLGKGGAKRHRKVLRDNIXXITKPAIRRLARRGXVXRISGLIYXETXXVLXIFLXNXIRDAVTYTEHARXKTVTXMDVXYALNRQGRILYGFC

SEQ ID NO: 188121 - protein, 156 aa, Triticum aestivum
  unsure (1)..(156): unsure at all Xaa locations
  Clone ID: PAT_TA_82539.pep
NNVGVMIVYMIIIGDVLSGTSSGGEHHYGVLEGWFGTHWWNGRFFVLLVTTLGVFTPLACFKRVDSLSYTSAISVALAVVFVVITAGIAIVKLIHXQIPMPKLFPGXXXLEPAGXLFTAVPVLVTAXVXHYNVXQSIMXQGSSKXKPIMHHHWQAN

SEQ ID NO: 188122 - protein, 172 aa, Triticum aestivum
  unsure (1)..(172): unsure at all Xaa locations
  Clone ID: PAT_TA_82540.pep
RSAGSAASTGDTLSSTTATQIQAAVAHPVIIASHRLLLQQRPNLVRGWSRQAPVSSSSTTATNSESQQGEEYEHLEYIIRGPPPAIQYCGELEKYCHWGNEVKLYRRHVDKLYAMFPRKIPDIKYYVCTVNKTFAQQGQRMYFQVHYTKIKLKNTLIQMMTCSXQARKQYLP

SEQ ID NO: 188123 - protein, 59 aa, Triticum aestivum
  Clone ID: PAT_TA_82541.pep
KAEKATGEVMPLQRWLDPDKDLASTVLYLVGDDSRFMTGTTIYVDGAQSIVRPRMRSFL

SEQ ID NO: 188124 - protein, 102 aa, Triticum aestivum
  Clone ID: PAT_TA_82542.pep
DLVLPDLVLELCYVSVVRLEIAAPNRFASVALAAAVHCTLYTASSCWPPFNSTKVAERNGACKSCWTQACYSAKLSCCSCSCDFCLSVLVTTYECPYPTNQL

SEQ ID NO: 188125 - protein, 97 aa, Triticum aestivum
  Clone ID: PAT_TA_82543.pep
FFFLFQRSSREPSTLSFAPNPAPLPDAARRSPSLRPHLLRYARERERERERERDVVRSVSPITTCRQFSGECPNSASTLHDLHTAEAITHFLILLRK

SEQ ID NO: 188126 - protein, 84 aa, Triticum aestivum
  unsure (1)..(84): unsure at all Xaa locations
  Clone ID: PAT_TA_82544.pep
XDKAAAHXKGGAKKVVISAPSKDAPMFVVGVNXDKYTSXVNIVSNASCTTXCLAPLXKXXNXKFXXIXGXXXTVXXITXTQKNX

SEQ ID NO: 188127 - protein, 106 aa, Triticum aestivum
  unsure (1)..(106): unsure at all Xaa locations
  Clone ID: PAT_TA_82545.pep
RVDXHXPLGCXGIFNQACEXAAEXRLLXSPPVXDVXQFGYFKVLXKXICRRXXSSFKAKLISQDXREEDQVXRRRCRDCCLDXVRDCALRCIISLXLVXSRTSXLC

SEQ ID NO: 188128 - protein, 101 aa, Triticum aestivum
  Clone ID: PAT_TA_82546.pep
MPARRRLAIAAVAKSHATLLKSGVISPTPWIEVKNEVHSFNAEDGSHPRMDEIYEMLSLLLHNFPVQPVHQETTGSHRLANYQIMGLTQPLLEMIDNFNPG

SEQ ID NO: 188129 - protein, 174 aa, Triticum aestivum
  unsure (1)..(174): unsure at all Xaa locations
  Clone ID: PAT_TA_82547.pep
VPLVLKGVRTGRDRRGANQKAYQIQQLLEPGAQDRRLSSLRFKHTRAATQPSQPAPPISSPQAVHEKAAGHSRHTEYQKLIVTGAPRRPNSPSVSNVRRSRQRLXLLXLRWITPSVRXLSLKTKARRTRRXGQFRVSTILXQHLEMTQFNVXCARMNTFXKHQPXKSKMRHRRX

SEQ ID NO: 188130 - protein, 138 aa, Triticum aestivum
  unsure (1)..(138): unsure at all Xaa locations
  Clone ID: PAT_TA_82548.pep
NDAHTHISTVAAGTLGYLDPEYHATFQLTIKTDVYSFGIVLLEIITGKPPVLMDPHTYHLPNWVRQKMQKAYSKISVDKRLLVXYDANXLQSVVDLAMNCVGECSIDRXSMTXVVSKXKCCCQHSKAKNSSFPFEFHD

SEQ ID NO: 188131 - protein, 98 aa, Triticum aestivum
  unsure (1)..(98): unsure at all Xaa locations
  Clone ID: PAT_TA_82549.pep
XMTLLTEGMKMSLSPPEEMRDKHNTLVGLGSRDNLPLSRKPVGNFRCQVPRRPKLLDILLCDGGGHPPALKAGSGHGQEFGVFWLKPWVLELEVGEGE

SEQ ID NO: 188132 - protein, 141 aa, Triticum aestivum
  unsure (1)..(141): unsure at all Xaa locations
  Clone ID: PAT_TA_82550.pep
FFFFFLDEYIFLQEKLPINSSSIMVVQRTLEIIKVTSRSVNHLATTTNTEASRRCTAVIAPPFFVPSLHLLGQGQLQSKPFGSRHLQKLLTFVRTANLLLKYSLPPGLSXGFKDXKTEXGTKNRYKRXDPLIISTIXFPDP

SEQ ID NO: 188133 - protein, 137 aa, Triticum aestivum
  unsure (1)..(137): unsure at all Xaa locations
  Clone ID: PAT_TA_82551.pep
MSDTDEHHFESKADSGASKTYPQQAGAIRKGGHIVIKARPCKVVEVSTSKTGXKHGHAKCHFVAIXIFNGKNLRYLPSSXNCDXPHVDRXNYXLIDITDDGXXNLXTEXGNXKXDLTSHRXXXLGNLKTXFPKGKAS

SEQ ID NO: 188134 - protein, 132 aa, Triticum aestivum
  unsure (1)..(132): unsure at all Xaa locations
  Clone ID: PAT_TA_82552.pep
ANGLLLAVETSLPKQKKSQAVSEFKCSVVLHKRRAKVQQEPDPPDIPNDVLVHIFSFLDTRSLXVAASLVCWSWXNSSANDNKLWENELPLFLNPICAPNTRLSPGVLHRICGSFDDSNLNWKEFSYKKHAT

SEQ ID NO: 188135 - protein, 183 aa, Triticum aestivum
  unsure (1)..(183): unsure at all Xaa locations
  Clone ID: PAT_TA_82553.pep
DDVELVAVNDPFITTEYMTYMFKYDTVHGHWKHSDIKLKDDKTLLFGEKPVTVFGXVRNPEEIPWGEAGXADYVVESTGVFTXDKDKAAAHXEGXGAKKVGISAPKQRSPMFVVCVNEDXXTSRLYIVPNANCTTNALLPLTXFIXDXFRINEGXMTRSHHTQETMASNKANGKAQVKSSNNM

SEQ ID NO: 188136 - protein, 96 aa, Triticum aestivum
  unsure (1)..(96): unsure at all Xaa locations
  Clone ID: PAT_TA_82554.pep
KDLNFQAQQGLHVAVCGTAGSGKSSLLSXNGMVPKLLGEAKTCGTMPYVSQXAWIQSDKIQDNILLCKRXEREKXYGRALEWCSLKKDWRLRXIGE

SEQ ID NO: 188137 - protein, 105 aa, Triticum aestivum
  unsure (1)..(105): unsure at all Xaa locations
  Clone ID: PAT_TA_82555.pep
ILRTFLGKKLNILWKGNQNLNILKNREKRKRNKRPKKENKQKKRKKKKXKRNRKEFENLKNKKEIEREEKGIENELKKQKNKERKKRNRKRKRKTVKNWFKNLLE

SEQ ID NO: 188138 - protein, 85 aa, Triticum aestivum
  unsure (1)..(85): unsure at all Xaa locations
  Clone ID: PAT_TA_82556.pep
RSHVTRSLSPXLAQFAXEASLXAMREGMXNTCQVNTLXSGPNAQRHTHGQAMPTQTLSLTCHTHGHGFRAQGTFCKISRRNKNTY

SEQ ID NO: 188139 - protein, 86 aa, Triticum aestivum
  unsure (1)..(86): unsure at all Xaa locations
  Clone ID: PAT_TA_82557.pep
RQSIVVDLKVWFXXHFDEFEGMNPSQSQRWPSSWPVDLRRRAHQHGNQRXTWSACHKEFPGCRGAQSGYIVSARTRAQARTQRVVP

SEQ ID NO: 188140 - protein, 152 aa, Triticum aestivum
  unsure (1)..(152): unsure at all Xaa locations
  Clone ID: PAT_TA_82558.pep
PWAAAGAEYVVESTGVFTDKDKAAAHIKGGAKKVIISAPSKDAPMFVCGVNEKEYKSDIDIVSNASCTTNCLAPLAKVINDRFGXIVEGLMTTVHAMTATQKTVDXPSXKDWXSGRAANFNXIQXTLVPQSFGKVLPKLNGNLLEWLPVFRC

SEQ ID NO: 188141 - protein, 86 aa, Triticum aestivum
  unsure (1)..(86): unsure at all Xaa locations
  Clone ID: PAT_TA_82559.pep
FLMXELXCLFIKHACTTVSHRTYVLHQESKRIEYLCTLIADHASKADVIDCNKDIYRPDRPTGRSVELLVIRPRPERRRLVDAAQQ

SEQ ID NO: 188142 - protein, 115 aa, Triticum aestivum
  Clone ID: PAT_TA_82560.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDD

SEQ ID NO: 188143 - protein, 136 aa, Triticum aestivum
  unsure (1)..(136): unsure at all Xaa locations
  Clone ID: PAT_TA_82561.pep
LSKGFEFTHFQSINQTINQNYLFNITFQNLEFWDVTLGRGNSAAVYRAITVAIPHLIWLMAHGALGRSRPTLGRQTPTGPSLGAQAAFGPPTDRRPRRLRVVQAGHHGHSVLRTVAXVKVSMATMPRLVGDXPXIR

SEQ ID NO: 188144 - protein, 76 aa, Triticum aestivum
  unsure (1)..(76): unsure at all Xaa locations
  Clone ID: PAT_TA_82562.pep
PITSPAAMTSRMSIAHTRLWRTTFPTVLYVCIYVPHCNKAVVVLCVVSYPIKLYAASSSKEMRKSIQIVXIMLKKK

SEQ ID NO: 188145 - protein, 98 aa, Triticum aestivum
  Clone ID: PAT_TA_82563.pep
CMQNQFVQSLLCWNGYLFLGVPLLRISDGYANCFTTDYWLILQNVFTFFYFLLIFEAMVFFLLFISLVLLFFLKLLLLLLVLNFLFFLNVLKIRIDFY

SEQ ID NO: 188146 - protein, 138 aa, Triticum aestivum
  unsure (1)..(138): unsure at all Xaa locations
  Clone ID: PAT_TA_82564.pep
TPGGPLDLATVLLGNRIIFIGQYVNSQVAQRVISQLVTLSAIDEEGDILIYLNCPGGSLYSILAIYDCMSWITPKVGTVCFGVVASQAAIILAGGEKGMRYAMPNARVMIHQASKVDRRVIREEVRRXVGETIMPQGG

SEQ ID NO: 188147 - protein, 172 aa, Triticum aestivum
  unsure (1)..(172): unsure at all Xaa locations
  Clone ID: PAT_TA_82565.pep
GASGKDIAMEVRRVAKEVHLVAKSMEEVTQELAKVLSKYSASLHLQLHVERLCEDGRVVFGDGSSILADTIIYCTGFNYSFPFLDTEGAVTVDXXCVGPLFEHVFPPSXAPSLSFVGIPXKVFAPWVLXAQXKWXAQVLSGKRXLPPEEEIVRSVXDIXRQEAXGAPXNYTT

SEQ ID NO: 188148 - protein, 61 aa, Triticum aestivum
  unsure (1)..(61): unsure at all Xaa locations
  Clone ID: PAT_TA_82566.pep
TSATSRTSPSTASKGFPPXLPVQVQATDPLPXPPAPARASSGVSRESXQLXLQPKGEXPSP

SEQ ID NO: 188149 - protein, 55 aa, Triticum aestivum
  unsure (1)..(55): unsure at all Xaa locations
  Clone ID: PAT_TA_82567.pep
XLKEXPXDLQYFFPFGXLRSLFNFLSKXIFPXIGXACYLGRAQSLKDSCRTYHCI

SEQ ID NO: 188150 - protein, 146 aa, Triticum aestivum
  unsure (1)..(146): unsure at all Xaa locations
  Clone ID: PAT_TA_82568.pep
GPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAXKAXXAGAAPXSXPKKTTXSPKKAQRLISAPVN

SEQ ID NO: 188151 - protein, 153 aa, Triticum aestivum
  unsure (1)..(153): unsure at all Xaa locations
  Clone ID: PAT_TA_82569.pep
MPVSRIAIGAPGELSHPDTFRAGVAEFISMLIFVFAGSGSGMAFGKLTDGGATXTPAGLIAAALAHAFALFVAVSVGANISGGHVNPAVTFGAFVGGNISLLKAVVYWVAQLLGSVVACLLLKIAIAALVYDICSSAAPQRATPNADYENSSN

SEQ ID NO: 188152 - protein, 180 aa, Triticum aestivum
  unsure (1)..(180): unsure at all Xaa locations
  Clone ID: PAT_TA_82570.pep
DDPSSSESSVSSNSSSKESTDGSEVAVKKILKETRGGNLDFFAEMNTISEAKHKNLVKLKGWCCRENNRNLLDFMCWCCKKKEDDELFLVYELXPNGNLHYHLCKSDQVIPWXTRYQIVKDIGSVLVYXHHECDPXILHRDTNKQHTPGQQLNAKLADXXXSRFXNQDXGTLMTTPXGRK

SEQ ID NO: 188153 - protein, 53 aa, Triticum aestivum
  unsure (1)..(53): unsure at all Xaa locations
  Clone ID: PAT_TA_82571.pep
XFXWSALKLSHPVISPXPNKNSSRXPXCXPQPSKYLFTRTIKLHVYTGYPFGD

SEQ ID NO: 188154 - protein, 34 aa, Triticum aestivum
  Clone ID: PAT_TA_82572.pep
SISNRIHQAILQCADQLTQERIVALIPSLDVSHK

SEQ ID NO: 188155 - protein, 96 aa, Triticum aestivum
  unsure (1)..(96): unsure at all Xaa locations
  Clone ID: PAT_TA_82573.pep
XXSGNPXXWHRXLFXYCRPAFXGLQILFLXXGSLYLSXPTCFCSTGKIVINELEGDVIYIGSAMKVHCLSGPKYICSKQKTIFKEAKKISFLLVCL

SEQ ID NO: 188156 - protein, 123 aa, Triticum aestivum
  unsure (1)..(123): unsure at all Xaa locations
  Clone ID: PAT_TA_82574.pep
DAIDEYAIGQLKEFEGKKLVSATKEGLKLDESEDEXKKKXEELKEKFEGLCKVIKEVLGDKVEKVIVSDRVVDXPCCLGTGXYXWTANMXKIXXGQSXXXSSKAXYXFIXKTMGXXPRXPSWP

SEQ ID NO: 188157 - protein, 105 aa, Triticum aestivum
  unsure (1)..(105): unsure at all Xaa locations
  Clone ID: PAT_TA_82575.pep
YNHVTQHPPAVTTVAMXTVRLEKNXRAXRXTPPNSRNGRCIXXSWXEWETXRFSXKGXPXCQXXSXXXPXVVFPCPSNXSKXXLAKLSGKPFXRXSLXPXPRGGX

SEQ ID NO: 188158 - protein, 138 aa, Triticum aestivum
  unsure (1)..(138): unsure at all Xaa locations
  Clone ID: PAT_TA_82576.pep
PPKLMSSSFNLHKMQMVMQPLEDHITIRFFQLLCNQTRSSCIRIQCLFVHHRICQHMPWCVLIQISVARRTSKGHKGLLDVFLYKFSLEMAATKLPTAGRGSFVNRYRGIMGPVMLLXRGVGNXSSGISFLPRGGVQG

SEQ ID NO: 188159 - protein, 80 aa, Triticum aestivum
  Clone ID: PAT_TA_82577.pep
FFFLRNTKGDLRDTLANVDHQRCQMVRTNCSHHRPQTMKDRIFDRKARGKSGKKERDDVGGGGGGDRGNTSCGLTRSRRR

SEQ ID NO: 188160 - protein, 116 aa, Triticum aestivum
  Clone ID: PAT_TA_82578.pep
RVFFFFFSNNNSRRHDGGAMAKSREPTLLQKLLNSDIKRDRHRLLHTFKFMALNNFFKDWPAKPLEFPSVKVDQIELESDIDEEDSDDDLPDAETAKDCTSVLKGKRRLTRIHSQR

SEQ ID NO: 188161 - protein, 115 aa, Triticum aestivum
  unsure (1)..(115): unsure at all Xaa locations
  Clone ID: PAT_TA_82579.pep
MARGLKKHLKRLNAPSHWMLDKLGGAFAPKPSSGPHKARECLPLILILRNRLKYALTYRECNXILMQRHIMVDGKVRTDKTYPAGFMDTFPFPKXGENYRFFYDTKGASAFICQG

SEQ ID NO: 188162 - protein, 126 aa, Triticum aestivum
  unsure (1)..(126): unsure at all Xaa locations
  Clone ID: PAT_TA_82580.pep
TXXQXLSXCWLTPPKRPXEXXWCLLXXPXPSIVXXHVHCSSEPQXILLVYQXLLLVLALGRQYLALLGQDVGTETELVPNSARRRFFPSSLFRLLNLVWRSVRSEDPAATRSAPTCGSLLVTNLSG

SEQ ID NO: 188163 - protein, 81 aa, Triticum aestivum
  Clone ID: PAT_TA_82581.pep
MSYGDAPRCLAVEDEKKTSWPELVGKSIEEAREIILKDMPEADIVVLPTGSAVTMDLRSNRVRIFVDTVATSSHWLTRFPR

SEQ ID NO: 188164 - protein, 198 aa, Triticum aestivum
  unsure (1)..(198): unsure at all Xaa locations
  Clone ID: PAT_TA_82582.pep
GIRFAMSTHAKNLAFDLAPPSNLLKYGDHYRFPFELLDNKSVSCLACLQLSFVCFKPPPADFIGFPNLRKLDLHALKTTRQDLESILCSCITLEWLSIVRCHLKDEMKVVLQPLSQLQYLKVMHCEVTKIEFDAAXINLCYDGPYIPXTLXHATKLXNAKFWFRXAXFQRAATSXLNGLPXVQXLTLQXGMQLKNRWN

SEQ ID NO: 188165 - protein, 106 aa, Triticum aestivum
  unsure (1)..(106): unsure at all Xaa locations
  Clone ID: PAT_TA_82583.pep
SATMSGRGKGGKGLGKGGAKRHRKVLRDNIQGITKPAIRRLARRGGVKRISGLIYEETRGVLKIFLENVIRDAVTYTEHARRKTVTAMDVVYALKRXGRTLYXFGG

SEQ ID NO: 188166 - protein, 80 aa, Triticum aestivum
  unsure (1)..(80): unsure at all Xaa locations
  Clone ID: PAT_TA_82584.pep
MSCCGGSCGCGSACKCGNGCGGCNMYPEVEAAGATLLVAATATHKASSGGMEMAAEDGGCGCTQXCKCGTXSCGCSCCSC

SEQ ID NO: 188167 - protein, 132 aa, Triticum aestivum
  unsure (1)..(132): unsure at all Xaa locations
  Clone ID: PAT_TA_82585.pep
MARTKQTARKSTGGKAPRKQLATKAARKSAPATGGVKKPHRFRPGTVALREIRKYQKSTELLIRKLPFQAPXVRRFAQDFKTDSXPXSAVSALXEAARGVLXGLFXGHNLCAIHAXAHIIPRHSPADPLGTP

SEQ ID NO: 188168 - protein, 93 aa, Triticum aestivum
  unsure (1)..(93): unsure at all Xaa locations
  Clone ID: PAT_TA_82586.pep
QVVTNGVLKSIEHRVMTNSVTPRMSVAVFIEPDADCLIGPSEEFIGEGNPMRYRSLTYREFLRVXNVVKLGSPLILTTXLXTXHXQKIEKADP

SEQ ID NO: 188169 - protein, 102 aa, Triticum aestivum
  unsure (1)..(102): unsure at all Xaa locations
  Clone ID: PAT_TA_82587.pep
VFFFFFFFFFFFFFFFDEHINYLXLCLLQKKLSHRCNARAYMLVQEKSIYLLSVRAHTYTLSLQSSHKFKASSSKLITIHTDTGGINTWHIYNATEGSRSCG

SEQ ID NO: 188170 - protein, 79 aa, Triticum aestivum
  unsure (1)..(79): unsure at all Xaa locations
  Clone ID: PAT_TA_82588.pep
MSCCGGNCGCGTACKCGNGCGGCNMYPEAEAAGATLLVSATATHKASSXGGMEKAAENGGCGCTQCKCGTSCGCSCCSC

SEQ ID NO: 188171 - protein, 122 aa, Triticum aestivum
  unsure (1)..(122): unsure at all Xaa locations
  Clone ID: PAT_TA_82589.pep
NPDKVPFVPISGFEGDNMIERSTNLDWYKGPTLLEALDQXNEPKRPSXKPLRLPLQDVYKIGGIGTVPVGRVETGVIXPGKXGNFGPXGPTTEGKSVEKQQRVPPGRGFLVXNVGFNXKKLL

SEQ ID NO: 188172 - protein, 110 aa, Triticum aestivum
  unsure (1)..(110): unsure at all Xaa locations
  Clone ID: PAT_TA_82590.pep
SRPLSVCSRVRRAHPRPRLRPARARSLAASLASXXRAGGMADQLTDDQIAEFKEXFNLFDKGRRWLHQQQRTGKNYAFPWGKTKRRLTQENXNXIQSNXNGTIXFQXFXN

SEQ ID NO: 188173 - protein, 48 aa, Triticum aestivum
  Clone ID: PAT_TA_82591.pep
MRACQYTSVYELKQDKIKHIKLCGETCSLYYSRCTNLILHTLGVASDI

SEQ ID NO: 188174 - protein, 131 aa, Triticum aestivum
  unsure (1)..(131): unsure at all Xaa locations
  Clone ID: PAT_TA_82592.pep
IPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWXYDNEWGYSTRXWVDLIRHMHSTK

SEQ ID NO: 188175 - protein, 144 aa, Triticum aestivum
  unsure (1)..(144): unsure at all Xaa locations
  Clone ID: PAT_TA_82593.pep
TITNDKGRLSKDDIEKMVQDAEKYKSEDEEHKKKVDAKNSLENYAYNMRNTIQDEKIASKLPADDKKKFEDAVYAAIQWLXDANQSVRVDXFEDKXKEXXGLLQPIIAKIFXGARAYXPRGCXKDPPAANRGACPXIGPLIIFL

SEQ ID NO: 188176 - protein, 47 aa, Triticum aestivum
  Clone ID: PAT_TA_82594.pep
AAYSSAKPRLCKVEGEDAEFAYKDGVVTVAVPWSGSSSKPSRVHYVY

SEQ ID NO: 188177 - protein, 112 aa, Triticum aestivum
  unsure (1)..(112): unsure at all Xaa locations
  Clone ID: PAT_TA_82595.pep
WNVTKRAIGVEINKQVGNRIIKKRIHVRVEHVQPSRCNEEFLQRKLNNDKLKAEAKARGEVIXSTKRQPAGPKPGFMVEGTTIETVTPIPYDVVNXSQXVTKAPGCFLKQKP

SEQ ID NO: 188178 - protein, 65 aa, Triticum aestivum
  Clone ID: PAT_TA_82596.pep
EVHFLAVTFRTRLIISYPITNFIATRTETKTFVVQDKIDYLCHPLARTCSCSKVCSKQRGLLHNF

SEQ ID NO: 188179 - protein, 111 aa, Triticum aestivum
  unsure (1)..(111): unsure at all Xaa locations
  Clone ID: PAT_TA_82597.pep
MAPKVAVAKKGDXQAQAAKVAKAVKSGSIKKTAXKIRKSVTFXRPXTFXKARDPKYPXXXTPGRXXDXXKXXXYPLTIKXXIKKMXNNNTXXSTXNFKANKKKXKXPFKKI

SEQ ID NO: 188180 - protein, 127 aa, Triticum aestivum
  unsure (1)..(127): unsure at all Xaa locations
  Clone ID: PAT_TA_82598.pep
GPVXFPLLCXFXFKXXYAQXWSSXFFKNLAXYXYFWXXQRQXXYWIFKGXYVLIEIRWCKEMTDTSISNRSIRIVFFTILAPYLLHENASDAHQDHHQQKIFVALNSHACWMILRAPSHHHVLSCSQ

SEQ ID NO: 188181 - protein, 116 aa, Triticum aestivum
  unsure (1)..(116): unsure at all Xaa locations
  Clone ID: PAT_TA_82599.pep
MSCCGGNCGCGAGCKCGNGCGGCKMFPDVEATAGAAAMVMPTASHKGSSGGFEMAGGETGGCDCTTCKCGTXRAAAPAAAAXEPAPXRPAGKRRHXMRRRSKQSSSPSPPPSVQYH

SEQ ID NO: 188182 - protein, 55 aa, Triticum aestivum
  unsure (1)..(55): unsure at all Xaa locations
  Clone ID: PAT_TA_82600.pep
GEDARDEAPSDXPPXGAXHXXXAKGEXPRRRKTKVKXEAXALRRVGVGSMCVCVC

SEQ ID NO: 188183 - protein, 56 aa, Triticum aestivum
  Clone ID: PAT_TA_82601.pep
LFQNLVDRSGGGVGGDGAGGTIIGCEVVLFEHLLWMLENADPQPESLDELVEYYAC

SEQ ID NO: 188184 - protein, 89 aa, Triticum aestivum
  Clone ID: PAT_TA_82602.pep
NEGIYNATPVLNRYPHRRLSPFAPRISNRFSSALPGVHPPSLPGPRRIHHLGPRRSSFAHPSSMRSQVPASPRRSSQAPAPGRSSLIHD

SEQ ID NO: 188185 - protein, 186 aa, Triticum aestivum
  unsure (1)..(186): unsure at all Xaa locations
  Clone ID: PAT_TA_82603.pep
APRLPAPPTRQTRLPAPPPQAPVPTPNNGLCYKCGQPGHRARDCNQNQNQLALPATGRGSNQPRNNSAKSYGRVHDNHVDLNEXLDQPATMMGTLLXVNSVPASVLFXDSGASHSFMSEDFAYKHDVKCEEMNTSVLVKTRGTMSKSRVGIDVPVTKGWDSSLSHYPESSKLTHLGMVGNHTLVAH

SEQ ID NO: 188186 - protein, 89 aa, Triticum aestivum
  unsure (1)..(89): unsure at all Xaa locations
  Clone ID: PAT_TA_82604.pep
XFXLLXLFYFQFXALCXWKIQSXTFLESILFIESKNLSKFNICSXELKKSSRFSEEIHHIPKVFINLGKMFSNSKNVHEIKKILIEFKF

SEQ ID NO: 188187 - protein, 146 aa, Triticum aestivum
  unsure (1)..(146): unsure at all Xaa locations
  Clone ID: PAT_TA_82605.pep
MAPVKLYGATLSWNVTRCVAALEEAGVEYELVPINFGTGEHKSPDHLARNPFGXQVPALQDGDFVLFRITAICNYACRKEQXECLKEGDIKDSXMXVDXLVQVGGHPLHRRPDPILFXXLIHPMLWGTTDKKXXDETCLDLRGLFT

SEQ ID NO: 188188 - protein, 67 aa, Triticum aestivum
  Clone ID: PAT_TA_82606.pep
DVCPIPGTTKVDNFNQNVAALSVKLAPEEMAELESYASADVAGDRYHDFLNTWKDSETPPMSSWKAE

SEQ ID NO: 188189 - protein, 100 aa, Triticum aestivum
  Clone ID: PAT_TA_82607.pep
GTLFPVKRLGSGTGRAMFLGMYCSFTLSPDVFPPGSFSADTIYPSFDFAERRLLKVEAYHLTDGLLKAEAYHLADGRVEQPSSLVQRHILSLTIYPCQLR

SEQ ID NO: 188190 - protein, 94 aa, Triticum aestivum
  unsure (1)..(94): unsure at all Xaa locations
  Clone ID: PAT_TA_82608.pep
QDNPREIVXLTVYSCDLNFVPQVKFVNLPPNKAHGPKMQGTTGVCSVLVDHVRCCVLFDRAVASRQTCMGCGRTCGHITGVRPYSRDWVGIGIF

SEQ ID NO: 188191 - protein, 47 aa, Triticum aestivum
  Clone ID: PAT_TA_82609.pep
GVLKIFLENVIRDAVTYTEHARRKTVTAMDVVYALKRQGRTLYGFGG

SEQ ID NO: 188192 - protein, 59 aa, Triticum aestivum
  unsure (1)..(59): unsure at all Xaa locations
  Clone ID: PAT_TA_82610.pep
KYTFFDLNRLIHRIARPTEATLSILAHFSSPSHQSTPLRLSSSPFAAXLERLXGGKGGG

SEQ ID NO: 188193 - protein, 174 aa, Triticum aestivum
  unsure (1)..(174): unsure at all Xaa locations
  Clone ID: PAT_TA_82611.pep
ATHQLNSHHHPVRGRSRALVPPTPPLVKPAAFFSRWEGSQLAKRVSARPQGTRKRAQGTRRARSTTRPERRWQGRACRSLCLLLSSSWGSCCSSMSRYAGYGFGPSVTPASGLCFLLRXTESVCSRFSPLXCPGLWNFFSLSLHYTYLFEIEQSTIXILILLLPHGNIYQGIYN

SEQ ID NO: 188194 - protein, 102 aa, Triticum aestivum
  Clone ID: PAT_TA_82612.pep
SAKKKGIGLEGYSCLRARFVWIWESLLRPPPPIGPSPPSLHCSGAGPRHGLPVERFEDPARIKTAGIHCAGADPLLDLTLDRSRTWRQLQRRTRSALQVSHI

SEQ ID NO: 188195 - protein, 135 aa, Triticum aestivum
  unsure (1)..(135): unsure at all Xaa locations
  Clone ID: PAT_TA_82613.pep
MAPVKLYGATLSWNVTRCVAALEEAGVEYELVPINFGTGEHKSPDHLARNPFGQVPALXDGDCTLPITAICXYACRKEQXKLXLKEGDIKESTMVVCXSXVGGHXLHRRPDPFSSXCLIHLCLXGATDRXPTTLG

SEQ ID NO: 188196 - protein, 130 aa, Triticum aestivum
  unsure (1)..(130): unsure at all Xaa locations
  Clone ID: PAT_TA_82614.pep
GPAYCGGGCGSCGGGGGYGAWPPPMPTPLQMMQPPPMGCGGPASSCRGCKGCRLQGXEGSSTRSTRPVRAPSCDSQANDRSCMHACAVRLSASXFSWVRPMFKICXXFXCTXLXFLIQXPQQKGLLQXSK

SEQ ID NO: 188197 - protein, 117 aa, Triticum aestivum
  unsure (1)..(117): unsure at all Xaa locations
  Clone ID: PAT_TA_82615.pep
TDACDTGIGAVLVQDGHPVAYLSKALGVRNQRLSIYEKEFLAVMMAVEKWRPYLQLAPFVIVTDHKSLYHLGDQQLETEIQRKAMSKMVGLSFHSKYRRGXNNGAADALSRXXTCSQ

SEQ ID NO: 188198 - protein, 115 aa, Triticum aestivum
  unsure (1)..(115): unsure at all Xaa locations
  Clone ID: PAT_TA_82616.pep
MQSQNKIGFSDSQAGKKGPDGFVRRDNCHSYQPTMRLMGKTVSLCKGSMEQEVPTTGKWIDKNVIGDRPSSXSCQLPPKKVFPYQDSVIPRLVFMILQILCQSQHTFAKAKAYCQ

SEQ ID NO: 188199 - protein, 91 aa, Triticum aestivum
  unsure (1)..(91): unsure at all Xaa locations
  Clone ID: PAT_TA_82617.pep
TXGLXTGNPTSXGXFXXXXPFXLDPFVEXPSXRFLSTXNRRFSPFIYSPYKYPVQAITHALNPAAMPGHLTTRSHAHIGQPPHSALLNPTN

SEQ ID NO: 188200 - protein, 114 aa, Triticum aestivum
  unsure (1)..(114): unsure at all Xaa locations
  Clone ID: PAT_TA_82618.pep
NFLSLLLLICSTYQQLYVXYFFQFLFCFLHYFSCFXLYXXILFSFSFXKNYNFLLVPLVFKFGXSFFVFFVALFHFILFLLTIKYLLLLFLVFSQFFCFVFCINYFLLVFCFIF

SEQ ID NO: 188201 - protein, 147 aa, Triticum aestivum
  unsure (1)..(147): unsure at all Xaa locations
  Clone ID: PAT_TA_82619.pep
KQVKWYYVVIAYVVAPMLGFANSYGTGLTDINMGYNYGKIALFVFAGWAGKDNGVIAGLVAGTLVKQLVLISADLMQDFKTGXLTQTSPKXMMIAQXFGTXMGCITPPHFMLFYKHLILGTIXTWGGPYXXYTAIXXLGXEGSNVTE

SEQ ID NO: 188202 - protein, 95 aa, Triticum aestivum
  unsure (1)..(95): unsure at all Xaa locations
  Clone ID: PAT_TA_82620.pep
MTKRTKKAGIVGKYGTRYGASLRKQIKKMEVSQHSKYFCEFCGKFAVKRKAVGIWGCKDCGKVKAGGAYTMNTASAVTVKTXIRRLREQTEHIAL

SEQ ID NO: 188203 - protein, 107 aa, Triticum aestivum
  unsure (1)..(107): unsure at all Xaa locations
  Clone ID: PAT_TA_82621.pep
FRXNWXPGPPPWGXFFLQITTXYFPGKRXXKFQEMKKNRVPNGVELEASALPSRDKHNHRTAQTHAHNPAPATTPQETEQDHAKIKLLRLRGRSLPRSLVDDQTTTA

SEQ ID NO: 188204 - protein, 63 aa, Triticum aestivum
  Clone ID: PAT_TA_82622.pep
QVDTHKTSLLSQLIVNWGLCTVSYPLLAVLVLLAVKDEDYSVSNVDDGGKEKETKMAAPSSFH

SEQ ID NO: 188205 - protein, 84 aa, Triticum aestivum
  unsure (1)..(84): unsure at all Xaa locations
  Clone ID: PAT_TA_82623.pep
XXLPFGLGPPPGTHFAGXLXGSTQPAXNXPLGENLGXRXXXTQXXKXXXISXGPNWEXFXLSGVNXXXNGXXVXGNFNRGXSNP

SEQ ID NO: 188206 - protein, 57 aa, Triticum aestivum
  Clone ID: PAT_TA_82624.pep
NITGNPEVRVNKMGRAAGVLENHEEGRRYAEHGLRAYVQDKTPEIMPGINKFFTSPK

SEQ ID NO: 188207 - protein, 134 aa, Triticum aestivum
  Clone ID: PAT_TA_82625.pep
MAPKAAEKKPVEKTPAGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTRASQVHSA

SEQ ID NO: 188208 - protein, 58 aa, Triticum aestivum
  unsure (1)..(58): unsure at all Xaa locations
  Clone ID: PAT_TA_82626.pep
MSDILAVALGGAAGGLGISWCHHTXCSDMPTAPRKNSDLKRVILRQLFKHQGXHFDTG

SEQ ID NO: 188209 - protein, 85 aa, Triticum aestivum
  Clone ID: PAT_TA_82627.pep
KTVWHNAAQETTSVHTYTKNSWPKYFVSATCQCNCQDSSMESNVKLLHLLISRQDSAKTIFLSAVVSWLDVTCVEGQWQETLFVP

SEQ ID NO: 188210 - protein, 109 aa, Triticum aestivum
  unsure (1)..(109): unsure at all Xaa locations
  Clone ID: PAT_TA_82628.pep
CGFVQYANRPSAEQALQLLQGTLVGGQNVRLSWGRSPSNKQTQEASQWGAGAAAGAAGGYYAGYGQGYEAYGTRXYAQPQDPNMYGYGAYAGYPNYQQPAAAPPPPPQQ

SEQ ID NO: 188211 - protein, 115 aa, Triticum aestivum
  Clone ID: PAT_TA_82629.pep
GTCDFSGAASIVYQQPAGICDPKTAGSWCVANAAVGDTRLQTALDYACGHGADCSAIQRGARCFDPDTKVAHASYAFNDYYQHNGRSANSCNFNGAGSIVYQQPKIGNCVLPSTG

SEQ ID NO: 188212 - protein, 140 aa, Triticum aestivum
  unsure (1)..(140): unsure at all Xaa locations
  Clone ID: PAT_TA_82630.pep
AKLDRAVLAMKLVMCLCIFIVLVITASPIAVSGDRPLMLGRRCLQDAVVIGGSPTPTGASTTGTLPRDAEPDISVDRSKRLSPGGSNPQHHXSHHRDQXHACLSDGVICQHSLSTSQTRXLTTVNAVRRLILSFSLLXCS

SEQ ID NO: 188213 - protein, 174 aa, Triticum aestivum
  unsure (1)..(174): unsure at all Xaa locations
  Clone ID: PAT_TA_82631.pep
LVGGAIVGAAVVAWRRRGDGKGAKKDRRGKEDDVLDGGVVENEQKSDQSDENLSMEVREVEADGLDGKEAEELHEIQEQVDEIVADELDSEPTDNFDPNASKERAEIVNDTDSEDEKNPDQNSVNSCVENEIAPNANQGVKNLMKALLHQQPGGRHEEHIGQXMTIXRDASTQX

SEQ ID NO: 188214 - protein, 77 aa, Triticum aestivum
  Clone ID: PAT_TA_82632.pep
QGVKKRQKRRKDGNKGTIQLNFKRKFLMHMPEKANKDGIIPFRLGLSDRILTSYYPLYLAFIHRKMSSRRKLKKRKK

SEQ ID NO: 188215 - protein, 64 aa, Triticum aestivum
  Clone ID: PAT_TA_82633.pep
GSIPAQVATLAGLQQFNVSFNRLCGAVPTGGNMSRFDRYSYLHNKCLCGTPLTACRQRPVGYLH

SEQ ID NO: 188216 - protein, 151 aa, Triticum aestivum
  unsure (1)..(151): unsure at all Xaa locations
  Clone ID: PAT_TA_82634.pep
MAPKVAVAKKGDAKAQAAKVAKAVKSGSIKKTAKKIRTSVTFHRXKTLSKARDPKYPRISTPXRNKLDXYQILKYPLTTXSAMXXIEDNNTLVFIVHLXADXKXIKAAFQKITTFRXQEVNNLIKPDXXEKAYVKLTPXXXLLIGHKIXSN

SEQ ID NO: 188217 - protein, 101 aa, Triticum aestivum
  Clone ID: PAT_TA_82635.pep
PEEQRVSPQPTELFENIYFEIPSGMIEKLLANPFAGDGTLHPDLHLIFVDEVCGLFKLAAIPGDVVKRKVFPLSLKGDALTWYRLCDDTRSWNYKRLKLEF

SEQ ID NO: 188218 - protein, 158 aa, Triticum aestivum
  unsure (1)..(158): unsure at all Xaa locations
  Clone ID: PAT_TA_82636.pep
QRLIFAGKQLEDGRTLADYNIQKESTLHLVLRLRGGMQIFVKTLTGKTITLEVESSDTIDNVKAKIQDKEGIPPDQQRLIFAXGKQLEDGRTLADYNIQKDPPSTWVLRLRWWPIAWPWSCLCLWGHRVAFPVSSDWIVSVPRAWCFVATVLWANVIT

SEQ ID NO: 188219 - protein, 133 aa, Triticum aestivum
  unsure (1)..(133): unsure at all Xaa locations
  Clone ID: PAT_TA_82637.pep
RALLILHFLTKKHILCVTHILWGCRFSVRKPAGSISLCFCECSEPLCHFLAAEPSDSALRRKNGGTPPIYFANSGNTRERITRTDNAKGKTGVQYILLDMGAXINSIVRRGCWTTQETWTGGDSTNVGKIYIH

SEQ ID NO: 188220 - protein, 47 aa, Triticum aestivum
  Clone ID: PAT_TA_82638.pep
TNLFWSKTFCGGAIPCNLSYEASYTFYKNQLMALLNAKQCIKKLKEK

SEQ ID NO: 188221 - protein, 116 aa, Triticum aestivum
  unsure (1)..(116): unsure at all Xaa locations
  Clone ID: PAT_TA_82639.pep
CCTEWXLXGDERDRSRTATSLTLNATSLNFLQPFVGLANGVLDPRSFCRLPLFAAQSQSMVLKRGTSTTMALNGLGWRRWTSCMRRRRSSIGKEAEWWREEHHRLPEGGARDMTAG

SEQ ID NO: 188222 - protein, 60 aa, Triticum aestivum; identical to SEQ ID NO: 134016
  Clone ID: PAT_TA_82640.pep

SEQ ID NO: 188223 - protein, 103 aa, Triticum aestivum
  Clone ID: PAT_TA_82641.pep
DSKQHKQLTGQQVGSRPHKLLSHPCFVSSLTTSAPPTSKAPGDGKYNSTTQILLGNLRGHVSRLEEVAEIRALTQPHAPPPHGSKTQRKETTCRSGITWVLIF

SEQ ID NO: 188224 - protein, 53 aa, Triticum aestivum
  Clone ID: PAT_TA_82642.pep
MYKELYFCGHTCNALVLLLYGNISHSVVAAHCSDNPCMLQVRKALPGYLPTPS

SEQ ID NO: 188225 - protein, 90 aa, Triticum aestivum
  Clone ID: PAT_TA_82643.pep
FHGPACCRLVDSHARRTTNFTGGNIMSDNADALLLPGNHSSFCFFCLSGHDDTAGITLAIASADVMALQESLTRCGNLLCRHYRDPLPFM

SEQ ID NO: 188226 - protein, 125 aa, Triticum aestivum
  unsure (1)..(125): unsure at all Xaa locations
  Clone ID: PAT_TA_82644.pep
MARTKQTARKSTGGKAPRKQLATKAARKSAPATGGVKKPHRFRPGTVALREIRKYQKSTELLIRKLPFQRLVREXAKTXKNXLRLQESAXSALQEAAKAXLXGXFQXTNSVHQSQRGHIMPRDSV

SEQ ID NO: 188227 - protein, 85 aa, Triticum aestivum
  unsure (1)..(85): unsure at all Xaa locations
  Clone ID: PAT_TA_82645.pep
LEELKGGLEWPLSVYGVVAARDSVDHSRNLLFSCDRWRSQKLSQDDPFLRLIGPSXRAIVFTDDVYFETELRVKGKTLSQRYSID

SEQ ID NO: 188228 - protein, 154 aa, Triticum aestivum
  unsure (1)..(154): unsure at all Xaa locations
  Clone ID: PAT_TA_82646.pep
EVPPLPKVELPPFPEVHLPPKPELPKVELPPVPEVHLPPKPKLPKVELPPVPEVHMPPKPELPKVELPSVPEVHLPPKPELPKVELPTFPGGHMPPKPEMPKVELPPKPKSTVPVFQVPXSPXPSPXXWLNHNGALVLLPPVPMCCVPMNGVSL

SEQ ID NO: 188229 - protein, 44 aa, Triticum aestivum
  Clone ID: PAT_TA_82647.pep
RIINPEALGLGVLTVSVSLLFQIEGTLFVYLCRAFCHAVAFMCV

SEQ ID NO: 188230 - protein, 91 aa, Triticum aestivum
  unsure (1)..(91): unsure at all Xaa locations
  Clone ID: PAT_TA_82648.pep
LQLTDLIYIIVTTDKIQKRGNNSPTFYSPLVPRMNFNYVPPSPNLTDHTTSCPIPYILQQASSRIICYNKHGDSTQXKSVNNLFNKKLGEL

SEQ ID NO: 188231 - protein, 84 aa, Triticum aestivum
  unsure (1)..(84): unsure at all Xaa locations
  Clone ID: PAT_TA_82649.pep
PERFANGISKAGASADAPAFFPFGWGQRTCVGQSFAMLEAKMGIAMILQRFSFELSPSYTHAPFPIGLLHPXEHGAQLMLTRLP

SEQ ID NO: 188232 - protein, 126 aa, Triticum aestivum
  unsure (1)..(126): unsure at all Xaa locations
  Clone ID: PAT_TA_82650.pep
MVVAMMPEAVPPLKAVLKDTGVDANDDMMMIGAVKPPKEHAFVAAHQFRWLLSQVNYPKLGDLCWLVIPCALIIGSPDVKEQGMISFMHIAKNVXSNRIICMKDAILDACCQKSLQMMIEVFQCCS

SEQ ID NO: 188233 - protein, 159 aa, Triticum aestivum
  unsure (1)..(159): unsure at all Xaa locations
  Clone ID: PAT_TA_82651.pep
FFFFFKSWADYFGKLIHPYQYVHTRTATALANEFISHAGTVKSTKMDRHCSMRWTLPRLYAMYRRSRQWNSAHFYYCIYKDPTAGNSRASEVLSVYSDKSCKHFSYLLRHIPVHHLPDVGQVSGSLLVLQVVPSPKTSIPNKGCSLTFGHKXAWIRVXN

SEQ ID NO: 188234 - protein, 59 aa, Triticum aestivum
  Clone ID: PAT_TA_82652.pep
NNAAAASLQSAGGEKERLLANERYLSEIMKEKASTARDRRRGRVAVWRPHLESITEDDL

SEQ ID NO: 188235 - protein, 76 aa, Triticum aestivum
  unsure (1)..(76): unsure at all Xaa locations
  Clone ID: PAT_TA_82653.pep
HHFESKADSGASKTYPQXQAGAIRKXGHIVXKXRPXKVCLRSPPXKTGKQGXAKCHFFSLDIPLWKRLRISFLPNF

SEQ ID NO: 188236 - protein, 118 aa, Triticum aestivum
  unsure (1)..(118): unsure at all Xaa locations
  Clone ID: PAT_TA_82654.pep
GRAGRTETAMDVQSATTKDPSAEAHRSEWAAAAPVLARQSLCSGRRANAGGTKGGLGKARGRSGGCTPAAAGRISGLTKRRPVYAPCTSKXCLCLHYPVVYKFIYIYEMYTVYAYLTN

SEQ ID NO: 188237 - protein, 124 aa, Triticum aestivum
  Clone ID: PAT_TA_82655.pep
KAEKTTAAKKTKAEKRPPASKEGGEKKGKKKSKKSVETYKIYIFKVLKQVHPDIGISSKAMSIMNSFINDIFEKLAGESAKLARYNKKPTITSREIQTSVRLVLPGESPSILSEGPSCHNSLLL

SEQ ID NO: 188238 - protein, 100 aa, Triticum aestivum
  unsure (1)..(100): unsure at all Xaa locations
  Clone ID: PAT_TA_82656.pep
KYQKSTELLIRKLPFQRLVREIAQDFKTDLRFQSSAVSALQEAAESYLVGLFEDTNLCAIHAKRVTIMPKDIQLARRIRXREGLSLCVVLCPRLNQCVQR

SEQ ID NO: 188239 - protein, 165 aa, Triticum aestivum
  unsure (1)..(165): unsure at all Xaa locations
  Clone ID: PAT_TA_82657.pep
LSGDELLSDSFPYRELENGVLWEVDGHWVVQGAVDVDIGANPSAEGGGDDEGVDDQAVKVVDIVDTFRLQEQPAFDKKXFISHMKRYIKEXLLPSXEGDDLRCFSKKMFXPXQXSSLTXXXDFIPWFGESMHDDGACVRLHKGGTADXTSLXXAHGLKEXXANPR

SEQ ID NO: 188240 - protein, 134 aa, Triticum aestivum
  unsure (1)..(134): unsure at all Xaa locations
  Clone ID: PAT_TA_82658.pep
IFWKNLKPISEGGGEPPHGKLGWAIDEDFGSIEKLIKKMNAEGAALQGSGWVWLALDKEAKKLSVETTPNQDPLVTKGSNLYLWLXGIDVWXEHAYYLQXYRTXRPDYLTNIWKVXVNWEYPGEEYEKXLPDLS

SEQ ID NO: 188241 - protein, 101 aa, Triticum aestivum
  unsure (1)..(101): unsure at all Xaa locations
  Clone ID: PAT_TA_82659.pep
LHQPLPRSPASTRSIFYVASKDDETPGPSCTRLQSLRRGGIEIKVLCILNVQLGMALGHTHSPSDEQSTLGVLLYFLQQYYLHLVWCRRGNSDXRSTACSE

SEQ ID NO: 188242 - protein, 62 aa, Triticum aestivum
  unsure (1)..(62): unsure at all Xaa locations
  Clone ID: PAT_TA_82660.pep
ATCKHAEIPWHMHVSGFSITSTCLHAKHAPVSMXVIEXLSPIXSXKGKXYPICTLXIGGNFP

SEQ ID NO: 188243 - protein, 99 aa, Triticum aestivum
  Clone ID: PAT_TA_82661.pep
VEELHKSSGAANDAPHLWKEPEVVFLHMESFLHSYLSMFRIHCDLNEAKRVGLHHLDSPSTVVRCREFSPFMIFRASVSSKCEMIFRMQPGHHLLIKLK

SEQ ID NO: 188244 - protein, 96 aa, Triticum aestivum
  Clone ID: PAT_TA_82662.pep
VRVGASGDGGLRRRRHDGAQHLHQGDEEAPFGTSHATHLILGVWCLSSTLATLRCMHSGSRGLSSSSVVCACVMGDSVPAIMPTDELVVAISRSRL

SEQ ID NO: 188245 - protein, 132 aa, Triticum aestivum
  unsure (1)..(132): unsure at all Xaa locations
  Clone ID: PAT_TA_82663.pep
FIQVSNSFLPEIVHDEVILRSSVSSFLSGVPSSLGYIIAKLHLNHCKASPCVSNFSFFLSSFYYRSSSWKIYMMXHQGFFSXFNCSSRFLLKLRSAKLYSKLNMVLNTCFXFEEFKYSSXCIPKCNPFYLXF

SEQ ID NO: 188246 - protein, 171 aa, Triticum aestivum
  Clone ID: PAT_TA_82664.pep
LPFDITYKPRRAIKSQVLADFVAEWIEAELPKEYCTYSNWIMHFNGSKMLVGLGAGVVLTSPIGDTVQYVLQILYTDSNNAAEYEALLHGLWMAVSMGIQRLEVHGDSNLAISQINGDFDAKDPKMAAYRNVVLKMSARFEGLEFHHVVRENNQAADILARIGGKRDSVHL

SEQ ID NO: 188247 - protein, 36 aa, Triticum aestivum
  Clone ID: PAT_TA_82665.pep
SIYYVTSRYDLDKLIHLQKDKFTNLMLDPLLLLQIT

SEQ ID NO: 188248 - protein, 139 aa, Triticum aestivum
  Clone ID: PAT_TA_82666.pep
RSLSNATSLELIADAEEVILNRELEMCPVFSNLKVLSLGEWCMAADLHPLVLFLQHAPNLERLFLKLKTEHEEIDDDIKPEGTSFACKNLTMVNIKCPMDDERVPVLEQFFVANGIAMEKISVYHRPTHQPRLSLAIRR

SEQ ID NO: 188249 - protein, 199 aa, Triticum aestivum
  unsure (1)..(199): unsure at all Xaa locations
  Clone ID: PAT_TA_82667.pep
MEVASLYRRVLPSPPAVEFASAEGKRLFAEALQGGTMEGFFNLISYFQTQSEPAFCGLASLSVVLNALAIDXVQSFRADQTTIHDFRAHLTRCASSQDCHLISSYHRSPFKQTGTGHFSPIGGYHAEKDMALILDVARFKYPPHWVPLTLLWDAMNTTDEATGLLRGFMLVSRRSSAPSLLYTVSCGHGSWKSMAKYCV

SEQ ID NO: 188250 - protein, 173 aa, Triticum aestivum
  unsure (1)..(173): unsure at all Xaa locations
  Clone ID: PAT_TA_82668.pep
GRTFETYVFSLFDENQKPGPVAXXFGIFNTDLTPKYDLGLLRQGPQSGSPTPSPEPSPSVGGGKWCVAKSGARXTDLQNNINYACAYVDCRPIQSGGACLDPNNIHSHASYVMNAYYQANGMHDYDCDFKGTGVVTSSDPVTGAQIQSLTARKSSWTTELSQMSQLRSAWHVG

SEQ ID NO: 188251 - protein, 84 aa, Triticum aestivum
  unsure (1)..(84): unsure at all Xaa locations
  Clone ID: PAT_TA_82669.pep
MADIALLVADXFEKTARRGAPGGDSGSSSXSGGETRNFXAVAXVWSSWVESASAAASGVXFTVXVQLEPKTGLXLAAADGLXSX

SEQ ID NO: 188252 - protein, 86 aa, Triticum aestivum
  unsure (1)..(86): unsure at all Xaa locations
  Clone ID: PAT_TA_82670.pep
MXEEKKQGLXLXDFWVSPFXQXCXIALDEKGLAYEYXEQDLRNXXELLLXXXPXHRKXPVXXQXXPVCKSLXIXQYLDGXVPXXGR

SEQ ID NO: 188253 - protein, 66 aa, Triticum aestivum
  unsure (1)..(66): unsure at all Xaa locations
  Clone ID: PAT_TA_82671.pep
RXATTPPPPCGPLICLGAQQXXSQRRRXRPRRLXTAXXHGXAAGXGXSXVAXGPGXSLLHTXXKNR

SEQ ID NO: 188254 - protein, 59 aa, Triticum aestivum
  unsure (1)..(59): unsure at all Xaa locations
  Clone ID: PAT_TA_82672.pep
EAXIVXYYHCSPVYLIXSISSXACNSXXRYMLXXXHXKXGHAXXNDVGLCICXPAXMDA

SEQ ID NO: 188255 - protein, 115 aa, Triticum aestivum
  Clone ID: PAT_TA_82673.pep
ASDQLRGARQILCCLTGMKGGCLHRLLVHKLCFGLSVLTVPIIVLLLEGAPVLTIFSPTPGQLKDLSQGFLHQQEQEHLGDDGATLVGSPGPLPGAACKKVGAKDEKLHYARGSG

SEQ ID NO: 188256 - protein, 155 aa, Triticum aestivum
  unsure (1)..(155): unsure at all Xaa locations
  Clone ID: PAT_TA_82674.pep
MAASAAAATRLSGGGVALLLLALLAAGTSTSSAXXSTGFYSHSCPGVHDAVRSVLQAAIAREQRMGASILRLFFHDCFVQGCDASLLLDDTXQFQGEKMAKLTTVRQRFEXIDAIKSAVDKAXXGRLAESSAAGQRTWSRTGLTCRGSGRSRKIR

SEQ ID NO: 188257 - protein, 95 aa, Triticum aestivum
  unsure (1)..(95): unsure at all Xaa locations
  Clone ID: PAT_TA_82675.pep
NKENTLXSPFXGLAVHPXDGIXQAISHVXALFLLPXHFRXHIALXFRXAXWTANIHDCIHGKXWPVXGXGDHTSHHTTYRHNXXXYTVWXDWXXG

SEQ ID NO: 188258 - protein, 139 aa, Triticum aestivum
  unsure (1)..(139): unsure at all Xaa locations
  Clone ID: PAT_TA_82676.pep
QKLPEQTTTYPRQGSHVLXILLAAGTIQREXNQATEQKXQAGEVDTRDIFLLIFASKKAQDSHPALSTSLFLIPFPRDPCALACLPAVIFKPRLSAPYVEQIVAKLRGLHXDAQPIGFVYPLSVSLIAEQVQNLYEETK

SEQ ID NO: 188259 - protein, 140 aa, Triticum aestivum
  unsure (1)..(140): unsure at all Xaa locations
  Clone ID: PAT_TA_82677.pep
LALTGARLNAKEMISAGXATHFVSSEKLEELEKRLLDLDTGXESAVRAVIEEFSTDVQTDEDSILNKLSTINKCFSAETVEDXIKAXESEASIXGNQWIAPVLKGXXKSSPTALKITLRXIREGXXQSLPEXVTKDLXLQ

SEQ ID NO: 188260 - protein, 49 aa, Triticum aestivum
  unsure (1)..(49): unsure at all Xaa locations
  Clone ID: PAT_TA_82678.pep
KAVVWEEDTLYEYLLNPKKYIPGTKMVFPGLXKPQERADLIAYLKEATA

SEQ ID NO: 188261 - protein, 132 aa, Triticum aestivum
  unsure (1)..(132): unsure at all Xaa locations
  Clone ID: PAT_TA_82679.pep
GCVLLGGGAGRRRHGGGEEAAGVSDVGAWAMNVVSSVSLIMANKQLMSSSGYXFAFATTLTGFHFTVTALVGWISNATGYSVSKHVPLWXLVWFSLVANTSIXGMNLSLMXNSVXLPDLRFGGCYEWCNRTH

SEQ ID NO: 188262 - protein, 131 aa, Triticum aestivum
  unsure (1)..(131): unsure at all Xaa locations
  Clone ID: PAT_TA_82680.pep
ESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESXDTIDNVKAKIQDKEGIPPXQQR

SEQ ID NO: 188263 - protein, 108 aa, Triticum aestivum
  unsure (1)..(108): unsure at all Xaa locations
  Clone ID: PAT_TA_82681.pep
MSRTLKHSSEHIDEMLKXDGTLIFPTGRXIGVYFSEELKXAXSIXYKVYPICGYLFDIMESLFKDFVNDIYRRRLEAKARGEKALDFINKTTMXSLXGRFGINPESTT

SEQ ID NO: 188264 - protein, 82 aa, Triticum aestivum
  unsure (1)..(82): unsure at all Xaa locations
  Clone ID: PAT_TA_82682.pep
MAGGKSTGNAARTGXRVXATVLKRSXDGSAFTXCEAXNKDXPVVLIDMHXCSLDEKIXMTLEAQVVXNVGQCRPVLRQGWYQ

SEQ ID NO: 188265 - protein, 109 aa, Triticum aestivum
  unsure (1)..(109): unsure at all Xaa locations
  Clone ID: PAT_TA_82683.pep
DXGXARIEVKTXGMXPETGTYRXIAPXMIQHRPYDHKVXXYSFGIXXWEXMTXMXPFTNXTXDQAXFAVXNXNXRPAIPQXCXPALXHIMTRXWDXNPEXXPSFNXVVP

SEQ ID NO: 188266 - protein, 124 aa, Triticum aestivum
  unsure (1)..(124): unsure at all Xaa locations
  Clone ID: PAT_TA_82684.pep
SCQENSCERYXYDPTWQGRLLETYDTQDDVFQIAXACWMPDWADIASSLNQLSDSEXPXAVSTLQRRTAXFVEXEXRIGNTXSXTRXGRDVPKXQARVSXGNXGSWQXLXSXKGXMXVYRGLQT

SEQ ID NO: 188267 - protein, 85 aa, Triticum aestivum
  unsure (1)..(85): unsure at all Xaa locations
  Clone ID: PAT_TA_82685.pep
SLKSIWCILWRNTRTRNEAVTSXNHMQEENLHKGSPQINGVFEYVCHKQSLDKEIFYKQLFSKKSIMLGRTEHRLKIKTLSMKAT

SEQ ID NO: 188268 - protein, 125 aa, Triticum aestivum
  Clone ID: PAT_TA_82686.pep
MAGNFEEVAKQFVEFYYNTFDSDRKGLAALYRDHSMLTFESASVLGTQAITEKLAGLPFEKVKHQVSTLDAQPSNDQGGVIILITGALLVDEEQRPMNFSQSFQLARDANGQYFVYNDIFKLVFG

SEQ ID NO: 188269 - protein, 70 aa, Triticum aestivum; identical to SEQ ID NO: 126007
  Clone ID: PAT_TA_82687.pep

SEQ ID NO: 188270 - protein, 51 aa, Triticum aestivum
  Clone ID: PAT_TA_82688.pep
FPFPYLEISSFTLSFLNKLRHEPSFFSFLQAHYQNNCICRGPHLCRRLPSA

SEQ ID NO: 188271 - protein, 97 aa, Triticum aestivum
  unsure (1)..(97): unsure at all Xaa locations
  Clone ID: PAT_TA_82689.pep
LIILATKKAKTSISSRKTQVHEPTPKWTDTNAERSIQLHAARKLSGFHRCRIRTQSHRHHQSRLAIXRHRXRPPPAPISXRVTEXPGPXAAGLXLXF

SEQ ID NO: 188272 - protein, 85 aa, Triticum aestivum
  unsure (1)..(85): unsure at all Xaa locations
  Clone ID: PAT_TA_82690.pep
ASGASRFEERAXYRPHRDRPDDWTQFRQETTIRCRPLAALAAVAEKVEXRCAERFLQNSAKGREVVERICRYLEAESAGAAPSVT

SEQ ID NO: 188273 - protein, 42 aa, Triticum aestivum
  Clone ID: PAT_TA_82691.pep
SAAAAPGPPCPIMLCMFVFCWSLKLMSYGVSEPMLSGGSDTP

SEQ ID NO: 188274 - protein, 91 aa, Triticum aestivum
  unsure (1)..(91): unsure at all Xaa locations
  Clone ID: PAT_TA_82692.pep
TVALREIRKYQKSTELLIRKLPFQRLVREIAQDFKTDLRFQSSAVSALQEAAEAYLVGLFEDTNLCAIHAKRVTIMPKDIQLARRIXGERA

SEQ ID NO: 188275 - protein, 174 aa, Triticum aestivum
  unsure (1)..(174): unsure at all Xaa locations
  Clone ID: PAT_TA_82693.pep
LTECSFLSSPTPSQVPSPPKLPNHEKKAGNGLVIVAVAGSFVIFLLAAVMFTMCISKRKEKKDEAGYNGKVTDGGRVEKRKEDLSSGVQMAHKNKLVFLEGCSYNFDLEDLLRASAEVLGKGSYGTAYKAILEDGSTVVVKRLKDVVAGKKEFEQQMEXIGRVGKHANIAPIRA

SEQ ID NO: 188276 - protein, 55 aa, Triticum aestivum
  unsure (1)..(55): unsure at all Xaa locations
  Clone ID: PAT_TA_82694.pep
SXIHRISLEPNSQIXVEXEFTDQXRXEFXDQLEPNSPIRXRANTPISLEXNSPIX

SEQ ID NO: 188277 - protein, 175 aa, Triticum aestivum
  unsure (1)..(175): unsure at all Xaa locations
  Clone ID: PAT_TA_82695.pep
CDRLASVGFTTNLISYLTLQLHLPLVEASNIITNYNGTANLTPLIGGLIADSFAGRFWTITFGSIIYQLGMVCLTLSAALPSLHPPSCAKHAADCQRASSYQISVLYLSLLCTSIGTGGTRPCTMAFGAXQLELKRAXXPGRKPKWSFFNLYFFAVELREVXRAVTAVVYIQDKV

SEQ ID NO: 188278 - protein, 153 aa, Triticum aestivum
  unsure (1)..(153): unsure at all Xaa locations
  Clone ID: PAT_TA_82696.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKFAVLQFYKVDDATGKVTRLXAKSCPNTECGAGVFXANHFDRHYCGKLRLNLXYN

SEQ ID NO: 188279 - protein, 174 aa, Triticum aestivum
  unsure (1)..(174): unsure at all Xaa locations
  Clone ID: PAT_TA_82697.pep
LLLLSSHLTTHRSPSKIARRPWRTKPSSAGAKTAAAPPVTVHSALVTYTSMLALLSLCPPFVILLWYTMVHADGSVVRTYEHLRDHGVLEGLKAIWPMPTLVAWKIIFGFGLFEAVLQLLLPGKRFEGPISPAGNVPVYKANGLQAYAVNLXTYLGLWWFGIFXPAIVYDHFGE

SEQ ID NO: 188280 - protein, 147 aa, Triticum aestivum
  unsure (1)..(147): unsure at all Xaa locations
  Clone ID: PAT_TA_82698.pep
QGAAAVHXLDKVEKDWSHGAXGQLHLHAGTPIRPVYTCXRVLAWWISASSALRDPRRDRGLPPWNMTPSRTQNEAPLPLPPPPAIPSSQAYKKHTETWARRTRGGLELKKQRASKSKARRRPTRKETRDATQAALVWVCGEVVLGEG

SEQ ID NO: 188281 - protein, 131 aa, Triticum aestivum
  unsure (1)..(131): unsure at all Xaa locations
  Clone ID: PAT_TA_82699.pep
MLGSKASLLLSCLALLSPASCRAIEERAVADHAVTFQTIYKPPSNYNTPKTLYGRNVQLADGTILATWENYSPEPPMVYFPIYQSKDKGSTWAPLSNVTDTKNGWGLRTSXFLYVLPQAIGTRKGTISLWK

SEQ ID NO: 188282 - protein, 83 aa, Triticum aestivum
  Clone ID: PAT_TA_82700.pep
PSMIGEPADPFATPLEILPEWYFFPVFQILRTVPNKLLGVLLMVSVPTGLLTVPFLENVNKFQNPFRRPVATTVFLIGTVVAL

SEQ ID NO: 188283 - protein, 166 aa, Triticum aestivum
  unsure (1)..(166): unsure at all Xaa locations
  Clone ID: PAT_TA_82701.pep
LNXQKTTVXXXVNPAKPNRRFEPQRXXXTDANXXDRTSRPPXTSXAHQTRTSGPSLGNPASTTEDIQKFYPPTLTSSPQPGHPXPPEAPDIRXVARTSGHPCLRTVRAEARVPLRPXRLYILFLHHLSRVSKGLAHLEIELCSSISDLLHERERAPSTETIHLGFK

SEQ ID NO: 188284 - protein, 92 aa, Triticum aestivum
  Clone ID: PAT_TA_82702.pep
LLNVNGHVHIKLSLSQTRAGAQEASFRMMTVFNCSQIIRCIKKKNPQKIGITRGNKDESMTGHDLVLLFLLLGSTHTLGFTETLKSVFLMET

SEQ ID NO: 188285 - protein, 130 aa, Triticum aestivum
  Clone ID: PAT_TA_82703.pep
LDLSVKDNSAKPPRRHSIQTKPGASPRPTPSGTVTPVSGVRSKRSESQGRFDTPTSEVSMSISRRKFSTLSSISYWMTQIRLAEAASKHSVSLGFFKLALESECEPLDRMREELKSYVARHGWRQNWRTS

SEQ ID NO: 188286 - protein, 69 aa, Triticum aestivum
  unsure (1)..(69): unsure at all Xaa locations
  Clone ID: PAT_TA_82704.pep
LSRDAHNFWSMYDRGFYTDLSHWYRNRSSISLCCPLSCSWPLLYQLIICLLHFPVLMLLXPAPXRXPGG

SEQ ID NO: 188287 - protein, 161 aa, Triticum aestivum
  unsure (1)..(161): unsure at all Xaa locations
  Clone ID: PAT_TA_82705.pep
HIQSNYIATIQAYTLSSTSTLAMCLPFSCCHRGDHDTKESEVESQPYYHYPSPVKEAHDGHRASATNDMPPVVEDNSKNGGGHTTGFSSHSDDGVVRGGETTITTEKIVAPPPLLQHRXVLGIWCXXTPQGTYVSVVVSHNMAWCRRCSXSRVQSXYVLCV

SEQ ID NO: 188288 - protein, 88 aa, Triticum aestivum
  unsure (1)..(88): unsure at all Xaa locations
  Clone ID: PAT_TA_82706.pep
MGEGAGDRVLSRLHSVRERIGDSLSAHPNELVAVFTRLKNLGKGMLQPHQXIAEYNNAIPEANARXSRMXFEDVLRESGGVSPMVCIA

SEQ ID NO: 188289 - protein, 80 aa, Triticum aestivum
  unsure (1)..(80): unsure at all Xaa locations
  Clone ID: PAT_TA_82707.pep
MATVPVNPKPFLNNLTGKPVIVKLKWGMEYKGYLAXVDSYMNLQLXNTEEYIDGQFSGNLGEILIXXXNVMYSRRSEDAE

SEQ ID NO: 188290 - protein, 47 aa, Triticum aestivum
  unsure (1)..(47): unsure at all Xaa locations
  Clone ID: PAT_TA_82708.pep
TPLASCHVGNPITYRAMLQRKTFSGQSDIFINYTLFGLQSSXMRCSK

SEQ ID NO: 188291 - protein, 56 aa, Triticum aestivum
  unsure (1)..(56): unsure at all Xaa locations
  Clone ID: PAT_TA_82709.pep
ITPRRFVYXIQRCLKPSGNGLEDGQGIRRSWNSTIAFTAACKLIGFMAPIGGVTID

SEQ ID NO: 188292 - protein, 76 aa, Triticum aestivum
  unsure (1)..(76): unsure at all Xaa locations
  Clone ID: PAT_TA_82710.pep
XXAPXVTXXPLHKXQQLXVVLXKKRGFCXMMTSCAXRYXDQPTIXPGIDLQXXFDLSIHTDIXLXTLHXXXFFVII

SEQ ID NO: 188293 - protein, 44 aa, Triticum aestivum
  unsure (1)..(44): unsure at all Xaa locations
  Clone ID: PAT_TA_82711.pep
ESEETRSXXXSRSSSXSSLVSXAXSKLSVXRXLFVSKKTGNGKA

SEQ ID NO: 188294 - protein, 103 aa, Triticum aestivum
  unsure (1)..(103): unsure at all Xaa locations
  Clone ID: PAT_TA_82712.pep
AXNNAXSXAGLXAPXXLRXPNGXXTRXXAXXRPPAAAILVMVVHPPERDXHLRGEDXDGGGEEFGGRXAQRGGVLGRSQVADGEPAPYCPDHIHGCQLMDRSI

SEQ ID NO: 188295 - protein, 118 aa, Triticum aestivum
  Clone ID: PAT_TA_82713.pep
SEWTGFSRAFNSPRQHQKSAILCPVGQASGKPKDKTKTTAAHAYCIGTACRKRDGTRRWYAGTCLPSVGPHTTDYTPSFVLNPDKRRAGGFKLGCKSRPLFSSPSRLKPKSPVLSRAG

SEQ ID NO: 188296 - protein, 117 aa, Triticum aestivum
  unsure (1)..(117): unsure at all Xaa locations
  Clone ID: PAT_TA_82714.pep
RWFKTSSRPSTXXTTAASQAVWXSRLLAEMLGTKVQKVKLHVXNRSAIELSKNPVHHERSKHIDLRYHYSKECVELGRVDIVHVRTGDQVADIFTKSLGRSRYVELQHKQVMGWHDR

SEQ ID NO: 188297 - protein, 132 aa, Triticum aestivum
  unsure (1)..(132): unsure at all Xaa locations
  Clone ID: PAT_TA_82715.pep
XVXREXXIFWGXLEMDGIDGNFDVAGPEKAAGPGESXTEGIMASSLPPINQERLPGSGSRSRAETPRPGINPSARLKSRQTTTAYGGAFREGFEARILDIWWVGRAGDYTARPLESEMGIRRSQGRGGVAVV

SEQ ID NO: 188298 - protein, 167 aa, Triticum aestivum
  unsure (1)..(167): unsure at all Xaa locations
  Clone ID: PAT_TA_82716.pep
KLGIKQKQLQSSRTVFHGIVPGLSCSPIGKIQIDVLFGDKDHFRREPVWFEVVDLESPYQALLGRPALAKFMAVPHYAYLKMKMPSSKGXLTMAGDYRKSSACAAENSRLAKSLVIALRAVLDRVVAWRQQQNVAHPKSRTGFKPKNKRFDTETREPCHRSTDTIGS

SEQ ID NO: 188299 - protein, 134 aa, Triticum aestivum
  unsure (1)..(134): unsure at all Xaa locations
  Clone ID: PAT_TA_82717.pep
VVAVGARTNTFNTPGVVENCHFLKEVEDAQKIRRSVMDCFERASLPFLNEEERKKNLHFVVVGGGPTGVEFAASLHDFVTEDLSKLYPSIQHLVKISLIEAADHILTMFDKRXTNFAEXKFGRDGIDVKLDIKL

SEQ ID NO: 188300 - protein, 103 aa, Triticum aestivum
  unsure (1)..(103): unsure at all Xaa locations
  Clone ID: PAT_TA_82718.pep
KGGNPSQLIPNPKPPIHPSPPHPLRAAMACSFAAATVVSSAPTPAASPSPLPRSPSLSPAPRSPPPPXAPPRRLQIRAGHQTRRPRRRVDLPLVGNKAQTKPR

SEQ ID NO: 188301 - protein, 59 aa, Triticum aestivum
  Clone ID: PAT_TA_82719.pep
FFFFGTKQRSGHIQRNSSVPGPDSLHNTYLMATTTLASVRCNTIQPTNCLLPTAQTTQS

SEQ ID NO: 188302 - protein, 96 aa, Triticum aestivum
  unsure (1)..(96): unsure at all Xaa locations
  Clone ID: PAT_TA_82720.pep
MASPIPREWVGLXXXPPXTQTELHELLGKLKEEDVSTLTILVMGKGGVGKSSTVNXIVGERIATVSXFQSEGXRPMMWSRQGXVHLNIIXTPGLLK

SEQ ID NO: 188303 - protein, 120 aa, Triticum aestivum
  unsure (1)..(120): unsure at all Xaa locations
  Clone ID: PAT_TA_82721.pep
WXQFXFXXKTXGGLSXPLXAAPXFFSKXGNIXLKAXGPKKXFXFXKKGFXPXKVNXXSKNFXYLSHEFNXLXVXLRLXSEFXMYXFXSREXSXDAILXXSFQNLXYAXSPRASSVVLVEX

SEQ ID NO: 188304 - protein, 63 aa, Triticum aestivum
  unsure (1)..(63): unsure at all Xaa locations
  Clone ID: PAT_TA_82722.pep
GITRLXXTDEXKXAYXKXXEQXNKQXXEEEEXSKGHDLLKGSFTILSTXEERRXYXWXXAXNP

SEQ ID NO: 188305 - protein, 126 aa, Triticum aestivum
  unsure (1)..(126): unsure at all Xaa locations
  Clone ID: PAT_TA_82723.pep
SDPAAGXWRAVPEAEAIDALPYIDGDYGDAAVKREVDRLVEEEMRRGKRKPADFLRDLPPVPTAGFENHPMLAKEYERVRAGKPPFMLDMSRXGLEPPPMNKRNDVGAWRQXYXECQSQLQHQIIR

SEQ ID NO: 188306 - protein, 98 aa, Triticum aestivum
  unsure (1)..(98): unsure at all Xaa locations
  Clone ID: PAT_TA_82724.pep
LPKDLDWRRVPGGEKKHEHQVVLRRGERGRARRRLPVAXAAVTNTSKTAFXMVVVIXDPXTEGPDLKSSKPFGXAKXTYVGAXKDELSLMMXMNFVFK

SEQ ID NO: 188307 - protein, 66 aa, Triticum aestivum
  Clone ID: PAT_TA_82725.pep
DNVSSHHSFGPQAAHPMCMSSAKQVSTRSEPTGNTSSTNPSKLTNDIKALKQNPTRMGEKLMCDDK

SEQ ID NO: 188308 - protein, 142 aa, Triticum aestivum
  unsure (1)..(142): unsure at all Xaa locations
  Clone ID: PAT_TA_82726.pep
QDVADSCRTGAATNVIFGLALGYKSVIIPIFAIAVSIYVSFSIAAMYGIAVAALGMLSTIATGLAIDAYGPISDNAGGIAEMAGMSHRIRERXDALDAAGNTTXSNSSSCVASSLVSLXVFGAFVSRTGVKVVDVSPQGFHG

SEQ ID NO: 188309 - protein, 120 aa, Triticum aestivum
  unsure (1)..(120): unsure at all Xaa locations
  Clone ID: PAT_TA_82727.pep
TPVELKNSSNGELWTLLLAAVVVLSLLVSPIAXTRKLNKPKPKPGSYRRPXKPKPKPVTGSYKPAPVAARRNHTATPTPSPTVYGKTTVLGQLPLKREYRQVDGVFLRVSGATGVENRRD

SEQ ID NO: 188310 - protein, 70 aa, Triticum aestivum
  unsure (1)..(70): unsure at all Xaa locations
  Clone ID: PAT_TA_82728.pep
RXSSSPTXARLTXGEWGXSXQGTVTHPPPLFXSISXFTDDLMYXXLLLXXCILXXLIKKXVSSXIXXSXS

SEQ ID NO: 188311 - protein, 109 aa, Triticum aestivum
  Clone ID: PAT_TA_82729.pep
RVALVPVFAVLAALAVAEMASGAVTCGDVTSAVAPCMSYATGKASAPSGACCSGVRTLNAKASTPADRKAACNCLKNLAGSGISMGNAANIPGKCGVSVSFPIRTKPTE

SEQ ID NO: 188312 - protein, 139 aa, Triticum aestivum
  unsure (1)..(139): unsure at all Xaa locations
  Clone ID: PAT_TA_82730.pep
HTRQATPRARARPATRERSVLVRSLAPRRRVGVPMSCAGQAGGWLLDYALVEXEIXGSEFIYMVDDPAVSSVILGFDAPRKEDGVRTTPXPRRDPXRSLARHPAPXXXEKLRETGXRKFNESVHLNRNHQXEKXYLRSA

SEQ ID NO: 188313 - protein, 115 aa, Triticum aestivum
  unsure (1)..(115): unsure at all Xaa locations
  Clone ID: PAT_TA_82731.pep
PCPAPSDANSQLRCSFRSSELRNRAKHPSLRRVKPSKLPRFIPFPPPIPRLSPQLRPSVSEAPPPTWPPSAPMALPYLEAXLCFMIFMYIFETYLDIRQHRASSANFAKTPAGSN

SEQ ID NO: 188314 - protein, 119 aa, Triticum aestivum
  unsure (1)..(119): unsure at all Xaa locations
  Clone ID: PAT_TA_82732.pep
XSRPLSELVMFTLXHFXCXFPXPAXSXCXRAAAXXRXHXEEERRESQRXXMAXSSRPLXWXXRRXLXPCXXKQLRXGSGPRXXXGXRXWVXGXGLXRQGSDVGGGAARSFVPXXQRAXA

SEQ ID NO: 188315 - protein, 121 aa, Triticum aestivum
  unsure (1)..(121): unsure at all Xaa locations
  Clone ID: PAT_TA_82733.pep
DALAKYFIGSVLSGGGSVPAPQASAQAWAAMVTEMQKGALSTRLGIPIIYGIDAVHGHNNVYKATIFPHNVGLGATRDPDLVKRIGEATALEVRATGIPYAFAPCIAVCRXPRWGRSMKLQ

SEQ ID NO: 188316 - protein, 116 aa, Triticum aestivum
  unsure (1)..(116): unsure at all Xaa locations
  Clone ID: PAT_TA_82734.pep
AFKPTNLSNCTQSAIHCRGRSNLLRASSMAXSDHGSNNGPXDVPGXYGLPLVGAVRXXLXFXXFXGXDKYSXPAWRXGSXVVRMXXPPGPXXAREPRLWRSGRFPCFLTSGEEDYD

SEQ ID NO: 188317 - protein, 90 aa, Triticum aestivum
  Clone ID: PAT_TA_82735.pep
NPSPYIVPEDMSLAKVYNLFRQLGLRHIFVVPRPSRVVGLITRKDLLLEEDNNNVMPELQSTSVRGLLNGKMLGGNIHLERPLLDNLVIE

SEQ ID NO: 188318 - protein, 136 aa, Triticum aestivum
  unsure (1)..(136): unsure at all Xaa locations
  Clone ID: PAT_TA_82736.pep
IAGIEAQMGVLHYILGNYGESYDSFKSAIAKLRTCGEKKSAFFGIALNQMGLACVQRYSINEAAELFEEARTVLEQEYGPYHPDTLGVYSNLAGTYDAMGRLDEAIEILEYVVGMREEXLGTANPDVDARTELWDY

SEQ ID NO: 188319 - protein, 94 aa, Triticum aestivum
  Clone ID: PAT_TA_82737.pep
LEAGKKADVVPDCATYSCVVGALCGAGRWSEAEDVFYAGVKRRKVADLGTVRVLVRGLKDAGKGRAARRVVVGLCKKFPEMFDGPWRDLRWRPG

SEQ ID NO: 188320 - protein, 130 aa, Triticum aestivum
  unsure (1)..(130): unsure at all Xaa locations
  Clone ID: PAT_TA_82738.pep
KKKXGQYLHLPSGASEXAEMARXCXGARGVRXAXGRRAAAXRXXGAXGRGRXRRGGPGVGGGAVGAVRXLARPPXLARELGDKARXSTSSRQXALITSSXAGRTYKXXXXFXNDXTVLXHYGVXVXQRFR

SEQ ID NO: 188321 - protein, 98 aa, Triticum aestivum
  unsure (1)..(98): unsure at all Xaa locations
  Clone ID: PAT_TA_82739.pep
RYFDEPDGDDPVVLDMSSMDKGMIFVNGEGVGRYWVSYRTLAGTPSQALYHIPRXFLNPRTTFVVFEEEMAAGCILVQTYERRHMSGDNRTVRRGMYK

SEQ ID NO: 188322 - protein, 80 aa, Triticum aestivum
  unsure (1)..(80): unsure at all Xaa locations
  Clone ID: PAT_TA_82740.pep
FFFFDRNQLCSFTCPGIICIETGTRGGMEVHLRARRRDGRRYILDTIQYKQREPEKKKKPKKTEEIKWKRYIYPAATAAX

SEQ ID NO: 188323 - protein, 134 aa, Triticum aestivum
  Clone ID: PAT_TA_82741.pep
MSGIIHKIEEKLHMGGDHKNKEEEHHKKAEEHHKKEEGEHHKKDGGEHKEGIVEKIKDKITGEHGDKSGDHKEKKDKKKKKHGEGHDHDGGHSSSSSDTTEFVTQNTCIFLVEVIPAVCVCYCVCMICFISKKK

SEQ ID NO: 188324 - protein, 49 aa, Triticum aestivum
  Clone ID: PAT_TA_82742.pep
LAPFPHFAFITCYFTETGDHDEFFGCLAAIYHDSLVPPACTQLNMELSR

SEQ ID NO: 188325 - protein, 153 aa, Triticum aestivum
  unsure (1)..(153): unsure at all Xaa locations
  Clone ID: PAT_TA_82743.pep
LARVLQSKAATYQSTHSAQWMERSLDDSACRRIDIPEMFLLADXXPITLQNVTEGLVVFPLKIHSNIMAELPFMITENIIMRLVAMGVSRQEAHEQIRVLSFEASHQVQSLGKXNDLVERIKKTEXFKPIWVIRWMMKRSVIGQVVGKFVDGW

SEQ ID NO: 188326 - protein, 128 aa, Triticum aestivum
  unsure (1)..(128): unsure at all Xaa locations
  Clone ID: PAT_TA_82744.pep
FEWFRGVMDEVAETDRKGVIELHNYCTSVYEEGDARSALIAMLQSLNHAKHGVDVVSGTRVKTHFARPNWRNVYKRIXNHQNQRVGVFYCGAPVLTKELRNXXDFSRKTNTKFEFHKENFSLSLSIYM

SEQ ID NO: 188327 - protein, 59 aa, Triticum aestivum
  Clone ID: PAT_TA_82745.pep
TQPYGKISMNLLIFAEAGASIETTTKPVDLSSPRTLPDLALRRLKPQIRVRQGMTAALG

SEQ ID NO: 188328 - protein, 92 aa, Triticum aestivum
  Clone ID: PAT_TA_82746.pep
ARAEFQAIINDPFMLNSVLLVFANKQDMRGAMTPMEVCEGLGLYDLTNRIWHIQGTCALKGDGLYEGLDWLATTLDEMRASGRLTSASSSAS

SEQ ID NO: 188329 - protein, 169 aa, Triticum aestivum
  unsure (1)..(169): unsure at all Xaa locations
  Clone ID: PAT_TA_82747.pep
GTLIDSLLRAHRYNDALTLFQDILHSGGTPSMPIYNSMMRSLCRMQKLSQAINLWFDHLPRKYNLLAQDEVISSARKKFEEGCLHEAVRELIKIDQEYGSVNSCPYTIWLIGXIQAGRIEDASRFFIYLRIRHCITPAVSLSNTLLKESGGYVLLRRICEIAPVLELDH

SEQ ID NO: 188330 - protein, 135 aa, Triticum aestivum
  unsure (1)..(135): unsure at all Xaa locations
  Clone ID: PAT_TA_82748.pep
YITRVPVDRRPSLRDDYSPRGSGYSDLGPRSAPRLSDRRAYADDSYGEKFDRPLVAYREGRGRDYDTISGSKRPYADMDDVPRYQEIGVRQSKARLDYDIGGSSARYGDTYSEXSGRPHAGYSSSRXIPVXDSXY

SEQ ID NO: 188331 - protein, 75 aa, Triticum aestivum
  Clone ID: PAT_TA_82749.pep
FFFFAVTYIYYKRCHTSKFYTPAPTETISSARECNALSSDIKTLSTIQRARSFLARSDIKTGGNSTIDANDDLLL

SEQ ID NO: 188332 - protein, 99 aa, Triticum aestivum
  unsure (1)..(99): unsure at all Xaa locations
  Clone ID: PAT_TA_82750.pep
ATHSSFRASQYYQFDTEHRSVRGNIRICSGDGSAXSWNVETXKGSCWESTDVKPPRVRWSPGSLMFVTGTSELSCWVPDLSKLESFTISHTNARSSSSL

SEQ ID NO: 188333 - protein, 137 aa, Triticum aestivum
  unsure (1)..(137): unsure at all Xaa locations
  Clone ID: PAT_TA_82751.pep
MAPKAEKKPAEKKPAEEKAEKKPRAEKRVPSKEGGEKKGKKKAKKSVETYKIYIFKVLKQVHPDIGISSKAMSIMNSFINDIFEXLAAEXQARRYNKKPXSLPGDSDSLSGSRKTRFEQSVQLIFRCARDVLILFRF

SEQ ID NO: 188334 - protein, 128 aa, Triticum aestivum
  unsure (1)..(128): unsure at all Xaa locations
  Clone ID: PAT_TA_82752.pep
MDLALLEKALLGLFAAAVVAIAVAKLTGKRYRLPPGPPGAPVVGNWLQVGDDLNHRNLMAMAXRFGDIFLLRMGVRNLVVVSTPELAKEVLHTQGVEFGXRTRNVVFDISREGEDMVSRLRRHWXNAI

SEQ ID NO: 188335 - protein, 143 aa, Triticum aestivum
  unsure (1)..(143): unsure at all Xaa locations
  Clone ID: PAT_TA_82753.pep
DPVPGLTXCRCGALFPRRHREKAALRWPXPXCXSSXSPAPTRXSSPXCAMRLRRGPSGLEGRAMVVVATGVFLLPLTILVQKSDDCLGALVAWSTDGVPRKPVHGRRGAADAAVHDSSHHLLAFLLPPXLVLTPTTSPWPRVG

SEQ ID NO: 188336 - protein, 71 aa, Triticum aestivum
  Clone ID: PAT_TA_82754.pep
TSICLYCVARHEISITTTNIRCSCTSITFSLLLFVVIQLQQLLSVHNFRNIIADFKDYIVESNTRYYEIGG

SEQ ID NO: 188337 - protein, 88 aa, Triticum aestivum
  Clone ID: PAT_TA_82755.pep
VTSAVISMTFLSLSKGITIGGSFFLYAGIAAVAWVFFFTCLPETRGRTLEEMGKLFGMPDTDDMAEAEDATAGKEKVAEVEMYMPSKM

SEQ ID NO: 188338 - protein, 103 aa, Triticum aestivum
  unsure (1)..(103): unsure at all Xaa locations
  Clone ID: PAT_TA_82756.pep
MEQDDCKWRQIPAFGDWNVWDGDXPVTQYFQAGAFFFXXPXEKGDXDLFKVPQLPAKPYGYKKCVVRVKGEKEPCAGGKGQALRDDNTEAGLWQFPSCRLLFL

SEQ ID NO: 188339 - protein, 80 aa, Triticum aestivum
  unsure (1)..(80): unsure at all Xaa locations
  Clone ID: PAT_TA_82757.pep
LDDTTSLDHVGSIFNCSEPTQSWLPPTQSSRPQQHVRQLEVSILLLHHYHPQNHPFPYHPFHQDTQAAYTHAPXPIXNWG

SEQ ID NO: 188340 - protein, 149 aa, Triticum aestivum
  unsure (1)..(149): unsure at all Xaa locations
  Clone ID: PAT_TA_82758.pep
ATYPSLLPFIFLEDFFGLTHLLLQSNSQTHTGNQLAEPAPPPFLGVGASRGTARLPLPFSFLSSPEDPIHHRGLAGKNQGYIDNIQTKVPPEPRGGKSPAVGGRNVGRRGLRTGVXAPGLRHSSWHRIXTSTHXSSFFGRRETGLCTFX

SEQ ID NO: 188341 - protein, 130 aa, Triticum aestivum
  unsure (1)..(130): unsure at all Xaa locations
  Clone ID: PAT_TA_82759.pep
NTAQSGEEVVADSHLLPAVAVGAKSGDAIRRYVESDANPEVALTFAGTALDVRPAPVVAAFSSRGPNRVVPQLLKPDVIGPGVNILAGWTGSSGRLGSADERXRFNILSGTSMSCRHQGWRVRGTGWSHA

SEQ ID NO: 188342 - protein, 68 aa, Triticum aestivum
  unsure (1)..(68): unsure at all Xaa locations
  Clone ID: PAT_TA_82760.pep
STXTVTRQEKTPGWMRXQLPVDVPKFQRLVALEEPFFLLLGGKWSWVIVRGWAEIYSIVSTVGSCIQL

SEQ ID NO: 188343 - protein, 104 aa, Triticum aestivum
  unsure (1)..(104): unsure at all Xaa locations
  Clone ID: PAT_TA_82761.pep
MWVEILCGLVVYKIIQRVFFAGXXDASYLADLDSSHSDLCFAVASRLEKLYAGRCFVGLRIPDPDAGERXXIDVVLVTKREVMVVXIKNLSGFVKLQGWKLFVH

SEQ ID NO: 188344 - protein, 132 aa, Triticum aestivum
  unsure (1)..(132): unsure at all Xaa locations
  Clone ID: PAT_TA_82762.pep
MHPNFPSDHGNGRGVGGGGGHSRRKRXHQLLGGGRAADILLWKDRNLSAGLLAGATLVWYLFEVVEYSIVPLVCQIAILAMLVVFIWSNAAXLEHTPPRIPEVIISEHASDKTVIHYKLDTPCLSLYIHRKI

SEQ ID NO: 188345 - protein, 162 aa, Triticum aestivum
  unsure (1)..(162): unsure at all Xaa locations
  Clone ID: PAT_TA_82763.pep
IHTKAMXRPPQNHAXRESVNPQMLTSAPRLRERTXTXVQNXSQQXGAWLQVVLTPDCMACRRCPRPKPWTSRNGLPRRMARCGFRRCEPSFIPLARSSLCASAIPFYVTDLMKNNSLMGKTCHWLTFVLLNVECNGCCNVESRCNYRSSMFHGLKFCTLMNS

SEQ ID NO: 188346 - protein, 154 aa, Triticum aestivum
  unsure (1)..(154): unsure at all Xaa locations
  Clone ID: PAT_TA_82764.pep
PNRPRQHASRHATSPQGPAXSAPSDAAVAAAAPASTTTAAASSGGLTFKLHPLVIVNVSXHXTRVKAQAACSGDSSSPSSSAPGAGQXAEGVRXRDRGAARPDRXDFNSSXSCSTPSPEPRXXLLDKKRXYKKXPDLRARITEGRSQILTKPVS

SEQ ID NO: 188347 - protein, 79 aa, Triticum aestivum
  Clone ID: PAT_TA_82765.pep
PCSRTTDSELIDFLSLVTGSTKELLSLLQISQSYSSSSESNIRFPVIGSPSSSSLNPINQSLAQTKASSVSGDSDVLFF

SEQ ID NO: 188348 - protein, 58 aa, Triticum aestivum
  Clone ID: PAT_TA_82766.pep
RNSYFLLTPMLYFTQVGTIISQSPTHFQEAHWVVCRSREFTGSYADLEFTVHADLRVS

SEQ ID NO: 188349 - protein, 109 aa, Triticum aestivum
  unsure (1)..(109): unsure at all Xaa locations
  Clone ID: PAT_TA_82767.pep
VXXQQQVQIFWCFXPXVLLCLYXFHPDLVSNRSMWPNHEWVFXLLXGIYLNFFKLGWSFPTLPXLSAXRGCSMGILDXIXXDLSXHNYYQASXLDGDICXGRXQDERXP

SEQ ID NO: 188350 - protein, 94 aa, Triticum aestivum
  unsure (1)..(94): unsure at all Xaa locations
  Clone ID: PAT_TA_82768.pep
AISILVXSLASQFSWCAEAAEGSAGISTEPDLQVQEQVHGDMKNRLEMQGRNRKLGHEVTTVELKHHRRITSGHKGGSXGGGAARCRGRRXGWA

SEQ ID NO: 188351 - protein, 125 aa, Triticum aestivum
  unsure (1)..(125): unsure at all Xaa locations
  Clone ID: PAT_TA_82769.pep
GSTFSRPPERSLAWFSRPPRPERSLSLLPWFSSPPSSALFLSLVASGNDVRCSGLVQALRRRRAHSKWIQELKLCSSSVLCSGVLQALPWMMLLLQGFQLWDITLSMKKSELCNFVXSCIEASSI

SEQ ID NO: 188352 - protein, 58 aa, Triticum aestivum
  Clone ID: PAT_TA_82770.pep
ETSLKDKYPREHLVFSDPKALHKQGWQALAETIMKQDVKVNLTRFRPFLLQAIDKLQE

SEQ ID NO: 188353 - protein, 153 aa, Triticum aestivum
  unsure (1)..(153): unsure at all Xaa locations
  Clone ID: PAT_TA_82771.pep
RXEETLASSGANFPPFNGXAGKAXRNLTLGLAFLGLPPNQQSPPGQXIRXSEVSELGRKPAVSXQRELXPSGPXKKXXXGPIMMXIGSLKEARGKLIKNIHEEMLYLREKGRRKCRNVKQAKRNFKGWLWLRGXLXPXGVCLISGXFCKLVGT

SEQ ID NO: 188354 - protein, 121 aa, Triticum aestivum
  unsure (1)..(121): unsure at all Xaa locations
  Clone ID: PAT_TA_82772.pep
ILVQTFSKHTNQSGGYGPQGYRPQGHGAASQLGPXSXNHGYGYPPRGMXXPQNYNAPYGGYPPQDPSRGGMGWXXRPGXPTHPSYQGGGSXYYKQGSQPYDSQPPXYPPGPGNYNSLXNPG

SEQ ID NO: 188355 - protein, 143 aa, Triticum aestivum
  unsure (1)..(143): unsure at all Xaa locations
  Clone ID: PAT_TA_82773.pep
SNPGVVPGAGSGALDALRHFHXFQALLQLVQANPQILQPMLQELGKQNPQILRLIQENQAEFLRLVNESPEGGPGGNILGQLAAAVPQTLTVTPEEREAIQRLEGMGFNRELVLEVFFACNKDEELTANYLLDHGHEFDEQQQ

SEQ ID NO: 188356 - protein, 186 aa, Triticum aestivum
  Clone ID: PAT_TA_82774.pep
SSWIYQITRLYKNKEHAEVEYTIGPIPVDDDVGKEVITQLTANMSTNSTFYTDSNGRDFLKRVRNYREDWNLQVTQPVAGNYYPVNLGVYIVDEKYELSVLVDRAAGASSIQDGQLEIMLHRRLLKDDGRGVAEPLDEVVCVDQDCQGLTARGTYYINVEKLGHGAHWRRTYGPASLLSLSPCFYS

SEQ ID NO: 188357 - protein, 172 aa, Triticum aestivum
  unsure (1)..(172): unsure at all Xaa locations
  Clone ID: PAT_TA_82775.pep
MAAATGYSDAPTDEQLLAYAELPRHGRYMAEVFAVRILATAGGDXRRPMAPSLSTAATAAAISFTAGVHWKREKTPRSKPATXXNLVLTGPSWATSAYSPIAFTLYLHDGSPQAGEAAEDDEDIGRIICDCIDGDFSNYNRAIVETVQTGYGPAEVIYASEQRVQGGSHQVA

SEQ ID NO: 188358 - protein, 110 aa, Triticum aestivum
  unsure (1)..(110): unsure at all Xaa locations
  Clone ID: PAT_TA_82776.pep
RFKLTCGSAVRVRLCXXSPHCCCVLAILLSLERWCCMDWFSWLPRASIEPLRASCLLLAILLLLVIDDDKSHGLCYYCCNKSDRRTIQCRPTKGIQCAGLVLGLGSLCEL

SEQ ID NO: 188359 - protein, 112 aa, Triticum aestivum
  Clone ID: PAT_TA_82777.pep
EENCQRRVAKEETWLVFEMDHWRGQPVMSIACPHPARPSCHRPQMHPAPCPFAHWRPGTHLLHYPAHQLHAYTSPALLLLWCLRIMRCLGFRLWRQSLRLQSYLWFCHDRFA

SEQ ID NO: 188360 - protein, 114 aa, Triticum aestivum
  Clone ID: PAT_TA_82778.pep
FLAPYKTKIIDVIEKGEKQPNITIGILVSVVVVFVTVLFKILFGGKKPVAPVKPAAEAKKPKATVTDGAGSSGDKDEKEDEKEETAGPRRRTRRHRDLFLMCLDVLAPAYFEDS

SEQ ID NO: 188361 - protein, 88 aa, Triticum aestivum
  unsure (1)..(88): unsure at all Xaa locations
  Clone ID: PAT_TA_82779.pep
MACKTKSLLLALSVAALLAARSESHGLGDFTSGSXEATTTPEMQTFFKPQAAAALPEALDASMXXKPXXTAXPATTTXXGREQRPXXA

SEQ ID NO: 188362 - protein, 58 aa, Triticum aestivum
  unsure (1)..(58): unsure at all Xaa locations
  Clone ID: PAT_TA_82780.pep
GHXAALYALAVVQFNGSGGDKADKDPRTGVALCXXXAWLGXXPALRXXGHCLQDGYXA

SEQ ID NO: 188363 - protein, 95 aa, Triticum aestivum
  Clone ID: PAT_TA_82781.pep
FFFLMIKDRNPHNLYPGFSCNPALNQLMSLYANFKIILEPPNNTPKRRATAMVPLILKVRQQLLCGYHDHQHIQHGQPSGSQHQLHVMSHLCHHF

SEQ ID NO: 188364 - protein, 42 aa, Triticum aestivum
  unsure (1)..(42): unsure at all Xaa locations
  Clone ID: PAT_TA_82782.pep
RKKAAHXLTXEDHDGDWMXVGDVPWGLFLGSVKKLRIARTDR

SEQ ID NO: 188365 - protein, 138 aa, Triticum aestivum
  Clone ID: PAT_TA_82783.pep
NVIKSRDYKLVFRNQTLTYVYSIICMHMKEGNNEHSQCTGQTIIDIDDSVIPGPGPAGQIIPKDACTAPFAQSARMIRSPRRTSSRASSSPWSCVAAGSGHGQPQHAGDLALEVMAADDPNPEAKVRVHLHRDVVEAL

SEQ ID NO: 188366 - protein, 113 aa, Triticum aestivum
  unsure (1)..(113): unsure at all Xaa locations
  Clone ID: PAT_TA_82784.pep
LLEAVXRERNIRTNQTRNTTIFHHPALGDFELQHLPVGNDAELEERILQHLAAAAAMGRAHHLGRRXGHRGRSGSHGRPHFLVFSTQPNSPSAGTISSSSAHMEGENDSNCHT

SEQ ID NO: 188367 - protein, 156 aa, Triticum aestivum
  unsure (1)..(156): unsure at all Xaa locations
  Clone ID: PAT_TA_82785.pep
NQLHETLDKIRPAQRTDKEIASIKEKMSKGKTKGFREDEHDTLWFEDRVYVPNDSEIGKLILQEAHDSPYSIHPGNTKMYLGLKGTFWWTGMKKDIAKYVAVCDVCQRVXGRXHRSPAGLLQPLPIPEWKXDKLGMDLSQXFXRTRSGYDSIXVVI

SEQ ID NO: 188368 - protein, 84 aa, Triticum aestivum
  Clone ID: PAT_TA_82786.pep
SASEGTDLVVLRFQKFVCLMFVDIGQLCLLASLHPACEGCWILQVTAPCLLSVKRFRDLLVMLTTQWNLNCSSVKRRYTEKKKK

SEQ ID NO: 188369 - protein, 77 aa, Triticum aestivum
  unsure (1)..(77): unsure at all Xaa locations
  Clone ID: PAT_TA_82787.pep
PAWHLEKXXLEXXNPXSPTGXDSXPXTQHXANHFISQARKSPNRPPADKVLDNLIYNYSPTFTGKKSKSFEEVYIFS

SEQ ID NO: 188370 - protein, 143 aa, Triticum aestivum
  unsure (1)..(143): unsure at all Xaa locations
  Clone ID: PAT_TA_82788.pep
LKGALXSRYIPXSXNSXKVLXAXHSXEDMRTMPIYIQXKTKNLMXRXIWHDTSFLSXMNVMDYSLLXGVDKEKXELVFXIIDYXTQYTWDKQLESWVKTSLVVXKNXFXTVILPREXKMRFXGLCQIFLLVXDVEFENIFWYW

SEQ ID NO: 188371 - protein, 52 aa, Triticum aestivum
  unsure (1)..(52): unsure at all Xaa locations
  Clone ID: PAT_TA_82789.pep
PXXEXXLXKSYSIGAAACTRGWTGSLEVGXSGPXARASEXSDGSRGLFGWRT

SEQ ID NO: 188372 - protein, 84 aa, Triticum aestivum
  unsure (1)..(84): unsure at all Xaa locations
  Clone ID: PAT_TA_82790.pep
PPSGTSSRDAVTYPXXARRKTVTAXXVVYAXKRQGRTLSGYXGWAASPSDALMRPWSVVCVGRSTVVCSVSSFRGVVSFGIFSL

SEQ ID NO: 188373 - protein, 79 aa, Triticum aestivum
  unsure (1)..(79): unsure at all Xaa locations
  Clone ID: PAT_TA_82791.pep
GTSDRXYAPFHRITVAGDVPRYSAMLFSVPSFQVQVADELVDDEHPPRFKPHDNNDFVCFCVSEEGALHQDKLKAFCGV

SEQ ID NO: 188374 - protein, 117 aa, Triticum aestivum
  Clone ID: PAT_TA_82792.pep
MSSGGVKDFYRQKKKGGVAKTASSSKNKTRHYTGGASVGASDAAQTSALVSHGSWDLKDDFGDEEEQLRQFDVDMKFGPCIGVTRLQRWERASAMGPPATSSSPGPPTARGIDKESR

SEQ ID NO: 188375 - protein, 91 aa, Triticum aestivum
  unsure (1)..(91): unsure at all Xaa locations
  Clone ID: PAT_TA_82793.pep
MPATPTIIGALLGLGTQMYSNALRKLPYMRHPWEHVLGMGLGAVFVNQLVKFDEKLKXDLDKMLXRARLANXQRYIDDDXYLSFQRLFFQN

SEQ ID NO: 188376 - protein, 83 aa, Triticum aestivum
  unsure (1)..(83): unsure at all Xaa locations
  Clone ID: PAT_TA_82794.pep
GGAGGVEEDIITLGPSEYIAQVAWSVGPFQFKEIEDCVTSLKFVTNRGATXPFGRRDGAHKSXPCSRGXLVGXXYLETSRQWV

SEQ ID NO: 188377 - protein, 87 aa, Triticum aestivum
  unsure (1)..(87): unsure at all Xaa locations
  Clone ID: PAT_TA_82795.pep
KVIPKNGTPKVLFXNTTXGDLXXFLWGILIHXWNQRGTRSYFEIXQSLGVDSPSQILFITDVFQEAIAAKNAGFEVIISIRPGSGAF

SEQ ID NO: 188378 - protein, 70 aa, Triticum aestivum
  Clone ID: PAT_TA_82796.pep
FLISTSLCPLLPYPTFPLMGSCDVVVVWLVAVSTKTVLTHVSCWEVGSLYYHVPTPSRIVRHLSSCDVIL

SEQ ID NO: 188379 - protein, 90 aa, Triticum aestivum
  unsure (1)..(90): unsure at all Xaa locations
  Clone ID: PAT_TA_82797.pep
MDAFSAVMDKVKSHPEMIEXVSAVIDKXKKSXPEXVEKVXDQXXSLXRLHLRGHXSKDKEPESXKKALKSEAXQNLQEEXGTLFRTNLNK

SEQ ID NO: 188380 - protein, 77 aa, Triticum aestivum
  unsure (1)..(77): unsure at all Xaa locations
  Clone ID: PAT_TA_82798.pep
KKILXXFLKKXFGXPQFFXXFFPQKREXXKXFXGKPXXPXXTXKFLGKSSKXFXXRGTIXXTIWFGFXKXXNPPGRN

SEQ ID NO: 188381 - protein, 53 aa, Triticum aestivum
  Clone ID: PAT_TA_82799.pep
EVDRPGCGAKILRGDGALDQYITRTNVMNLQETNDGLAGELEEAYMLSRIVSL

SEQ ID NO: 188382 - protein, 175 aa, Triticum aestivum
  unsure (1)..(175): unsure at all Xaa locations
  Clone ID: PAT_TA_82800.pep
AGLPVSRRSNGASFGSVXNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYLTRIXIIGFDKCVQSFIASSTGFQESARLKVTTGIISASFTILWLIFYCKHSFQMLS

SEQ ID NO: 188383 - protein, 107 aa, Triticum aestivum
  Clone ID: PAT_TA_82801.pep
GLGRRLILAGHMRHNTLQLSLDRIREQGETFTEPNQRVVYIWAGITDYVGRHMELDHNLVNMNSGACQHSSTAGATQRGSHAHILCWLTCTVQRNTEPGQALHQNIT

SEQ ID NO: 188384 - protein, 65 aa, Triticum aestivum
  unsure (1)..(65): unsure at all Xaa locations
  Clone ID: PAT_TA_82802.pep
GFSSPSYQVLLGLGFLRVXXRXMAAAXVEYXCFVGRXCLGQXQXVAGDALXSYGEXPRLQXHHRP

SEQ ID NO: 188385 - protein, 86 aa, Triticum aestivum
  unsure (1)..(86): unsure at all Xaa locations
  Clone ID: PAT_TA_82803.pep
YNLQNSFXSTASFSQSFRSTASFSKSIMDSSMDSSISGQQCLRYDANQVIIFFSPVPFFAWFLARAVLCILQAEHVSELFFPTSAR

SEQ ID NO: 188386 - protein, 88 aa, Triticum aestivum
  unsure (1)..(88): unsure at all Xaa locations
  Clone ID: PAT_TA_82804.pep
MAPKAEKKPAEKKPAAEEKAEKTTAGXKPKAEKRLPASKSSGKEGGEKXGKKKAKKNVEXYKIYIFKVXKXVHPDIGISSKACHHELL

SEQ ID NO: 188387 - protein, 163 aa, Triticum aestivum
  unsure (1)..(163): unsure at all Xaa locations
  Clone ID: PAT_TA_82805.pep
KEGYGSRSGCVRRYNTFSWVHNAHLKAMLKKLRAKHPNVRIIYGDYYTPVVQFMLQPEKFGFAKQLPRACCGAPSTPEKAAYNFNVTAKCGEXGAXCCADPTTHWSLDGFTDGAAYXHIAKGGYTGFCGQPIINLMIRICVEFIKVGTGKNGAGNSLQLMLIM

SEQ ID NO: 188388 - protein, 61 aa, Triticum aestivum
  unsure (1)..(61): unsure at all Xaa locations
  Clone ID: PAT_TA_82806.pep
ASSSFTVAMKLAPNREKFMEVISGTGDINADIEKFCTTFSPFXKENHXFLASVGLDDLKAS

SEQ ID NO: 188389 - protein, 119 aa, Triticum aestivum
  Clone ID: PAT_TA_82807.pep
VDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENPLP

SEQ ID NO: 188390 - protein, 117 aa, Triticum aestivum
  unsure (1)..(117): unsure at all Xaa locations
  Clone ID: PAT_TA_82808.pep
HLVRLYGFCFDANTKALVYEYLEKGSLEKYLYYGDVECSTSTGKRLEWGTLHGIXLGTAKGIKYLHEECQQRIVHYDIKPANILLTADXHPEVGDFGXARXGEREDTHXSLTGGRDR

SEQ ID NO: 188391 - protein, 80 aa, Triticum aestivum
  Clone ID: PAT_TA_82809.pep
LHLGVVNHSSRRNLLPKRPFFSVRTFGGLLCLIMLLYGFYMLWFFLDLHRAYRLCCTALISGAYEDCFWFCCLCCNALKQ

SEQ ID NO: 188392 - protein, 63 aa, Triticum aestivum
  Clone ID: PAT_TA_82810.pep
SRYSTLANRNILPAQVHKQYTQVLGIYITAVYSKTYWGGVILYTMKNTSYGLQDQAQLICLQT

SEQ ID NO: 188393 - protein, 109 aa, Triticum aestivum
  unsure (1)..(109): unsure at all Xaa locations
  Clone ID: PAT_TA_82811.pep
LIVRRKDARSVKIKRSKDVVKFKVCXSKYLYTLYVFDAEKTNXLKQSLPLGSLALIHIHRPLSAIHSNPKVREKNENPFHLQRLPSLCRDMNRIPYHRETPYASSIHGA

SEQ ID NO: 188394 - protein, 123 aa, Triticum aestivum
  unsure (1)..(123): unsure at all Xaa locations
  Clone ID: PAT_TA_82812.pep
FEPFASASAPPYPIDPLHLASDRATPLHESTAPRPCAAAARRSXPHRRSESSLPPNAHTCSPDPLRLHRRGRASGSSRWWPSRWPXRRRDIRGXIGTISGGASRSCXGERXXXFXXFXXXGLA

SEQ ID NO: 188395 - protein, 104 aa, Triticum aestivum
  unsure (1)..(104): unsure at all Xaa locations
  Clone ID: PAT_TA_82813.pep
PAGAAWRPGRRAPFKETTGIXGLXVVPNARXVXVRLYERTLKXXKGVPQKXGYXKAVXSXXLTLXIFQEEEDAFRESDSLRVIEATSVIAKINFIGCHDYNLSI

SEQ ID NO: 188396 - protein, 51 aa, Triticum aestivum
  unsure (1)..(51): unsure at all Xaa locations
  Clone ID: PAT_TA_82814.pep
ITITWLPISCAFXIVVQXKCLSDREQPYNLMNGLSQRGICCANLKKKKKKK

SEQ ID NO: 188397 - protein, 41 aa, Triticum aestivum
  Clone ID: PAT_TA_82815.pep
VTNTPNFLTDDVAGLGISVPRKTTQADRYVRAGLWKARGTT

SEQ ID NO: 188398 - protein, 139 aa, Triticum aestivum
  unsure (1)..(139): unsure at all Xaa locations
  Clone ID: PAT_TA_82816.pep
MDDYAREMMELKTLVTRTLEKKGVLAKIRAELRASVFEAIEEEDRVMENDDGGNPALLGSCNDRAKQLHASPSGRLLTALFCEYFEWAQLSHTMKVYXPECNXPXDFLRMNLKTSLXKIELKGARXLKXXTXLCSPRVS

SEQ ID NO: 188399 - protein, 175 aa, Triticum aestivum
  unsure (1)..(175): unsure at all Xaa locations
  Clone ID: PAT_TA_82817.pep
GRGEWVYDDAAXPWYQEEECPYIQPQLTCQAHGRPDRAYQHWRWQPRGCSLPSFNATLMLEMLRGKRMLFVGDSLNRGQYVSLVCLLHRIIPESSKSMETVDSLTVFKAKDYNATIEFYWGPFLGESNSDDAVVXRIXDPIXXGTSIXKHANFXKGLNFGFKNYLLGITGQKXKI

SEQ ID NO: 188400 - protein, 61 aa, Triticum aestivum
  Clone ID: PAT_TA_82818.pep
FSRQAKCVLTTISSSSYTADTSYGTSRCRTQTYPRLHWKKTPHGRQADHTSSSILLPPWTN

SEQ ID NO: 188401 - protein, 129 aa, Triticum aestivum
  unsure (1)..(129): unsure at all Xaa locations
  Clone ID: PAT_TA_82819.pep
MWGSTDGGTXRFTLETSMGAVSVEMYYRHAPKTCRNFVELARRGYYDNVIFHXIIKDFIVQGGDPTGTGXGGESIYGAKFEDEIKTELKHTGGXILSMGNXGPKNNXSQFLXNLAPCXSLXGKNKIFWE

SEQ ID NO: 188402 - protein, 108 aa, Triticum aestivum
  unsure (1)..(108): unsure at all Xaa locations
  Clone ID: PAT_TA_82820.pep
MSALRHSLPIILLQLYILSGRPAAAKVPALFVFGDSTVDTGNNNYISTLMKSDFAPYGRDLWPGSGGGSTSSGQSTGRFSNGRXAVDFISEAFGLPQFVPXYLDPTQT

SEQ ID NO: 188403 - protein, 155 aa, Triticum aestivum
  unsure (1)..(155): unsure at all Xaa locations
  Clone ID: PAT_TA_82821.pep
MKDGTSXGGGAFAAGSDPRQPSTANXYAPPKLSPQDLPIDYAGFLAVAFGXLGVMLRYKVCSWIAIIFCAQSLANMKNFENDLKQLSMAFMXCXYGSGDELFXPRSSRQYKALNCGRTCATFFIGLFGASXIALPSVLTXMYVQFEQNVIGMGIN

SEQ ID NO: 188404 - protein, 92 aa, Triticum aestivum
  Clone ID: PAT_TA_82822.pep
LPQDWFRTRDLERTMREESSCYLILNCEGFLPMNPSNSLVTKSALNLLQYPYFQTSLKEYQRKSTNPPNNRYICFLNYIYDHDLIYKDINTP

SEQ ID NO: 188405 - protein, 157 aa, Triticum aestivum
  Clone ID: PAT_TA_82823.pep
VVQLDDWVLCRLYNKKNEWEKMQLGKTAVAGVGATKEEAMDMATSHTHSHSQSHSHSWGETRTPESEIVDNDPFPELDSFPAFQDPAMMMTVPKEEQVDGFNAKSGNLFVDLSYDDIQGMYNGLMLPPPGEDYSSLGFPRLKGNNPPEPGWITAIEH

SEQ ID NO: 188406 - protein, 62 aa, Triticum aestivum
  Clone ID: PAT_TA_82824.pep
KCCHGNFTTVLQLNFSCLACYEATVVGASVSNSQNKLQWPFRPDVECMVRKEILVRLSSVYL

SEQ ID NO: 188407 - protein, 175 aa, Triticum aestivum
  unsure (1)..(175): unsure at all Xaa locations
  Clone ID: PAT_TA_82825.pep
VIFDAGSTGTRVHVFRFDRKLELLEIGDDGIEVFAKVKPGLSSYAGHPQEAANSMLPLLDKGKSAVPKQLTKRTPLRLGATAGLRLIGEEQSEQILEAVRNLIHTKSKFQYKPEXINVIXGXQEXSYYXVXLNYLXDKFGXDYSQTVAVLXMGRGSVQMAYAVSXMPKCSGALLG

SEQ ID NO: 188408 - protein, 70 aa, Triticum aestivum
  Clone ID: PAT_TA_82826.pep
SPENEKEINNYNFFYRCRADRPKWHFPNFSSLSRYTKTWSIVTHKRTENILLGILMIIWRGPHLSDNRGF

SEQ ID NO: 188409 - protein, 138 aa, Triticum aestivum
  unsure (1)..(138): unsure at all Xaa locations
  Clone ID: PAT_TA_82827.pep
MASWAALLALLLSAFSAAAXXDERFYGQSCPSVEDVVRKEMVRALSVAPSLAGPLLKMHFXDCFVXGCEGSVLLDFNGXTTXRRXNAXRNLKLRXFRFIQKVKXXVEKGLPXNVSWAKCGSNGKEPXWLKXGXFWGSN

SEQ ID NO: 188410 - protein, 144 aa, Triticum aestivum
  unsure (1)..(144): unsure at all Xaa locations
  Clone ID: PAT_TA_82828.pep
MSSLRPSLLLVVSLLAAALLAAAPSSASRDLRXLQASFVVRGRVWCDNCXAGFETPASTYIAGAKVRVDCKSKTTGANTCSFEGXTDRTGXYNILVIDEHEHEXCSRLVRARKRXCNVVAGCKRAPXFLTAKRFDQSLEMLGVQ

SEQ ID NO: 188411 - protein, 176 aa, Triticum aestivum
  unsure (1)..(176): unsure at all Xaa locations
  Clone ID: PAT_TA_82829.pep
VGSIQSQVAKIEDDMKVRASEYNNVRSQLSAINRKQSGSLXVRDLSNLVKPEDMITSEHLVTLLAIVPKYSQKDWLSSYEKIDTFVVPRSSKKLYEDNEYALYTVTLFAKVVDNFKVRARXKXFXVRDFXFSPEAQESRXXXMXKLLQXQEAIXATLFNGXFASXXXGFXXRXAFF

SEQ ID NO: 188412 - protein, 138 aa, Triticum aestivum
  unsure (1)..(138): unsure at all Xaa locations
  Clone ID: PAT_TA_82830.pep
MAGMAPEGSQFDAKHYDSKMQELLSTGETEEFFTSYDEVFEXFXDIGLQENLLRSXYAYGXXKPSAXQQRGIXPLQGLXVIQQAQSGTXKTATFCSXVXQQLXTNGPVKSKXXVFXPTREXXNQXWKIFXXLWDXLGV

SEQ ID NO: 188413 - protein, 134 aa, Triticum aestivum
  unsure (1)..(134): unsure at all Xaa locations
  Clone ID: PAT_TA_82831.pep
PASGFPGXQRSRRKGXXKGKLKASKGDSKKRAGLXQWLRPFLRAMFPCKANLSTGVRGPFPRNLPSDQTSXEPPFKQTNIPSTKPSKFPTKAKIDXRFRFPRHSFVPVALVTRSFVGKTXSVAKKVLLLRRVGC

SEQ ID NO: 188414 - protein, 100 aa, Triticum aestivum
  unsure (1)..(100): unsure at all Xaa locations
  Clone ID: PAT_TA_82832.pep
XAPFARKFHEDDPVLDRIDEEILGXXXDVXTPGGWCAGTRENGSDPCSVVGDTGLVVPGXGAXXLQRLVTSLLSEEKFHPXQVNLCFYVAVVLPQPTVVL

SEQ ID NO: 188415 - protein, 172 aa, Triticum aestivum
  Clone ID: PAT_TA_82833.pep
MEDSKAPVSEHGGETSKAAVLVGVAAGSGGRRGRAATRVLAVVDLILRSVAVVATVGSAIAMGTTNQTLPFFTQFLRFKAQYSDLPTLTFFVVVNSIVAAYLVLSIPLSIVHIMASSAKYSRLVLVFFDRQCCGVVRRGGGRCLATRERRATVAFFLDFGPMVLGMFKSRDW

SEQ ID NO: 188416 - protein, 99 aa, Triticum aestivum
  unsure (1)..(99): unsure at all Xaa locations
  Clone ID: PAT_TA_82834.pep
TXETFXAAPRPXGNXASHVNTALLARTSXDAASGKNIMEDICLXXGAYXADHAXRASKVEDFLKGKSLSSSXILKAVQLXKETXSPPEGTXXPEYRVXX

SEQ ID NO: 188417 - protein, 139 aa, Triticum aestivum
  unsure (1)..(139): unsure at all Xaa locations
  Clone ID: PAT_TA_82835.pep
MARRLLVALLAASLLLPLARPDSSSSPPAATAYDELRLRGFPRGLLPXXVRAYTLDSGSGDSPSXLRSSCRIVLPAGSXPXRFKERXKGRXEERDFGAXGXGXGXFRWWXXGDXXDGXSWFXGGSXXKFPGGIKFPARG

SEQ ID NO: 188418 - protein, 172 aa, Triticum aestivum
  unsure (1)..(172): unsure at all Xaa locations
  Clone ID: PAT_TA_82836.pep
SCRSCRECGDRPRGASGEGPPPSDSWAWRKYGQKPIKGSPYPRGYYRCSSSKGCPARKQVERTXADPTALLVTYTFEHNHEAPQPKTSGGSXCHQQGKPSARPPAPKPEPSVVLVQRDESARSTXVETEVPEQEQETEPEEEHEPAEKGPWPVRKRNLNGAPRRRFLVFTPR

SEQ ID NO: 188419 - protein, 129 aa, Triticum aestivum
  unsure (1)..(129): unsure at all Xaa locations
  Clone ID: PAT_TA_82837.pep
MFVPAATAGTVLCCMCGVSMQPNPANMCARCLRXAXDITEGVPRHAAVVYCPDCSSYLQPPRSWLRAAPESPELMQILLRRIXRPLARLRXSLSGAEFVFSEPQSKXLXXKXXLRREXLXXIVLEQSNQ

SEQ ID NO: 188420 - protein, 145 aa, Triticum aestivum
  Clone ID: PAT_TA_82838.pep
LQSTSALSATNSGISNPNSEFGSCSPHSRVNSALSVRGWKRLDADQRFAPGRRRSEFSCDSHVTGFTVDLSLRILFSRLTVQGRLRGAWDVQAGGTTMMIDLIVMTGVECPLLLREVGLTPIGSKMTDASSVLGGESNRPQRARL

SEQ ID NO: 188421 - protein, 135 aa, Triticum aestivum
  Clone ID: PAT_TA_82839.pep
KAKSEGYLWGNRTAAVDSDKKQQLLAVIGVYTGFGSRLKRNVFRGSWMPRGDALKKLEEKGVAIRFVIGRSANRGDSLDRNIDDENRQTKDFLILESHEEAAEELPSKAKIFFSAAVEAWDAEFYVKVEDNINLT

SEQ ID NO: 188422 - protein, 131 aa, Triticum aestivum
  unsure (1)..(131): unsure at all Xaa locations
  Clone ID: PAT_TA_82840.pep
MAASVFPALLLAVAAVLLLPVAEAVWLELPPSGTKCVSEEIQPNVVVLADYAIMYESHPSSHPTVAVKVTSPYGNTVHHNENATTGQFAFTTSEAGNYLACFWIDSVEKGXRNISXNLDXKIGIAAKDWLF

SEQ ID NO: 188423 - protein, 154 aa, Triticum aestivum
  Clone ID: PAT_TA_82841.pep
RTALVKSLRPQPLPSKMVAIALLGMAANIPLGVWREHTKKFSPQWFAAVHAAVPFIAMLRKSVVMPRTAMAFTIAASIVGQTIGSRAERIRLRNQAANGTGDSSTHTAMYPNKNGHCSDTEGKAWDPLATKITGSTARGSPAPTPSVCSDCVSM

SEQ ID NO: 188424 - protein, 95 aa, Triticum aestivum
  unsure (1)..(95): unsure at all Xaa locations
  Clone ID: PAT_TA_82842.pep
MRLLTHNMLASNVRGATTGYPLTLEATNWCTKEVELNSDFIRGLLPKIDWRALVAATRAVGLPELLPEEQPPEEEIFADGXADVEGSAIRRIHHA

SEQ ID NO: 188425 - protein, 62 aa, Triticum aestivum
  unsure (1)..(62): unsure at all Xaa locations
  Clone ID: PAT_TA_82843.pep
QEKGRVVQVRYKAITSGGGEKCTATAAWPASMPXPPCGSFLTGWAQVRTXPXPAPRWRHAAS

SEQ ID NO: 188426 - protein, 73 aa, Triticum aestivum
  unsure (1)..(73): unsure at all Xaa locations
  Clone ID: PAT_TA_82844.pep
ERLKAHEVLKHPWICDNGVATHQTLDPTVLSRTNKLSAVNKSKKLALQVIAKHLSXEEIXXLXGXXXGNGQEL

SEQ ID NO: 188427 - protein, 114 aa, Triticum aestivum
  unsure (1)..(114): unsure at all Xaa locations
  Clone ID: PAT_TA_82845.pep
VXXGXXSRXRXICXXXCXXSXXPPPPASLLVLATGSPARFAMPLDSDPNPCEGSGDHALPPDITGERRGASSRGECGGGXRQRSWGEPSKERGGGDAMRLPSAGEGIGPTPAAR

SEQ ID NO: 188428 - protein, 76 aa, Triticum aestivum
  Clone ID: PAT_TA_82846.pep
MRSETPKDDSRQAASILFPDKDQSLKLKKHHGRAEALLLAAYGKGLVLPSGKFSKTSVCLWFQMTCFFGGKRCCHW

SEQ ID NO: 188429 - protein, 114 aa, Triticum aestivum
  unsure (1)..(114): unsure at all Xaa locations
  Clone ID: PAT_TA_82847.pep
TLTGKTITLEVESSDTIDNVKAKIQDKEGIPPDQQRLIFAGKQLEDGRTLADYNIQKESTLHLVLRLRGGIIEPSLQXLARKYNQDXMICRKCYARLHPRAVNCXKKKFGHSNQ

SEQ ID NO: 188430 - protein, 171 aa, Triticum aestivum
  unsure (1)..(171): unsure at all Xaa locations
  Clone ID: PAT_TA_82848.pep
TNQARQAEDVGIDYFDSLLKVGFLQIWSTWGEVTCKMHDLVHDLARQILRDEFVSEIETNKQIKRCRYLSLTSCTGKLDNKLCGKVRALYVCGRELEFDKTXNKQXCXRTIIXKYITADSLPCCVKIXNTGVXEISSVNCEXSQKSLALLDLKPFMIKCSSLQCTERQLRA

SEQ ID NO: 188431 - protein, 148 aa, Triticum aestivum
  unsure (1)..(148): unsure at all Xaa locations
  Clone ID: PAT_TA_82849.pep
LGERFNKLRAKIISLRCGPGAXILPPEVTRIHMDFATSFKNGHMGAKKFWRENLPRLKYHNPSVPMIVNRHSRNNKKPTISIYLRKPDASTPAPATRSQPSSSRNNMSKATPRMXEKIVTVDMTEKHFLTFLIRTCRDPCVPSTHQFI

SEQ ID NO: 188432 - protein, 103 aa, Triticum aestivum
  unsure (1)..(103): unsure at all Xaa locations
  Clone ID: PAT_TA_82850.pep
MSGRGKGGKGLGKGGAKRHRKXLRDNIQGITKPAIRRLARRGGVKRISGLIYEETRGVLKIFLENVIRDAVTYTEHARRKTVTAMDVVYALKRQGRTLYGFGG

SEQ ID NO: 188433 - protein, 91 aa, Triticum aestivum
  unsure (1)..(91): unsure at all Xaa locations
  Clone ID: PAT_TA_82851.pep
XQISXSLRARMPGSXGCXQXLXSEQAAXXSDLTGGRLXXXXSCAVCSRRGAWWYXQLHPDQLVPGPXXXAXGTGGSGTQLXXACNXDXRTP

SEQ ID NO: 188434 - protein, 136 aa, Triticum aestivum
  Clone ID: PAT_TA_82852.pep
MRGGSRPAPVVLFLLAASGICAQFTAVLAGDPQTSNDDKKAEAQPKGHTGKTVLFVLLGVGAVILLSFVIFKYWQKKKRQEQHARLLKLFEEDDDIEVDLVFIDDLQLYSKSIWQGFAGLLFMCKEVVNLKAQKVC

SEQ ID NO: 188435 - protein, 77 aa, Triticum aestivum
  unsure (1)..(77): unsure at all Xaa locations
  Clone ID: PAT_TA_82853.pep
SLXLVPQKLGVGGTLAPGFPPMLRSHSRPHLGCSQLVLDGLGGGCLLGCRWRLGGGGGGGGCGLLALLDEVDDVVRR

SEQ ID NO: 188436 - protein, 80 aa, Triticum aestivum
  unsure (1)..(80): unsure at all Xaa locations
  Clone ID: PAT_TA_82854.pep
SDXXXDIVCHRAYVXXEXASAFXVLTWHVMPVFRQVSRTGAHLRXRPCSXWXXCXXSSLXRSSAXAXSCDXGSVWXLNXD

SEQ ID NO: 188437 - protein, 95 aa, Triticum aestivum
  Clone ID: PAT_TA_82855.pep
PIHDLDLSKYIGHRCQDVPHNYRLYATSNHYGSLGGGHYTAYVYHEGKKGWYDFDDRHVGPITEDSIKTSAAYVLFYRRIQEDSLDTDMDLIFQT

SEQ ID NO: 188438 - protein, 68 aa, Triticum aestivum
  unsure (1)..(68): unsure at all Xaa locations
  Clone ID: PAT_TA_82856.pep
XPDLKRXKLVLATLTRVGTISRLSSSAXRNSYCSRRTIEKQGRDDDGRTGTSRRXRDRDEAAGAACSA

SEQ ID NO: 188439 - protein, 63 aa, Triticum aestivum
  unsure (1)..(63): unsure at all Xaa locations
  Clone ID: PAT_TA_82857.pep
MXFXLVYCXAXISXGXINXAVTFGXXLXRKLSLXXAVFYIIMQCXXAIXGAGVVKGFQQGLYM

SEQ ID NO: 188440 - protein, 86 aa, Triticum aestivum
  unsure (1)..(86): unsure at all Xaa locations
  Clone ID: PAT_TA_82858.pep
LVXLVWFLEGFSNPTPSMDALTMRCYRYSPSVAMVPMRKTSRTTMTRASISTDGCSSSEPKKKSHSVSFAGKANKVYEDKDLGISG

SEQ ID NO: 188441 - protein, 48 aa, Triticum aestivum
  unsure (1)..(48): unsure at all Xaa locations
  Clone ID: PAT_TA_82859.pep
RARQPNDEDPLNHEXAVVLRDNPKMFEANVRRAMAGGYVGQHYFQRCA

SEQ ID NO: 188442 - protein, 63 aa, Triticum aestivum
  unsure (1)..(63): unsure at all Xaa locations
  Clone ID: PAT_TA_82860.pep
AALXHELFICTLHDEKQLLLQELSGMRTSIYSYTIHATMSMITLKYYTQKKWTGNKSTDADSS

SEQ ID NO: 188443 - protein, 167 aa, Triticum aestivum
  unsure (1)..(167): unsure at all Xaa locations
  Clone ID: PAT_TA_82861.pep
RTGGANRPAWLQQYELIGKIGEGTYGLVFLARLKPPHPAPGRRGPPIAIKKFKQSKEGDGVSPTAIREIMLLREINHENVVKLVNVHINHADMSLYLAFDYAEQXTSYEIIRHHREKLSSSINPYTVKXSLLWQLAQTGLNYLHSNWIIHXRXLKASNILGHGEEGY

SEQ ID NO: 188444 - protein, 43 aa, Triticum aestivum
  unsure (1)..(43): unsure at all Xaa locations
  Clone ID: PAT_TA_82862.pep
XIVGYXXGHPXPVRFPNTCSLFLQIQIMCLKNPKCRSSIHRKL

SEQ ID NO: 188445 - protein, 78 aa, Triticum aestivum
  Clone ID: PAT_TA_82863.pep
NDVDLVALSGGHTFSRVQCKFITDRLYNFSGTNMPDPTLDASYRAFLTQRCPRNGDPTALNDLDPTTPDTFDNKLLPS

SEQ ID NO: 188446 - protein, 101 aa, Triticum aestivum
  unsure (1)..(101): unsure at all Xaa locations
  Clone ID: PAT_TA_82864.pep
KAKMIYRXWSLLSXTVVIXGGVATXGLAVIFLLXGKEKFNGYLCREGYRFXQQDXAXXGRXLLWKGVISLNFTRFLCYQKSLMMESILLQAFTFLITVTIN

SEQ ID NO: 188447 - protein, 120 aa, Triticum aestivum
  unsure (1)..(120): unsure at all Xaa locations
  Clone ID: PAT_TA_82865.pep
MVLQLRLIPRLAAAARLTPATSCAPRLLLRRAPLPPALAMASAYSAGXRXDRRLLFRQLFEKESSTYTYLLADVADPXXGPAVLIDPVDRTVDRDLNLIKELGLKLVFAMNTHVHADSPG

SEQ ID NO: 188448 - protein, 102 aa, Triticum aestivum
  unsure (1)..(102): unsure at all Xaa locations
  Clone ID: PAT_TA_82866.pep
NXIXXXVXXFXXVXXSXXGXGXGXXXNSXXPRXXSPXPGHESPSGSTTKHTKTARTSRQWLQTGAVLADVPGRSPSPSLQFLVVVARLKGSNGHRGLWGQVL

SEQ ID NO: 188449 - protein, 42 aa, Triticum aestivum
  unsure (1)..(42): unsure at all Xaa locations
  Clone ID: PAT_TA_82867.pep
IEMLXQQEICCHQLSKLPRXHXCFXLLFSFLTXGPSLPXLVC

SEQ ID NO: 188450 - protein, 97 aa, Triticum aestivum
  Clone ID: PAT_TA_82868.pep
DAPNKNYFDPRYLLSMYGNAWGDLFKGAFLWAKEGKDYREGAVSLLYRATGLLVPGIASHSPRDYVNAVRLGSVASAFWIACSFPCMCIIACNNWMK

SEQ ID NO: 188451 - protein, 185 aa, Triticum aestivum
  unsure (1)..(185): unsure at all Xaa locations
  Clone ID: PAT_TA_82869.pep
GEXGDLXRLPXFQLVXLQXHXGIXLXPVDSXAXAPXKYGFPVSEKFPGWLMPSQXFIGPIPPTRPERLKTFYPSIYRSKSQSTCNIVVAALAGGFVRTLAHRHRVQVPVASPDFQLACRGCKTVWRNYRCRPLHSWPWSLGWETSKICLPPVFLKWFGLIAPSPHRSACLCKGGVGAQLHVTVIT

SEQ ID NO: 188452 - protein, 95 aa, Triticum aestivum
  unsure (1)..(95): unsure at all Xaa locations
  Clone ID: PAT_TA_82870.pep
MXXXGNXXGXDTRAAXAXIYKXLKEEXLXXPAFEFTXXSRQXIDRMVDXNVLGXKCXRXLSVXDSYKLLXGADXWXKRKRSXCTXXWCLMLKFFL

SEQ ID NO: 188453 - protein, 113 aa, Triticum aestivum
  unsure (1)..(113): unsure at all Xaa locations
  Clone ID: PAT_TA_82871.pep
MDWSAVTAEDLVDALRXVDWSTPPRTVSEFFSRFTVPRSYSKWTSRLKCNXYYYRTNYFILIMFILGMXFLXKQVVSLCXMTGLSXAFLNDSFAVTFNRKSQGHRQFYTFSAR

SEQ ID NO: 188454 - protein, 39 aa, Triticum aestivum
  unsure (1)..(39): unsure at all Xaa locations
  Clone ID: PAT_TA_82872.pep
DLLSDLKLDYVPPKMGRWNNEIILCPLSVAIVKXKKKKK

SEQ ID NO: 188455 - protein, 94 aa, Triticum aestivum
  Clone ID: PAT_TA_82873.pep
FFFLIETFVLLFDAKGNHKTHKLGLYTKCNQDHPSGYFDNTRLKTQINSRLNSSLEGKPLCAMGSPVYLFGGVLLLFGALPKRQPRAYRLVSTT

SEQ ID NO: 188456 - protein, 171 aa, Triticum aestivum
  unsure (1)..(171): unsure at all Xaa locations
  Clone ID: PAT_TA_82874.pep
ELLSAGEISGEEKGVSNQIWRLYWSSHQRFFRHMCMSAKVPAVVKLAKEALAENKCVVIGLQSTGEARTEEAVTKYGVEMEDFVSGPRELLLKLVEENYPLPPKPDTFQQGEEKVTEIQRNXHSAQDVSFKGRVRKVAKMEDVSDDDSGDYSPSVNILAGNIVATFGNKKK

SEQ ID NO: 188457 - protein, 68 aa, Triticum aestivum
  unsure (1)..(68): unsure at all Xaa locations
  Clone ID: PAT_TA_82875.pep
GRXXPAXXRTSXRGTXPPXALCASLLLLEPLRLTLSRGIPERAAAEIAAIWGLVVXXETEERGXRMCV

SEQ ID NO: 188458 - protein, 145 aa, Triticum aestivum
  unsure (1)..(145): unsure at all Xaa locations
  Clone ID: PAT_TA_82876.pep
LLARLASLTTPEAARHETLLRIGCHAPSQPQAPPPRLRRPKAPAMSDRKSYTCTDVVGTHVSRSHPPSTNSKTVGPLAGRGEMAEEREVVVATPSRTRRTEHGQQRPRASSRVVQPEAKGVAGNRSXVLXVGAERXASXRLRENE

SEQ ID NO: 188459 - protein, 48 aa, Triticum aestivum
  Clone ID: PAT_TA_82877.pep
YVCSLIAITVLNEKRTFCCSLQPFVDSPLFMSMLSIDVFFVCPTVLPG

SEQ ID NO: 188460 - protein, 54 aa, Triticum aestivum
  unsure (1)..(54): unsure at all Xaa locations
  Clone ID: PAT_TA_82878.pep
LRXSSXWPPGSPXCSRGPXAGAGRGARXGFGVNXXGHRXXVTXVVXCVAGGVRX

SEQ ID NO: 188461 - protein, 124 aa, Triticum aestivum
  Clone ID: PAT_TA_82879.pep
KQAASSNPGVPPSSLMSFIRKNMSTSGVVLEDFDSHFSNRFYHSYLDNSVNINSSSIAAAAALVARSMYILASDDSVVDLITLNTIKVNVSLVEELIGCLLTCNPGLSCGLVKRFISPSNPCPT

SEQ ID NO: 188462 - protein, 157 aa, Triticum aestivum
  unsure (1)..(157): unsure at all Xaa locations
  Clone ID: PAT_TA_82880.pep
KNGSSPCTVKVVAPSGLHGSPSDDEAGGPSPLLDRWRYGGGCDCGGWDMACPIDVIGNTYDNSWAESIATNVKHPMELFVQGSKEELPVLSMKENGRGQFVVDFHGRLSALQAFSVCISLLHCSEASXAISLKKGKQKXYSSXIKFLLEGGANQFPL

SEQ ID NO: 188463 - protein, 38 aa, Triticum aestivum
  Clone ID: PAT_TA_82881.pep
MLLLLTSELLYFLHNQSSGFSQTYRALIIIQPFSHHSL

SEQ ID NO: 188464 - protein, 38 aa, Triticum aestivum
  Clone ID: PAT_TA_82882.pep
PREIERRIMSSGILLVLMVSMFLIVRDTLNLDFIKQNM

SEQ ID NO: 188465 - protein, 114 aa, Triticum aestivum
  unsure (1)..(114): unsure at all Xaa locations
  Clone ID: PAT_TA_82883.pep
AWCPSPTRITSPATATATATAPTSGPWWRGQGWGRRRRPWTTRGLPAEXAAWWWWWCWSPSLYGLCEGLGLSVGWLISPRRTPPPFVEVNFWGCFNFGGKQGRRDPYFLSKKKK

SEQ ID NO: 188466 - protein, 95 aa, Triticum aestivum
  unsure (1)..(95): unsure at all Xaa locations
  Clone ID: PAT_TA_82884.pep
LTNLDMILYFVXTRSLKCSPXPHPPLLLAGAVSTTHVACLAMYSERMAHFGQPNRFPSFFFVRGAKTTNILRTKEYNSPSRIXSSVAWHGSSFLV

SEQ ID NO: 188467 - protein, 90 aa, Triticum aestivum
  Clone ID: PAT_TA_82885.pep
LSRTAVAAVRSAARSAPLTGRVPGAPLPSLASSSAARSARILRRSAAASSSGLETLMPLHSAVAAARLRSCIAVDFSCWSSLSQGYALPL

SEQ ID NO: 188468 - protein, 149 aa, Triticum aestivum
  unsure (1)..(149): unsure at all Xaa locations
  Clone ID: PAT_TA_82886.pep
RXQTAXDRAPIXXSGTLSGYTRKVFTNVQGTFVFRXLVTSQTGARPRVCRFNSQLRHAAIAMTSSAPCRPSLRHPRQGLPHQQRRGGPHQGQLRAQVEIQRLHSLDFINNQSPRCAVRFVRLRLVCFETLLTTLVTANLCGAEELLVLR

SEQ ID NO: 188469 - protein, 65 aa, Triticum aestivum
  Clone ID: PAT_TA_82887.pep
FFFLQQKQATHAFYCSPGWNACVSVCCVLNLLDMYKYNTNPYMQFCTHNKFYLITTSTNKISSSQ

SEQ ID NO: 188470 - protein, 71 aa, Triticum aestivum
  unsure (1)..(71): unsure at all Xaa locations
  Clone ID: PAT_TA_82888.pep
NLDSCXQIRMIGVAFAHXKNPLVTLHTSTCLDXGSSYXXISXILARXYTPSXTSXHNDXRQXGRGRVDDPH

SEQ ID NO: 188471 - protein, 113 aa, Triticum aestivum
  Clone ID: PAT_TA_82889.pep
LRAAARASPHPPHSTRESLPPTHSTRSRRQPRGDPVLILVVSGEDLGPGRLISRLDLTFLWPLTATRKEEFLRLTVAPAFAPRALSSRQIPYLTTGSLNVWRIQQVGEPEVQL

SEQ ID NO: 188472 - protein, 78 aa, Triticum aestivum
  unsure (1)..(78): unsure at all Xaa locations
  Clone ID: PAT_TA_82890.pep
VAAPXTQLVEPYTWWVASDYHETGGCPVERFWPWQHRSTHRPRSAGECMEPRRRPVKSCRASGMPSQRQGDEFIGREA

SEQ ID NO: 188473 - protein, 72 aa, Triticum aestivum
  Clone ID: PAT_TA_82891.pep
MTECPGLQCASNRIKLKINAARSKPKGKTNHILSSLAEPQCNQHPTHTPSDSALAHRNPHSDTPSGEYVSSS

SEQ ID NO: 188474 - protein, 114 aa, Triticum aestivum
  unsure (1)..(114): unsure at all Xaa locations
  Clone ID: PAT_TA_82892.pep
QRRREGESFAARDMXDVLMQLADDPTSEVQIGRVGVKAFTQDLIVGGTEPVSATVEWAMSELLRKPSVLAMAAXELDREVGRRRWVTXKDVAHLPCLQAIVKETMRVTTSRSLP

SEQ ID NO: 188475 - protein, 44 aa, Triticum aestivum
  unsure (1)..(44): unsure at all Xaa locations
  Clone ID: PAT_TA_82893.pep
TDKGLGVRSKRXXLLAXDLTXXVAXXEEGGQXTISGAEEILKAL

SEQ ID NO: 188476 - protein, 113 aa, Triticum aestivum
  unsure (1)..(113): unsure at all Xaa locations
  Clone ID: PAT_TA_82894.pep
MRGIAFCSRLLSILATALLLHEGLGLTPFFFRYVDAVMXIPKXTLFPMCGMNLAFDRDLIGPAMYFGLMGDXQPIGRYDXMWAGWCVKVCGFLLLQLVTLPKHNVHWPDDHLT

SEQ ID NO: 188477 - protein, 82 aa, Triticum aestivum
  unsure (1)..(82): unsure at all Xaa locations
  Clone ID: PAT_TA_82895.pep
IPXXYQIPSAXXKDXGGIWCRMRXRRRRXLQXRXTXXRLARTXRXYXXLPASQXKEIKRKRRFXSGFXCCKXRILXVVVEXX

SEQ ID NO: 188478 - protein, 113 aa, Triticum aestivum
  Clone ID: PAT_TA_82896.pep
KHSMLRPRNVLKFVKDSSIFRPGYYIGIDPRAKLVILGIRGTHTVYDLVTDLVALSDKKVSPKGFSTHFGTYEAARWYLRHELSIIRKCLEKHKDYKLRLVGHSLGGASAALL

SEQ ID NO: 188479 - protein, 52 aa, Triticum aestivum
  unsure (1)..(52): unsure at all Xaa locations
  Clone ID: PAT_TA_82897.pep
PSXRALLVXVLLVVXDDXGHPPDGXLHLXAGXSXSYSRGENSXGSGGLSRXX

SEQ ID NO: 188480 - protein, 107 aa, Triticum aestivum
  unsure (1)..(107): unsure at all Xaa locations
  Clone ID: PAT_TA_82898.pep
FTSLCSSEXAAATSSSTYIAIXXKXLXXAPSXXTAXTSVSFXXTQHPCXXAASADCRRXVXPKVSSXSVIGTAMPSLDFXTSVFKKEKVSLDGHXEYIVXGXTDXFR

SEQ ID NO: 188481 - protein, 108 aa, Triticum aestivum
  unsure (1)..(108): unsure at all Xaa locations
  Clone ID: PAT_TA_82899.pep
MRGGDRPSASLQLLSLGLVLLYFFTSGSTVGLVEGQKTWCIAXXSASNEIXAQNLDYACSQVSCAVIXKGGXXYYPDXPVSRXAVAMNLYYAYSGRNXWXCTQQLGRR

SEQ ID NO: 188482 - protein, 127 aa, Triticum aestivum
  unsure (1)..(127): unsure at all Xaa locations
  Clone ID: PAT_TA_82900.pep
NSGKGFAKGNIHLQHSSNYPNFALFCHLFKTQLLGSSFSFELLSTRLIWRHEIPTDSNSLQXSGRHGDCVPTHLPNFVGVVTTDGHSFHPWLCHVSTTHGLSSEISXWTFNTHGEXXLHXLNPMGXN

SEQ ID NO: 188483 - protein, 117 aa, Triticum aestivum
  unsure (1)..(117): unsure at all Xaa locations
  Clone ID: PAT_TA_82901.pep
PPSYWPSPSWRPPPGTGRQRDRVPRVPGQAFNTXFAQYAGYVTVSEQRXXALFYWFFEAEKDPGSKPLVLWLNGGACATYLRTHTLSPARLLRASSRSVSYCDDCLGLMGTWGRSVD

SEQ ID NO: 188484 - protein, 88 aa, Triticum aestivum
  Clone ID: PAT_TA_82902.pep
QNLVAWARPYLNDRRRLYQLVDPRLGLNYSVKGVQKVAQICHYCLTRDSKSRPSMDEVVKQLTPLQDLNDMASASPRPRSTQRGKVHR

SEQ ID NO: 188485 - protein, 54 aa, Triticum aestivum
  Clone ID: PAT_TA_82903.pep
HFKPLSEGDLYEIYKIWQGPRERVSPLPQIMTSTLPLGEMVSLRTHHVQCGTLA

SEQ ID NO: 188486 - protein, 59 aa, Triticum aestivum
  unsure (1)..(59): unsure at all Xaa locations
  Clone ID: PAT_TA_82904.pep
IPIXAXHIFKIGTTVRTLLLANRPQVTRXVXLXXINAELIXGVFXFTXTHFSKXCTAVN

SEQ ID NO: 188487 - protein, 135 aa, Triticum aestivum
  unsure (1)..(135): unsure at all Xaa locations
  Clone ID: PAT_TA_82905.pep
XHXPTTRDAPLXYXIPYTXLMHAWYLRADSPQAVLXYITWKXLYATKYQDAMSKTECTKTRLFICASFLQLLQVSQLPALDKENKAHKINIKNRFHNSPPNSLYNIGDTQPLFAGSWGGCASTWCPAAPCHRANR

SEQ ID NO: 188488 - protein, 77 aa, Triticum aestivum
  unsure (1)..(77): unsure at all Xaa locations
  Clone ID: PAT_TA_82906.pep
HGTHIALHSYSXILTHTTHQTTENTTRTHTVXIQRQXHSLTLEHTRSHIHSELVIILAXNXHGDGXHSHTHTXRHDR

SEQ ID NO: 188489 - protein, 50 aa, Triticum aestivum
  unsure (1)..(50): unsure at all Xaa locations
  Clone ID: PAT_TA_82907.pep
VXCPTXSSAASCRSSTTSPXSSXPRRXXXLKDAXXXGLHXXLHRXAPGTG

SEQ ID NO: 188490 - protein, 96 aa, Triticum aestivum
  unsure (1)..(96): unsure at all Xaa locations
  Clone ID: PAT_TA_82908.pep
LPISXANPRXFFDMTVGGAPAGRIVMELYANXVPKTAENFXALCTGXKGVGKSGKXLXXKGSXFXTGXIPXFMFQXRRIQPXQXTGXEFXXGXSSP

SEQ ID NO: 188491 - protein, 67 aa, Triticum aestivum
  unsure (1)..(67): unsure at all Xaa locations
  Clone ID: PAT_TA_82909.pep
HSASTDXFIVXVFXGRPXGXAARKQRRLLAGXXPSWIDTXXYLINXXXAXRRIDQLASSVWQCACGX

SEQ ID NO: 188492 - protein, 140 aa, Triticum aestivum
  unsure (1)..(140): unsure at all Xaa locations
  Clone ID: PAT_TA_82910.pep
VYCFSWVVIFVILLVMKTVSVGRRRFSAEFQLVFRLIKGLIFITFTAIVVILIAIPGMTVLDIFVCILAFMPTGWGLLLIAQAIRPVIHKTGLWGSIKALARGYEILMGLLLFTPIXFLAWFPFVSEFRQDAVQQGVREV

SEQ ID NO: 188493 - protein, 78 aa, Triticum aestivum
  unsure (1)..(78): unsure at all Xaa locations
  Clone ID: PAT_TA_82911.pep
RREXXVGHEXEXQHDXTDRDERGDVXXIXGXAXHQXGREDXAQLRRQRAEPXRKLXSGTLRGCGXCTTAGXXPSRSGG

SEQ ID NO: 188494 - protein, 109 aa, Triticum aestivum
  unsure (1)..(109): unsure at all Xaa locations
  Clone ID: PAT_TA_82912.pep
MGQXFRKLFDAFFGNKEMRVVMLGLDAAGKTXILXXXHXGXVLSTVPTIGFNVEKVQYKNVVFTVWDVGGXEVRPLWRHYLTTLMSXYVVDSLIEKNRGGRHNNLAKCM

SEQ ID NO: 188495 - protein, 51 aa, Triticum aestivum
  unsure (1)..(51): unsure at all Xaa locations
  Clone ID: PAT_TA_82913.pep
GHXLHLLXFXXFVCXXCVXXDVXXMEXXLTLTFSGRRDQSXIGKGGRXGGW

SEQ ID NO: 188496 - protein, 124 aa, Triticum aestivum
  unsure (1)..(124): unsure at all Xaa locations
  Clone ID: PAT_TA_82914.pep
FRQPLQEKQKHSNMIDGKHFQLQGYGNDRVASEDQVLDXXDRLYLLVEPQEDRSLDLWPACLRDVLHDFTTECTRVKDCLLREMANALDELGDDDDYFIDQFGDRADTHXRXXYYPPCDGGPRG

SEQ ID NO: 188497 - protein, 46 aa, Triticum aestivum
  Clone ID: PAT_TA_82915.pep
FFYSRCQYMLHVKITWDISVAVYIERARSSKVATKTNCILGSTKYI

SEQ ID NO: 188498 - protein, 115 aa, Triticum aestivum
  unsure (1)..(115): unsure at all Xaa locations
  Clone ID: PAT_TA_82916.pep
NFRRAFEHFXVHAGGRAVLEEVQRXLSLEDKDMEPXRXALHRXGNTSSSSXXXEXGLRRXQGXXKXGNXXWQIXFGXGFXSKXAXWXALXDXXAXSPGEEKACNPWGSQVAKAYV

SEQ ID NO: 188499 - protein, 143 aa, Triticum aestivum
  unsure (1)..(143): unsure at all Xaa locations
  Clone ID: PAT_TA_82917.pep
LFQFISVPRCIVHGSSRATRNIPLVVTGEDDRARWEGAGSVLAYSRSYRYGHGAIYRAEWNRISASSCLPDGTVGSPHSRTFFLAPQSLLSQPRSRXNLTIKVCTVATRHLGTIXSLXAWEXGRXXRXIXRTSLXSASLAFXK

SEQ ID NO: 188500 - protein, 76 aa, Triticum aestivum
  unsure (1)..(76): unsure at all Xaa locations
  Clone ID: PAT_TA_82918.pep
EPQSSXQEPXLLSCKEXARTVVVGCLEAQMXXSSSRRXXSXAAQXRITDQRSWXVRRXKLEAPDTLTLLTPRRVIA

SEQ ID NO: 188501 - protein, 90 aa, Triticum aestivum
  unsure (1)..(90): unsure at all Xaa locations
  Clone ID: PAT_TA_82919.pep
EXFSVTCRSTAKRTKDRAETFKXHQLSFSEVKHATCDFQNRSPLQIXNPINRATPLIGXLNKGVCXAYXXKVKISGXPSRXKFPXRXKXX

SEQ ID NO: 188502 - protein, 43 aa, Triticum aestivum
  unsure (1)..(43): unsure at all Xaa locations
  Clone ID: PAT_TA_82920.pep
GXXSXDXRGVXDVLGVGSDASSESESSSELHFVGWFGVGIKLR

SEQ ID NO: 188503 - protein, 51 aa, Triticum aestivum
  unsure (1)..(51): unsure at all Xaa locations
  Clone ID: PAT_TA_82921.pep
PXSTXRMXSXPYTMPRRLXPXHXXWRVNFKENDQFQTRRLMCVSQWCSFVQ

SEQ ID NO: 188504 - protein, 44 aa, Triticum aestivum
  unsure (1)..(44): unsure at all Xaa locations
  Clone ID: PAT_TA_82922.pep
MPSHKTFRIKKXLXKKMRXNXPIPYWIRMRTDNTIRXNAXRRHW

SEQ ID NO: 188505 - protein, 69 aa, Triticum aestivum
  Clone ID: PAT_TA_82923.pep
FLLCFLIFTMKIRMFKLQSLLHKKGREAESHISQIIYSAASAMARIAAALEISEVGEPVVRVLVVEVVA

SEQ ID NO: 188506 - protein, 84 aa, Triticum aestivum
  Clone ID: PAT_TA_82924.pep
CCDGGKAKCAFNHACAAVVCGEEALASPSKGLPCDACGFVWIEELLKTMPNMQTSHDACGFLWFKNCPMTLSFKVVNWMLHLYI

SEQ ID NO: 188507 - protein, 113 aa, Triticum aestivum
  unsure (1)..(113): unsure at all Xaa locations
  Clone ID: PAT_TA_82925.pep
KSYCENALKIYQKPIPGTSLEEIATGLTDVSAIYETMNEHEQALKLLQKALKMYNNSAGQQSTIAGIEAQMGVLHYILGNYXGSXDSFXSAXKVXTCGEKKVCFFGXALXXMG

SEQ ID NO: 188508 - protein, 111 aa, Triticum aestivum
  unsure (1)..(111): unsure at all Xaa locations
  Clone ID: PAT_TA_82926.pep
SPDLLLPADAAKMRRYSALPNGGRQETLADRAHRYRGVVLVILAPLALVSLVLLLMPRSPAGTMGGARRSGPAGEDRYAVIFDAGSSGSRVHVFXFXANLDLVXIGSIEFV

SEQ ID NO: 188509 - protein, 84 aa, Triticum aestivum
  unsure (1)..(84): unsure at all Xaa locations
  Clone ID: PAT_TA_82927.pep
VPRLDTILTSIPTDVVLRKQRLLANPSMKQAMLFPQPAQAGXAFHQXLNGLARKXPHXDGVFLKPGDERVLNWTAGXXXDLKHW

SEQ ID NO: 188510 - protein, 65 aa, Triticum aestivum
  unsure (1)..(65): unsure at all Xaa locations
  Clone ID: PAT_TA_82928.pep
TNGLEFNDKLRPGXPFXPXXLAAXPXQXALLKVKEVKNGRLAMFSMLGFFIQAYXTGXGXFXXLC

SEQ ID NO: 188511 - protein, 82 aa, Triticum aestivum
  unsure (1)..(82): unsure at all Xaa locations
  Clone ID: PAT_TA_82929.pep
ICRCSNLALFCVIXXAPLHGFAFXFDVEFNGPVRQKFKKQTSQPLDVNMPNXNPSNKKKKAXVSIVLSTAXEDAPTHWQQLS

SEQ ID NO: 188512 - protein, 105 aa, Triticum aestivum
  unsure (1)..(105): unsure at all Xaa locations
  Clone ID: PAT_TA_82930.pep
CRDPRYWEDAEEFKPERFENSNLDYKGTYYEYLPFGSGRRMCPGANLGVANLELALASLLYHFDWKLPSGQEPKDVDVWEAAGLVAKKNXXLVLHPVSHIAPNAN

SEQ ID NO: 188513 - protein, 127 aa, Triticum aestivum
  unsure (1)..(127): unsure at all Xaa locations
  Clone ID: PAT_TA_82931.pep
GEARTCGRSIMVWGLGGCFGGVAVAAVSPXAAGRKQSASEGGAEAKQQQQQRVAPREEEQQAAXSVAGGRKERKKKDGEKASVVVMHXFPFHSRPGLXXNPSVXSXSPFHSSIQVTFAQELXXTWLW

SEQ ID NO: 188514 - protein, 97 aa, Triticum aestivum
  unsure (1)..(97): unsure at all Xaa locations
  Clone ID: PAT_TA_82932.pep
AGFIWRRPRSTTGTCTSGAATTTSTGCPSSACMATATATATHAGSSAPPMNRRRTCPSRHAPCLSPPRPRRRTAPXVPPLXXGKXCXRXISXXVXXW

SEQ ID NO: 188515 - protein, 111 aa, Triticum aestivum
  unsure (1)..(111): unsure at all Xaa locations
  Clone ID: PAT_TA_82933.pep
QVHKQGVALGRSVDLSKXTDYXELQAELDKXFEFEGELVSXSQNWQXVYTDDEGDMMLVGDDPWEXFCSIVRKNYIYTKEEVQKMNSKSAAPRKEDLRQQAAEEVAPPPQR

SEQ ID NO: 188516 - protein, 154 aa, Triticum aestivum
  unsure (1)..(154): unsure at all Xaa locations
  Clone ID: PAT_TA_82934.pep
HETDPEKVKLVTVLSIDGGGVRGIIPATILAFLEEKLQELDGPDARIADYFDVVAGTSTGGLLAAMLTAPGQDHDGRRRPLFDAKDLAXFYIDHSPKIFPQKNWILSKIAGTLRMVRGPKYDGKYLHGLLRXALGDMRLDKXSPTCHPDFDIGS

SEQ ID NO: 188517 - protein, 33 aa, Triticum aestivum
  Clone ID: PAT_TA_82935.pep
TTEGSTIYPPYSLKTYWGFSHFENPAQGAVGSW

SEQ ID NO: 188518 - protein, 83 aa, Triticum aestivum
  Clone ID: PAT_TA_82936.pep
MAGKGGPTNLEKEQMFGMAEKEMEYRVDLFNRLTKTCFEKCVEKRYKEAELNMGENSCIDRCVSKYWQVTNLVGQMLGNQPQM

SEQ ID NO: 188519 - protein, 135 aa, Triticum aestivum
  unsure (1)..(135): unsure at all Xaa locations
  Clone ID: PAT_TA_82937.pep
GMSEAEYRSHFSIWALAKAPLLIGCDVRAMSQQTMGILSNSEVIAVNQDSQGAQGKKVQSSNGLEVWAGPLSNNRKAVVLWNRQXYQATITAQWSSIGLASSTAVTARDLWAHSSFSAQGQLSASVPXHDCKMYV

SEQ ID NO: 188520 - protein, 130 aa, Triticum aestivum
  unsure (1)..(130): unsure at all Xaa locations
  Clone ID: PAT_TA_82938.pep
PFXPPEKXQEHWHRFYSQFLNXSLITPXPEMLLSQRDIXRRGRGXRRGSATRARSTAQRTAAXRLVAPHPREQDRDTPRLPRPRRFRRPVEPPTAAGPHGLGPCSTTSVEETEERGIGARVCAVSLGCSG

SEQ ID NO: 188521 - protein, 69 aa, Triticum aestivum
  Clone ID: PAT_TA_82939.pep
QSANIIYNKCAHNIVCFHIFQFSLQSTRIKGGPQEDIAERVYTKNQVRDENSPGKWLLLDRLFNASSDS

SEQ ID NO: 188522 - protein, 134 aa, Triticum aestivum
  unsure (1)..(134): unsure at all Xaa locations
  Clone ID: PAT_TA_82940.pep
DLHFPTSSPYYHXIXXYXXYSFYSXXLSQLXLTMSRFDYRVFPSXHNSSFFXFSXLSXXSXXPSEXSPSXSXXIARASLPPPXPXPPPXWRXPXRXVSXAGVGRRSXSGXXTEEEGERXQGQGXGRKARGXVGX

SEQ ID NO: 188523 - protein, 79 aa, Triticum aestivum
  unsure (1)..(79): unsure at all Xaa locations
  Clone ID: PAT_TA_82941.pep
LLIRKLPFQRLVREIAQDFKTDLRFQSHAVLALQEAAEAYLVGLFEDTNLCAIHAKRVTIMPKDIQXAGXIXGXRXRPS

SEQ ID NO: 188524 - protein, 129 aa, Triticum aestivum
  unsure (1)..(129): unsure at all Xaa locations
  Clone ID: PAT_TA_82942.pep
ASLPANFKKMLSIQLRGSAAKGKLVKVKASYKLSDAAKKASPKTKAKPAKAAAAKTTAPKPAKAAAAKSKKAAAAKPKKAAAAGTKRKVPEKKVVAXKKSPAAKAKAKPKTVKSPASKKARKLRMRWLL

SEQ ID NO: 188525 - protein, 118 aa, Triticum aestivum
  unsure (1)..(118): unsure at all Xaa locations
  Clone ID: PAT_TA_82943.pep
ACRRGQTGRSGARRDQIRCCCARWQRRSLWFTLLRVKEELMTTTKLGLPIIEPVLCTRRNFRPHLVLISMLDSPPARELIVSREVETKGRVELQRVSLYMEXTCEQXRXGEDCIDLKT

SEQ ID NO: 188526 - protein, 79 aa, Triticum aestivum
  unsure (1)..(79): unsure at all Xaa locations
  Clone ID: PAT_TA_82944.pep
MKYSFAIAALATAVSAQSLADVPKCAIPCLDDAITSKTDCKTTDLTCVCKSFDXVRXAATSCVITKCGSLHEVFLMCLG

SEQ ID NO: 188527 - protein, 138 aa, Triticum aestivum
  unsure (1)..(138): unsure at all Xaa locations
  Clone ID: PAT_TA_82945.pep
HDQLRPFNHTELSDVHRFSAQSPAIQGYQPNSTPRRPLHHLLCPEELPRPPSCSQPCARPPDCTQSPTRTAPTTSAPENCLYGLRLASVDFGTLDQTTTEXGCFVTGKEPCRDLSINRTXXAWSGRVXXXLXXVCXXT

SEQ ID NO: 188528 - protein, 84 aa, Triticum aestivum
  unsure (1)..(84): unsure at all Xaa locations
  Clone ID: PAT_TA_82946.pep
MAFNKIKVSNPVVEMDGDEMTRVFWKSIKDKLIFPFVDLDIKYFDLGLXHRDANDDKVTVEAAEATLKXNVAIKCATIXQIQGK

SEQ ID NO: 188529 - protein, 150 aa, Triticum aestivum
  unsure (1)..(150): unsure at all Xaa locations
  Clone ID: PAT_TA_82947.pep
TSSLHYSLSVLPPCRIRPGHWTPASRSAGRARPCLCIYQRPTPAHRSPSRSTSSPASRCTHRTASSSPRGAAECGSPTSLLPTARSIAARRLPGNSPAIXRXXASPFGASXSLLSRXVASSTYFLYVVSLLKXEXSLCAMGLSAXXGXIX

SEQ ID NO: 188530 - protein, 98 aa, Triticum aestivum
  unsure (1)..(98): unsure at all Xaa locations
  Clone ID: PAT_TA_82948.pep
PVSPIAMLAYLLHAPATAVAVAAAPCASYLRSXPPAKXPFLPSLPRPXSPKRXGEAFAXPPXTRGPHRGVVLQXPLXXWAGGLKFKRGXXGGXGVXEK

SEQ ID NO: 188531 - protein, 101 aa, Triticum aestivum
  unsure (1)..(101): unsure at all Xaa locations
  Clone ID: PAT_TA_82949.pep
QFLXXXDPFXNXYSXKXFQTQXVAXSXXRXTXSSPXELGLAQQLPHMDKVGDFFCKTRYQPISHGFRLFPLLSFIFPVIFPVYIKIGARLSYTLLPRSFTA

SEQ ID NO: 188532 - protein, 106 aa, Triticum aestivum
  unsure (1)..(106): unsure at all Xaa locations
  Clone ID: PAT_TA_82950.pep
NNWDFPWXXHLLLSXXYXGYXPLXSRQCSTSFIVTAMHHNXXLPRVLLPGGFHXRRERRRXXGEGKKRRKNKLYXYAQRHQRGPMLPAPALGLRIHEDADNREREM

SEQ ID NO: 188533 - protein, 165 aa, Triticum aestivum
  Clone ID: PAT_TA_82951.pep
MLWSTIKSFLDPKTASKIHVLGNKYQHKLLEIIDECELPEFLGGKCNCIEGCQRSDKGPWKDPNIIKRVLNDEANYGRQIVTISSIDGKIIRYARPDHPTRKGSDASAESGSEVEDVTSPTASRNLITHPILTPVHEESKLSPHGSTFVAHALLKKHSCCRQGCG

SEQ ID NO: 188534 - protein, 168 aa, Triticum aestivum
  unsure (1)..(168): unsure at all Xaa locations
  Clone ID: PAT_TA_82952.pep
KEGTTLRWPGSRVTWEGFSDASDADLIAEHEIWAAVDPFAKNEAFNCSNGDLFKWKQLWPILAXHFGLEWAGYEGEENRFKLEEAMXXKEAVWAEIVRENDLIATELDEITNWWFXDAMXAVETQLLDSMNKSKEHXFLGFRNTVXSLTXGXKAEXLKLYPNKIAHKL

SEQ ID NO: 188535 - protein, 144 aa, Triticum aestivum
  Clone ID: PAT_TA_82953.pep
GSWPRRFRTSELGGNWSSWAPVPPPRVAHRSRAKLILLVNMPVLIGSTGMMPPATAVNYTTWIIAGFLSGYVVYRYRRHWWERHNYLLSGALDAGLAFMAVLIYLCLGLENVGLNWWGNDLDGCPLASCPTAKGIVVEGCPVYT

SEQ ID NO: 188536 - protein, 84 aa, Triticum aestivum
  unsure (1)..(84): unsure at all Xaa locations
  Clone ID: PAT_TA_82954.pep
MGSETETVNVEGIPFPAEITVGNPLSLLGTGITDIEIHFLXIKYNAIGVTSTTPAGRQTTPTCWATRGKGRRGLAERLLAGRAP

SEQ ID NO: 188537 - protein, 98 aa, Triticum aestivum
  unsure (1)..(98): unsure at all Xaa locations
  Clone ID: PAT_TA_82955.pep
MAPKAEKKPAEKXPAEEKAEKKPRAEKRVPSKEGGEKKGKKKAKKSVETYKIYIFKVLKQVHPDIGISSKAMSIMNSFINDIFEKLAAEAAKLAAARC

SEQ ID NO: 188538 - protein, 76 aa, Triticum aestivum
  Clone ID: PAT_TA_82956.pep
SIILPPLVLSICNIHHHATVFYIESSYNGPAAFSYKTNVYTRQNRLDISKALGSEGLPTPLAKEKPVSTLDWTLCG

SEQ ID NO: 188539 - protein, 59 aa, Triticum aestivum
  Clone ID: PAT_TA_82957.pep
ANSPLQYYSGTLDRSSWPMDLSLANKQERNSRAIHPLLQTLIRKTNPISTCHWNKQNWI

SEQ ID NO: 188540 - protein, 124 aa, Triticum aestivum
  unsure (1)..(124): unsure at all Xaa locations
  Clone ID: PAT_TA_82958.pep
SESICMAEQPSKHGASLQPARWEPKIFSADTFYYGPPSSAXVCPIPWTMSVSNLRRAXTPIVCCAPXAGVTXPSALAISPQRPCIPLHRVPIRSSIHPIPPRAGHAPARXNRRGQGVEGGWIKC

SEQ ID NO: 188541 - protein, 56 aa, Triticum aestivum
  unsure (1)..(56): unsure at all Xaa locations
  Clone ID: PAT_TA_82959.pep
SEATSSAVXDLQSKLDVVTAECLTEKEKNKKLTMENEKLQYRMTHLIRAIKEAESR

SEQ ID NO: 188542 - protein, 65 aa, Triticum aestivum
  Clone ID: PAT_TA_82960.pep
SHPKLENFNHTKHNKTFVRSVSITKQITTLSTFAKEFIFYFCIISTVFQLYYSLYPPIQTIDSSK

SEQ ID NO: 188543 - protein, 144 aa, Triticum aestivum
  unsure (1)..(144): unsure at all Xaa locations
  Clone ID: PAT_TA_82961.pep
MPSQSTHTSSSLSSSTAPILPCSSAXALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSXLRDIPVVICL

SEQ ID NO: 188544 - protein, 142 aa, Triticum aestivum
  unsure (1)..(142): unsure at all Xaa locations
  Clone ID: PAT_TA_82962.pep
REAPPXQQPKKQAVSNVDPSSDSWPFSGARGGVVCRSGHPSDGSQRPRQEAAAGSXRTAGARGTPPRRRRMRRRRGRTTRIRSSCGSPRHRPPPWARPPRQXGGAGCAAAPRLDGAAVAGRGRGRRRRGSCGGGGGSPVPRR

SEQ ID NO: 188545 - protein, 165 aa, Triticum aestivum
  unsure (1)..(165): unsure at all Xaa locations
  Clone ID: PAT_TA_82963.pep
MLPTPDTSHVPYERVYEPAEDSYLLLDTLSSAAETEYLQKAFPDIAPLVVEVGTGSGVVLAFVHAHAQKLFGTREVLTAGVDMNAFACRATVGTVAKAACDNPDSHAFYLGSCMGDLTTPWRXGXIDVLIFNPXYVPRLRCCRQIVADDSSRKSLYDRLYLARWE

SEQ ID NO: 188546 - protein, 90 aa, Triticum aestivum
  Clone ID: PAT_TA_82964.pep
YMAAGAIPIAHKSAGPMMDIVLDEDGHQTGFLASEKEEFTEAIIKVLRMPESGRQEMAAAARKRAQRFSDQRFHQDFTETVRPILSAREG

SEQ ID NO: 188547 - protein, 119 aa, Triticum aestivum
  unsure (1)..(119): unsure at all Xaa locations
  Clone ID: PAT_TA_82965.pep
MSDTDEHHFESKADSGASKTYPQQAGAIRKGGHIVIKARPCKXVEVSTSKTGKHGHAKCHFVAIDIFNGKKLEDIVPSSHNCDVPHVDRQDYQLIDITDDGYVSLLTESGNTKDDLKFH

SEQ ID NO: 188548 - protein, 174 aa, Triticum aestivum
  unsure (1)..(174): unsure at all Xaa locations
  Clone ID: PAT_TA_82966.pep
SRVFSFFPFSQTVALVGESGSGKSTVISLLERFYNPDSGTISLDGVEIKSLKVNWLRDQMGLVGQEPILFNDTIRANIAYGKHGEVTEEELVKVARAANAHEFISSLPQGYDTTVGERGVQLSGGQKQRVXIARPYXEXPRILLLDXARAPDAESNDSDPDNVCGTACGTLHKV

SEQ ID NO: 188549 - protein, 131 aa, Triticum aestivum
  unsure (1)..(131): unsure at all Xaa locations
  Clone ID: PAT_TA_82967.pep
FPWLLVDYTSEKLDFNKSSTXKDLSKSVGALDENRFXSFYYGSHNSSMEIILQYLLRLEPSTSLHLXFQGLPEEFIHINREPLKVNMWPNLHNWIASYQQRVASVHCVLDTLNLQRPPTRNFEHRVGQKKK

SEQ ID NO: 188550 - protein, 64 aa, Triticum aestivum
  unsure (1)..(64): unsure at all Xaa locations
  Clone ID: PAT_TA_82968.pep
LRARGRXTPRXRRCLSXXGVEDQMXPKTPRVSTPAGCXSXPAQPVPSVYIRSSTSASXXPAXRG

SEQ ID NO: 188551 - protein, 168 aa, Triticum aestivum
  unsure (1)..(168): unsure at all Xaa locations
  Clone ID: PAT_TA_82969.pep
MASAAKTLARVGSSLFGRILASPSSSIPRAGLPLARLQPHVPPPAPAXVDAYEAETIARLSSLPGEISFPCGLPSLRFFIDDXEDPVPNDPFQLLPKRXYQPSTIKRXRTHGFXTRKSTKGGRKXIARRMPKEAQILVDLSPDVKRLMCLHVSLRPRKQSHDLWNFFG

SEQ ID NO: 188552 - protein, 100 aa, Triticum aestivum
  unsure (1)..(100): unsure at all Xaa locations
  Clone ID: PAT_TA_82970.pep
LXQSLVFHXASSLPPSXGQNLLPGISCPPLVKFKCTLTRSYACXIQAFSTLSHVSRKHTSEARKIVLQCQQQHSLHQHPSRNECLISRCLKGSISFQTPA

SEQ ID NO: 188553 - protein, 63 aa, Triticum aestivum
  Clone ID: PAT_TA_82971.pep
FIDSGSKPVLLNTREEKILTIDSLLPNRLHYFRIGVANIWRILICRTRVSLEHAQLCASPLLA

SEQ ID NO: 188554 - protein, 110 aa, Triticum aestivum
  Clone ID: PAT_TA_82972.pep
AGSAAAMKVAGVVVVLVEGDMVAEEGVEWVAADERTKCMQTSGVSFNACLINISGKIRAFYVGSSSVTCEVCCFFPWARGLVVSIMHMQVLSCKSSFNFPAAEVVFHFFP

SEQ ID NO: 188555 - protein, 67 aa, Triticum aestivum
  unsure (1)..(67): unsure at all Xaa locations
  Clone ID: PAT_TA_82973.pep
MYSPKPESSFGPNPNSGTHQQQMELTGANMGPGNGANNNTNMAGRQRLRWTNELHERFVXAVTQLGG

SEQ ID NO: 188556 - protein, 164 aa, Triticum aestivum
  unsure (1)..(164): unsure at all Xaa locations
  Clone ID: PAT_TA_82974.pep
KQSAHFYSVDITEKQAKMGLVCRVHSNDKSKFKLLYFELEENGGLSLALQEDSVKVGKVTAAGMYFLGFPVYRFEQNNLAAAAKDSDGAFFXRLDSFQPCDIHXLKPGTHFFAVYGDNFFKSASXTIEVVCGELFCRKGDLRMWRQDTTKRLNFQFEQRKEFSH

SEQ ID NO: 188557 - protein, 70 aa, Triticum aestivum
  unsure (1)..(70): unsure at all Xaa locations
  Clone ID: PAT_TA_82975.pep
HNLIKVXQANVLCIYAQINXSLARTPHWXXNYDLNXKLGLQQFSCKCAGRQMQSKNGVYRACKYKPVFHA

SEQ ID NO: 188558 - protein, 44 aa, Triticum aestivum
  Clone ID: PAT_TA_82976.pep
DDLMQIVVWSQAQEGRLFWPYELSLAGHRNQDIVLISFLVTSLD

SEQ ID NO: 188559 - protein, 89 aa, Triticum aestivum
  Clone ID: PAT_TA_82977.pep
MDHEEVTEFLGQVPLLQCLPGSSIRRIAEAVQVKNYEPGDYVAREGEPVNGLYIIVDGQAEVSALRMRRSKSPRLCVNKTTLVWNNSLL

SEQ ID NO: 188560 - protein, 55 aa, Triticum aestivum
  Clone ID: PAT_TA_82978.pep
SGYNITIIYTNQCLMDKIIGDNSAKSREGNPLTLHLRQANTPVNKIPQKWKKNKR

SEQ ID NO: 188561 - protein, 195 aa, Triticum aestivum
  unsure (1)..(195): unsure at all Xaa locations
  Clone ID: PAT_TA_82979.pep
SLTSLTWLDLSSNNLSGSIPMFLENLTDLTMLNLSFNRLEGPIPEGGIFSNNLTRQSLIGNAGLCGSPRLGFSPCLKKSHPYSRPLLKLLLPAILVASGILAVFLYLMFEKKHKKAKAYGDMADVIGPQLLTYHDLVLATENFSDDNLLGSGGFGKVFKGQLGSGLVVAXSLDMKLEHRSELDVSAKHAWHAPDK

SEQ ID NO: 188562 - protein, 98 aa, Triticum aestivum
  unsure (1)..(98): unsure at all Xaa locations
  Clone ID: PAT_TA_82980.pep
MSGRGKGGKGLGKGGAKRHRKVLRDNIQGITKPAIRRLARRGGVKRISGLIYEETRGVLKIFLENVIRDAVTYTEHARRKTVXAMDVXXALKRQGRTL

SEQ ID NO: 188563 - protein, 68 aa, Triticum aestivum
  Clone ID: PAT_TA_82981.pep
DMPSWLPSNVSLLARFIREPPPIRSTVTKAVAEFKRTHADTWSIQKDAFTEDELEVLRDTSSSSSYFA

SEQ ID NO: 188564 - protein, 47 aa, Triticum aestivum
  Clone ID: PAT_TA_82982.pep
GTGDHVIVDLNYLPSFKEVPNSEAVPAFWDAVRQACESTRGNANVQG

SEQ ID NO: 188565 - protein, 127 aa, Triticum aestivum
  unsure (1)..(127): unsure at all Xaa locations
  Clone ID: PAT_TA_82983.pep
MWAASCLASCCAACACEACRTAVGSIGRRSARIAYCGLFALSLFASWALREVAAPLLQSIPWINHFHKXPDREWFETDAVLXVSLGXSSSHPRRIWPDKGQKTRDRSHGGGGKISGIISPMSRPTGR

SEQ ID NO: 188566 - protein, 94 aa, Triticum aestivum
  Clone ID: PAT_TA_82984.pep
SLRNLSSMILDASELAVFFRSYPPRLYSQPYSMHLLLGNCMFGFQLETELVMNFLLHAEPPPGSEALDVLPIVGPIYVKWAGLARLGTARHRRA

SEQ ID NO: 188567 - protein, 91 aa, Triticum aestivum
  unsure (1)..(91): unsure at all Xaa locations
  Clone ID: PAT_TA_82985.pep
NWGIVFXLFPQXQLTXTTSEHHXGYPLCXAPGXXTYYSGRXLRLTXDIXIPXRRXARLXDGVPECRHRLXXGNLXERRXVVQVHYDXXSGA

SEQ ID NO: 188568 - protein, 110 aa, Triticum aestivum
  unsure (1)..(110): unsure at all Xaa locations
  Clone ID: PAT_TA_82986.pep
MASTGRSMLLSLLLFAVTLSLLEMYRAKFASSELMTIAGGFVCSLLFLLLLTFIGNYQEXSGDRTGWGALLXSTTCTLIVAGTVHRVCITTCSXFPLDPLRVDSLDLRMI

SEQ ID NO: 188569 - protein, 61 aa, Triticum aestivum
  Clone ID: PAT_TA_82987.pep
FFFLVVSLRDHTLQNSGSLGYKRKANTMQCIRMVRTIQILEPSLTRDYTLSTSTDPVSLLA

SEQ ID NO: 188570 - protein, 134 aa, Triticum aestivum
  unsure (1)..(134): unsure at all Xaa locations
  Clone ID: PAT_TA_82988.pep
GNPIMHDNRRPRYLAFFYSNSTSFVASIVVIVMLLPXWLDKNKEWSLKVMNTTIVLDLLALLVAYAAGSSRGWKTSVYVIALIIAVLAYVAIHIMLALLCSRSHAVIPRQRTPGAAILNRSTRGIRHNCCMSTP

SEQ ID NO: 188571 - protein, 71 aa, Triticum aestivum
  Clone ID: PAT_TA_82989.pep
LIKLEYEFNRNGFYVPVHNHFFRKEVQTPGLCIIVAHIHFYQLVSRVLPVFIFIRRFRHSDTVQNSTKQAV

SEQ ID NO: 188572 - protein, 79 aa, Triticum aestivum
  unsure (1)..(79): unsure at all Xaa locations
  Clone ID: PAT_TA_82990.pep
MMGAMFQSVAAAVXPLLXNSVVDLRSPEVAVLVEMLPVXRVPLGSSVAGVSVLPAELISTKPRLCVRSLVPDAKAGKKK

SEQ ID NO: 188573 - protein, 176 aa, Triticum aestivum
  unsure (1)..(176): unsure at all Xaa locations
  Clone ID: PAT_TA_82991.pep
PKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIATSRXLNHLIXNQNEYAWRYSKTLADVKGVXHLYEGKSALEMPLIH

SEQ ID NO: 188574 - protein, 181 aa, Triticum aestivum
  Clone ID: PAT_TA_82992.pep
GTYTTVIISFLRGFGHGAAYYSLDLSGHPLAGVGADVKHCQAKGILVLLSIGGPPNTNTGAGAGYSLPSARAAADLAAYLWDAYLGGSRAGLRRPFGDAALDGVDLYIDQGGVDGHYDELARRLYAYNRSTAARGDLRHGRWRTGPRAQRRSGSFRSAVGTKSLVHGGWKMGRGYRRSRWV

SEQ ID NO: 188575 - protein, 90 aa, Triticum aestivum
  unsure (1)..(90): unsure at all Xaa locations
  Clone ID: PAT_TA_82993.pep
TFNDRFNQGXEAEDKTPGGXLLTETPRRTIIGTVVAVGPGPLDEDGERLALSVSAGSTVLYSKYAGSEFKGADGTNYIVLRASDLMAVLS

SEQ ID NO: 188576 - protein, 146 aa, Triticum aestivum
  unsure (1)..(146): unsure at all Xaa locations
  Clone ID: PAT_TA_82994.pep
MAPPPHRHLLLLLLLLPLVLLAGTPASADDLVSELQSLRARSPSGVIHLTDTSVTRFLSAPSARRPYSVLVFFDAASLHSKPDLHLPQLRTEFALLSGSFLAHNPIPATLFGESIRRVXILHSWVTRCPYRLSSHLIDNPGAPDHA

SEQ ID NO: 188577 - protein, 127 aa, Triticum aestivum
  unsure (1)..(127): unsure at all Xaa locations
  Clone ID: PAT_TA_82995.pep
MHRTYSMRQTRAPTASQLQNPPPPPSSTKSGRLFKSSFGHALRRNAGGAFGPDLAKKLSQLVKMEKNVMRSLEXVARERMEXAQQLSIWGEVVTKISDVTDNSVSLTXGXLETYSPFDSQVTIRYRT

SEQ ID NO: 188578 - protein, 164 aa, Triticum aestivum
  unsure (1)..(164): unsure at all Xaa locations
  Clone ID: PAT_TA_82996.pep
PVSLRNQTVWFHNVLRLLGSAREQRKTMATSLFLVGEIGVNDYFIGLNENRTVGEVRTFVPHVVGAIRSVITDVISAGAGTVVVPGMIPLGCEPQLLTLYRGSVDAAGYDPESGCITRLNDLAQLHNRELRRMLAXLRRAHPARHRIRRLYRASPTSSCPRAYG

SEQ ID NO: 188579 - protein, 127 aa, Triticum aestivum
  Clone ID: PAT_TA_82997.pep
SEFEPRCIRTSYLKQPKSERVKILRQRRLGAEAATLRSHAWCRSSSSAAFLCSVVSLPGIPPQPFKPLIPIHAAQLPHAHQQANKIYVKSTNRESTRIDSSTLLQMYYWLLPALPHRGVDRAEHANK

SEQ ID NO: 188580 - protein, 95 aa, Triticum aestivum
  unsure (1)..(95): unsure at all Xaa locations
  Clone ID: PAT_TA_82998.pep
SPWSSSPVNPLQLWFRFLDRFFRPSWLWIALFLFVWICIRAWADSPPPQAETXLFLMPPQWDLLRVVQYHLFCDHLKAPFVPHLXSLPISTRIAL

SEQ ID NO: 188581 - protein, 120 aa, Triticum aestivum
  unsure (1)..(120): unsure at all Xaa locations
  Clone ID: PAT_TA_82999.pep
MAKPRGGGGLXDLEGHYAFYGAYHSNPVNVGIHELFVWPIFLTALMLLHLTXPSXHAAXISXAVYAAYYXLLDRRAGXLAXLLXYLCWAASGALSARLGFSXGXKVVXVXQLFCWLSIHW

SEQ ID NO: 188582 - protein, 117 aa, Triticum aestivum
  Clone ID: PAT_TA_83000.pep
QDWCNMILYADHSVRMSVASRSIKIQEYHLNTPTSSTQSQTIHYMFYHKNKSTGYLLGPHPCFHYCHALELPKFQRYLMKPMSLALLRKHCLQHMSPYFRIKPWGLAHTRQTLDPGP

SEQ ID NO: 188583 - protein, 153 aa, Triticum aestivum
  unsure (1)..(153): unsure at all Xaa locations
  Clone ID: PAT_TA_83001.pep
ITACIHSYTTHTPRSNASLKEQGRQGCYQXPSXXPTLATALLXTKXXLLRRXXVWPFLLLLLLLLRAPVLLLRLDDXGHVYGXRGCRAGHVGQYLHDSXIVGRSTLCSXTHTWXRKDWVTLQXXSERGSYLTRLLVTRHVAPVTMSRVANPDX

SEQ ID NO: 188584 - protein, 168 aa, Triticum aestivum
  unsure (1)..(168): unsure at all Xaa locations
  Clone ID: PAT_TA_83002.pep
PDPVCXLGFGCVATFPVXPSGLPLSFESXCXRETAASXVSCCSTPLVSPAGPVHVHPPQERHXVAVARGRRLLLLIHCRPEEETGPFHFHHCGAGREVMGATLIARCCCCRGGGGGSTSTGAAVATPRPRLRLSPSPRWLFPYCSSSLALSAIISIDGCHFELGFPYS

SEQ ID NO: 188585 - protein, 167 aa, Triticum aestivum
  unsure (1)..(167): unsure at all Xaa locations
  Clone ID: PAT_TA_83003.pep
RKTQRPKATPPKRPSPTGMAMAPCAPASVSSFPARPVRAPSAVRPRAAAIRATAAAAEGGRWWAPLLGWSGKADYLEAPAPVPAVLQDDDAAAARRXFXGGLTEEKAASCGRXWRKRXLPRPMSTPXRSPSXAPPKRRRRNWRPYIRLXXCXXVPXSGIFSXHVSLS

SEQ ID NO: 188586 - protein, 134 aa, Triticum aestivum
  unsure (1)..(134): unsure at all Xaa locations
  Clone ID: PAT_TA_83004.pep
PTETFTDRPPTSDGPPAPGGPAKGAYVPPTMRGGADRTGDSMRRRNDENSVRVTNLSEDTREPDLLELFRAFGPVSRVYVAVDQKTGSSRGFGFVNFVHREDAEKXINKLNGYGYDNLILRXEWATPRPLAATC

SEQ ID NO: 188587 - protein, 68 aa, Triticum aestivum
  unsure (1)..(68): unsure at all Xaa locations
  Clone ID: PAT_TA_83005.pep
MAAWMRSLLSPLRKLWIRMHSAQNKKGRGIYILYXDVKSCPCEDVHILWSSSSTRPLPPPPLSLRLKH

SEQ ID NO: 188588 - protein, 118 aa, Triticum aestivum
  unsure (1)..(118): unsure at all Xaa locations
  Clone ID: PAT_TA_83006.pep
AGTKVHYSADDALILXQXAQDVLPYLDGRCVYLVXMMXSXXTTXXXILXXMLGYSFFDSDKLVXKAVGISSXAEIFQLHSEXFFRXNESXVLXDLSSXHXLVVAPXRGALIRPINWML

SEQ ID NO: 188589 - protein, 77 aa, Triticum aestivum; identical to SEQ ID NO: 155675
  Clone ID: PAT_TA_83007.pep

SEQ ID NO: 188590 - protein, 154 aa, Triticum aestivum
  unsure (1)..(154): unsure at all Xaa locations
  Clone ID: PAT_TA_83008.pep
MVNHRVTYRRRNGWNTRSNTTRTIRTPGGELRVLHIKKRGTVPKCXDXGXQXSRVPXLRPREYSQXXKPKXTSQRPXGGSRCGXCVRDRIVRXFLIEEQKSQEVLKDXTQRRIMIMVSPWKGRIRSCLGHRKKDDDNRRANGGVASRCTGLMED

SEQ ID NO: 188591 - protein, 73 aa, Triticum aestivum
  Clone ID: PAT_TA_83009.pep
ASPGYYDGRYWTMWKLPMFGCTDATQVINEVEEVKKEYPDAYVRIIGFDNMRQVQCVSFIAFKPPGCEESGKA

SEQ ID NO: 188592 - protein, 112 aa, Triticum aestivum
  unsure (1)..(112): unsure at all Xaa locations
  Clone ID: PAT_TA_83010.pep
XINMVXNXLVGMNSXGVYDTPGGTIXAAAVXELDSXXLXRETMQXXDIIALKYAELVXXGRWFDPLRXXFDAFMENVTXXTXGSXTLNLXKXSVNIXXXKSPXPXHXNTPPT

SEQ ID NO: 188593 - protein, 44 aa, Triticum aestivum
  Clone ID: PAT_TA_83011.pep
LNFHYCSRFLARYRLSCWPGYKSGLSVMFTLFNSLSLLFVMVKM

SEQ ID NO: 188594 - protein, 54 aa, Triticum aestivum
  unsure (1)..(54): unsure at all Xaa locations
  Clone ID: PAT_TA_83012.pep
XTTFSYXLVLGDFEAXLLSQQKLFKGLTARPQVPNLMFKLXIXVMWGFLXXSGV

SEQ ID NO: 188595 - protein, 99 aa, Triticum aestivum
  unsure (1)..(99): unsure at all Xaa locations
  Clone ID: PAT_TA_83013.pep
RVVLKNAPILLLDEASSAIESESSRVVQEALDTLIMGNKTTILIAHRAAMMKHVDSIVVLNGGRIVEQGSHDSLVQLNGLYVKLMQPHFSKGFXQRRLI

SEQ ID NO: 188596 - protein, 100 aa, Triticum aestivum
  Clone ID: PAT_TA_83014.pep
NADAGCRFCCTCIFTQAALYSYTYIYARRPMLSRNPAEATNGFANIGVATDSSESHTATMLRLCWLCLLPWLSRSGFVFSTHLSYMSKLDLVFLCFTPHA

SEQ ID NO: 188597 - protein, 100 aa, Triticum aestivum
  unsure (1)..(100): unsure at all Xaa locations
  Clone ID: PAT_TA_83015.pep
KLSRAELVRLRSQVPAREGAPRFSTYAVLAAHVWRCASLAPGLPADQPTKLYCATDGRQRLQPPLPEGYFGNVIFTATPLXNAGTVTAGVKRASVNPVQG

SEQ ID NO: 188598 - protein, 79 aa, Triticum aestivum
  unsure (1)..(79): unsure at all Xaa locations
  Clone ID: PAT_TA_83016.pep
SWILLSTVETSSYNTKNAISWNSPLVKSNSSSRRXXQKQHIKPLLTRCKDATRGDEAQVQITSHWIPRIHAGSVTDNIT

SEQ ID NO: 188599 - protein, 63 aa, Triticum aestivum
  unsure (1)..(63): unsure at all Xaa locations
  Clone ID: PAT_TA_83017.pep
SIGSQRTPKCDKALNGLVSGLGDHPEKLHQACLVHAFLKRPFSCTVDGCPFSYSRKGXXDNIS

SEQ ID NO: 188600 - protein, 50 aa, Triticum aestivum
  unsure (1)..(50): unsure at all Xaa locations
  Clone ID: PAT_TA_83018.pep
VNNMXSRIINYSLCKQLWDVLETDLMQVSKMSFVCLQRLYLCMNSSPIVP

SEQ ID NO: 188601 - protein, 118 aa, Triticum aestivum
  Clone ID: PAT_TA_83019.pep
SQFKRAATTAAPPDAQLSKDICFALADKAFDPRVLTRISDKLQLHSMADIKKESLALHEMVISSGGEPDACVDEMSSLLKKLKDCVVTEAPTTETPNAQSTSIKHTSPIIPDEFRCPI

SEQ ID NO: 188602 - protein, 115 aa, Triticum aestivum
  unsure (1)..(115): unsure at all Xaa locations
  Clone ID: PAT_TA_83020.pep
XFLAHAXRARHKRTFSEDDRIQXXESTKNVEEGXXSDXSEPXDPMMLQREAXDWXTXDHYKILXLSXYRWXATEDHIKXAHRXKVLKHHPDKXAPXGRTEDDXFFKCIQKAPTPS

SEQ ID NO: 188603 - protein, 135 aa, Triticum aestivum
  unsure (1)..(135): unsure at all Xaa locations
  Clone ID: PAT_TA_83021.pep
ETRPFNQGSRLTAFELVHEKIPATLIADSAAAALMKQGHVQAVIVGADRIAANGDTANKIGTYNLAISAKHHSVQFYVSAPVTSIDLSLPSGDEIXIEERSPKXIAEPEXGWETIAAPVYIWNPLSIYSSXLITA

SEQ ID NO: 188604 - protein, 114 aa, Triticum aestivum
  unsure (1)..(114): unsure at all Xaa locations
  Clone ID: PAT_TA_83022.pep
ATRRIERSSPKGAQRRGVASRVTXPPVPLREXRSALXAXVELXFTAYSERLNGALAALGLXAVLXVELGSGQALVKYHQPATLFLQAYTVAAAXALFVKYXKERISTWPGPPAK

SEQ ID NO: 188605 - protein, 82 aa, Triticum aestivum
  unsure (1)..(82): unsure at all Xaa locations
  Clone ID: PAT_TA_83023.pep
MNGNMAMLNTTTSTIVSTGSPNMSAEFSCQNLKYTAPLAVEWSYPELQLLNDGLNKYANEPGIMNYIKIAATLPDKTXRMLP

SEQ ID NO: 188606 - protein, 158 aa, Triticum aestivum
  unsure (1)..(158): unsure at all Xaa locations
  Clone ID: PAT_TA_83024.pep
AMDAAALESLILDLHAIEVVKLGSFTLKSGIKSPIYLDLRALVSHPRLLSAVASLLHALPATRPYGLVCGVPYTALPIAAVLSVDRSXPMLMRRKEVKXHGTPIHRGSFSPGTRLIIEDSSHGLRARDAPARAEGLSRRVSRRRGGRRLWIRITTSVA

SEQ ID NO: 188607 - protein, 56 aa, Triticum aestivum
  Clone ID: PAT_TA_83025.pep
FFFLIIIIIIIIIIIKENFFHSLNSTLFSRSSRALDLQQFNRSTTCRQKHSTRGTE

SEQ ID NO: 188608 - protein, 92 aa, Triticum aestivum
  unsure (1)..(92): unsure at all Xaa locations
  Clone ID: PAT_TA_83026.pep
SSMALSSMFKRINVKDLTSKVSVYTSATELSGGLNMIFXRWATKRTAGQQKMVAIPIQSIGGKEFGGEKYYKEHQCPPKXDRFIWKHLDGKI

SEQ ID NO: 188609 - protein, 157 aa, Triticum aestivum
  unsure (1)..(157): unsure at all Xaa locations
  Clone ID: PAT_TA_83027.pep
IRACARXPDSRRXCRASXPCACGSTFERAGFLVGGXLLRVVVARSVCPGXGDRTPKEGSWNGEDEXALXHGLAVGXFVKXSLXECSALGHCRFCCSNRRSGPAPWAQVRARKSAGALEQAEQGGHGFERGPTHEAAESGAPPVARRRPGGDERQQHH

SEQ ID NO: 188610 - protein, 154 aa, Triticum aestivum
  unsure (1)..(154): unsure at all Xaa locations
  Clone ID: PAT_TA_83028.pep
MAMAKATILATFAAVAALAAVQLAAAADHPVGGDGSWDASGTTGYDAWSAKQTFKQGDTLSFKFVPSHDVTEVSKAGYDACSGSNPXSYTGGSASVNFGPRKRYXICSVPALPAGMNWSHVAAAXVAAARPRKTQRHRDFPRPGPRWHDNPRVS

SEQ ID NO: 188611 - protein, 116 aa, Triticum aestivum
  unsure (1)..(116): unsure at all Xaa locations
  Clone ID: PAT_TA_83029.pep
MXNPLXGLXDHXKLXRDYXLEGLYDTSIIFFNXAIXQINKHLTTLDDALXRTKWMNCKIAISEXVEIVKXLXAXLNXXXTPGTXRSSSXPXXSXIICFQXLDXYHLTSTFDIAQQM

SEQ ID NO: 188612 - protein, 67 aa, Triticum aestivum
  Clone ID: PAT_TA_83030.pep
SFPLVSVVLRWLWLPSSASEIPTCLDHLSFSSLILSFLQNVIQWRCLQQILVSLLLPPLLALRAMRS

SEQ ID NO: 188613 - protein, 74 aa, Triticum aestivum
  unsure (1)..(74): unsure at all Xaa locations
  Clone ID: PAT_TA_83031.pep
QVRARXXRXIINXXSXSLCNVVASRXVTXCXITCLKDXTAXNGFLPLXCMHVIYNSVHASIIYISPIGDXCNIF

SEQ ID NO: 188614 - protein, 57 aa, Triticum aestivum
  Clone ID: PAT_TA_83032.pep
KCSENLNTRSLISCALKMSDGILILNLQEEFPFNECANQSFKYFCPLLLHVLDLKSA

SEQ ID NO: 188615 - protein, 197 aa, Triticum aestivum
  unsure (1)..(197): unsure at all Xaa locations
  Clone ID: PAT_TA_83033.pep
PFRRGFHFVFVPPIASPPSNSTRFNPTTASPSRSPPLPSLSLPYKKPSPGASIETQSSPIRRLEPRSAGRSTRGWDRIGSEQRGTDQNPPATTMGPXXCRLVPVLPCNAWRAXPELPVHTXSXRRXPRLSPSPLLIFNRNDRRTVDRLLSNSPSXLKLSXLTHMTSNPTAVGSHDTQRXRHTTLXSPLXFKGQGHSX

SEQ ID NO: 188616 - protein, 153 aa, Triticum aestivum
  unsure (1)..(153): unsure at all Xaa locations
  Clone ID: PAT_TA_83034.pep
GGYFPNRPTTIRKSMPVEEEAGRDEEMKKFLKQPETTLLDMLPTQMQAIRVMTTLDILSSHSPDEEYMGELAEPSWLEXPMVKAAXEFXGRMKEIXGFIDECNNNPDXXNRCGQDXAXXMLNPSPTGITGRPNTPLTLVSHPMGLPMLTYCWE

SEQ ID NO: 188617 - protein, 73 aa, Triticum aestivum
  Clone ID: PAT_TA_83035.pep
FIPINFLHQSISSSTNNHSRCYFSPTQQQQRLGASWFYMTLTRRPSGKKKADSHLLVCLFVCCSFVVFRNPPN

SEQ ID NO: 188618 - protein, 131 aa, Triticum aestivum
  Clone ID: PAT_TA_83036.pep
RVLLAGDPSRLKGSLPHVPSLTERKKADIDAFARRLQGITKSISRYPTSKRRFDVLVKALLSELERTMGQSGNGSQSQAQRLRNSVARMLTKKLWARLPTLGMKTQNADDEMSRTRDLLFDDPTSIHLVQR

SEQ ID NO: 188619 - protein, 144 aa, Triticum aestivum
  unsure (1)..(144): unsure at all Xaa locations
  Clone ID: PAT_TA_83037.pep
MAAAWEVLAVLLVAAQVASAAQVTAPAFLWAPKNYGFSSDDAKEVVHYQTISPKSLAKSVLXEGGWXNFMCSREDTQNNVDVXIVFIGLKLQSSDISKETIHFTDTLNSLPRFQGSLVPHIEKTKCITCETCNHPKTVEIHSFR

SEQ ID NO: 188620 - protein, 76 aa, Triticum aestivum
  Clone ID: PAT_TA_83038.pep
HPDIGISSKAMSIMNSFINDIFEKLAGEAAKLARYNKKPTITSREIQTSVRLVLPGELAKHAVSEGTKAVTKFTSN

SEQ ID NO: 188621 - protein, 108 aa, Triticum aestivum
  Clone ID: PAT_TA_83039.pep
KWVPCLEFSKVGFIFREHNASPGYYDGRYWTMWKLPMFGCTDATQVINEVEEVKKEYPDAYVRIIGFDNMRQVQCVSFIAFKPPGCEDPARPKQSLTTGIYKHCILST

SEQ ID NO: 188622 - protein, 107 aa, Triticum aestivum
  unsure (1)..(107): unsure at all Xaa locations
  Clone ID: PAT_TA_83040.pep
RLPASLRCGRTAMRWLSRLLSQAVAARRASAAARSNTSLVKGGSHGFASGGRDGSPEVPREWLRKLWVDELKKQKEXARRWGVGSSLXVAGATXEAPSRTISTNTAV

SEQ ID NO: 188623 - protein, 67 aa, Triticum aestivum
  unsure (1)..(67): unsure at all Xaa locations
  Clone ID: PAT_TA_83041.pep
TLSXTXRXAACIACTAXNXYHQRRRXDHRRXPCRHLQAAGPXSAXADDDXREGEVXLLXGLQXXXPG

SEQ ID NO: 188624 - protein, 95 aa, Triticum aestivum
  unsure (1)..(95): unsure at all Xaa locations
  Clone ID: PAT_TA_83042.pep
RGGPCTDRRGSRWRENVFRFCTALRGLGSIMILLVLAIVGVTYYAVVLCNYGPPXSPAAAHSRRLAVLLLLHFCCYLYGLFSVVLMTWSFHKWLI

SEQ ID NO: 188625 - protein, 111 aa, Triticum aestivum
  unsure (1)..(111): unsure at all Xaa locations
  Clone ID: PAT_TA_83043.pep
MATTLSSTVVVALGAPLFLLLVTCGSCARPVSFNASDLTADPGWDAARATWYGAPTGAGPDDDGGACGFKNVNLPPFSAMTSCGNXPCSRTAXVRSCYQIRCQNTGCPTKT

SEQ ID NO: 188626 - protein, 97 aa, Triticum aestivum
  unsure (1)..(97): unsure at all Xaa locations
  Clone ID: PAT_TA_83044.pep
TGRPPSNLPANYYLVDTDSMPSRNIYRVFITSKYVNSCSLLLAGSAFCLICKLRKMLVVATTXEPSHALICGSLCETRMQHVINEKHRLALQCGLVT

SEQ ID NO: 188627 - protein, 96 aa, Triticum aestivum
  Clone ID: PAT_TA_83045.pep
GEQGEFIASGSDDGRWFIWEKRTGRLIKMLAGDGAVVNCIQSHPFDCAVATSGIDNTIKLWTPDANATSMVSGPELDVLSAIENNQQKAYKVTVPT

SEQ ID NO: 188628 - protein, 111 aa, Triticum aestivum
  Clone ID: PAT_TA_83046.pep
AAASTPPPASQCLPTALRARQATSRSRSRIQTNQYITTMVLDSLSSPHRRSQNTFFVSSAKKPQSSRDDSWSALVERHRFLLTTLLVLAFLCTVYLYFAVTLGGIRCLHWD

SEQ ID NO: 188629 - protein, 123 aa, Triticum aestivum
  unsure (1)..(123): unsure at all Xaa locations
  Clone ID: PAT_TA_83047.pep
PPXELLHMDXFGPNACKVSVXSFGLVIVDXFSRFTWVFFLDDKSQVXKIFKNFARKAQNQFEVKIKKVRSDNGTGFKNINVDTFLDEEGISHEFSVTYTPQQNGVVQRKNQTLIEMARTMLDE

SEQ ID NO: 188630 - protein, 114 aa, Triticum aestivum
  unsure (1)..(114): unsure at all Xaa locations
  Clone ID: PAT_TA_83048.pep
KLXSEPKSQTMRLTVFLSHYSMEIXVPISLARYWIREWWKWIVLGLSFTRRTLRWSSRTITAWSRSWRVATWSSRRRLNLRSSSWSGRRVADWNGSPAAVYHLPFALDRHTSTN

SEQ ID NO: 188631 - protein, 100 aa, Triticum aestivum
  Clone ID: PAT_TA_83049.pep
ALRSVASSLPHLAAPIQARAPSARREVVRWSSCSSSRCRCSYSSSSSPSSSASSAARLAERPQRRRRRFSPVRLCSLHSASCDPTIPCVSADLTLYYSMT

SEQ ID NO: 188632 - protein, 123 aa, Triticum aestivum
  unsure (1)..(123): unsure at all Xaa locations
  Clone ID: PAT_TA_83050.pep
EGATSFLFTEYQYVGXFMSIFAVVIFLFLGSVXGFNTKSXPCTYSKDKYCKPALFTALFNTVSFLPGAINSPGLRFPGMXIATYANAKTNLETKKGVCKXFXNAFXPGAVKGSCNWWSVTIMY

SEQ ID NO: 188633 - protein, 76 aa, Triticum aestivum
  unsure (1)..(76): unsure at all Xaa locations
  Clone ID: PAT_TA_83051.pep
MVKHNNVIPNGHFKXHWXNYXXTWXXQPARKQKXRIARQKKXXXISPRPNAGPLXPXVQCQTLKXNMNQRLGKXYL

SEQ ID NO: 188634 - protein, 120 aa, Triticum aestivum
  Clone ID: PAT_TA_83052.pep
SSVHSLHGKEIMIPASVALAAPTYMVCAAALARAVALATDRLGPVRHGSAATQRMSNVATAHGVGEARLRQQPTDVERPDGAGRRRQLAMAHQRDKRQAAGVNSPSEEEDGEPGPSLPRR

SEQ ID NO: 188635 - protein, 121 aa, Triticum aestivum
  unsure (1)..(121): unsure at all Xaa locations
  Clone ID: PAT_TA_83053.pep
HAELLLLGYAPWCERNRAXLMPRFAEAAAALRAMGSAVAFAKLDGERYPKAAAAVGVKGFPTVLLFVNGTEHAYHGLHTXDAIVTWVRKKTGEPIIXLQSKDSAEXFLKKDMTFVIGYQEF

SEQ ID NO: 188636 - protein, 84 aa, Triticum aestivum
  Clone ID: PAT_TA_83054.pep
MSKQGGKAKPLKAPKADKKEYDETDLAYLQKKKDEEKALKELKAKAQKGAIGGSGLKKIGKEMRLASPIPKRMISTVYCVALTM

SEQ ID NO: 188637 - protein, 59 aa, Triticum aestivum
  unsure (1)..(59): unsure at all Xaa locations
  Clone ID: PAT_TA_83055.pep
KFTAGTLEKGRXPSFYCYTGKIQYSQFTQNVRSNHVAAQTIFMSLRKNIREKKVIANLK

SEQ ID NO: 188638 - protein, 70 aa, Triticum aestivum
  unsure (1)..(70): unsure at all Xaa locations
  Clone ID: PAT_TA_83056.pep
PXXGEPNITRFXVIIEXIXDXCREXEASTXLQEHAXLEVAPRPPPLLXQSHTLXHHKQAXTKVRRGTHLL

SEQ ID NO: 188639 - protein, 169 aa, Triticum aestivum
  unsure (1)..(169): unsure at all Xaa locations
  Clone ID: PAT_TA_83057.pep
MAASARTLVTVRALEGDMATDSAGVPLADVLRAPIRPDIVRFVHKLLSCNSRQPYAVSRRAGHQTSAESWGTGRAVSRIPRVPGGGTTAPARSVRKCSXXTHFAPTRLARWTSRQIHFPCRNAPHLGNAFLLVSTCTXDLAXSAGXRSIRTKHNISLVQKGRIFEPPGK

SEQ ID NO: 188640 - protein, 97 aa, Triticum aestivum
  Clone ID: PAT_TA_83058.pep
DTEDDDYYDQCQACSYRAGHGQCRTIVSDNGFQCYCSDGVYSTTACGTKRANWKTTIVVESKRELNQECSIYIGLSCMEAITESRISIYIDLSHFEG

SEQ ID NO: 188641 - protein, 119 aa, Triticum aestivum
  unsure (1)..(119): unsure at all Xaa locations
  Clone ID: PAT_TA_83059.pep
AVKAAGLQMDDIDLFXEINEAFASQYVYCCKKLKLDPAKVNVNGGAMALGHPLGATGARCVSTLLNEMKRRGKDCRFGVISMCIGXGMGAAAVFERGDGVDXLTNARGTRPQLVSKDPC

SEQ ID NO: 188642 - protein, 103 aa, Triticum aestivum
  unsure (1)..(103): unsure at all Xaa locations
  Clone ID: PAT_TA_83060.pep
FFFYPDMISFITKQWGSRCPDIATFKGERDSQSLNSNTSTGMSHRLNARHKANRFSIHQNYFSQCLGFHSIPGALLCSCLVLGFLYFQDLLDNLLLLNPXKHG

SEQ ID NO: 188643 - protein, 123 aa, Triticum aestivum
  unsure (1)..(123): unsure at all Xaa locations
  Clone ID: PAT_TA_83061.pep
NNVSNVAASASGKLSGTSGAVTAVFHNSIYQGSLPVPSKANALEHLLVYSPSGHVIQHELLPSSGSESSGSSPRLGQVXNLQLQDDEMHVTAEPIKWWXVFRXTNWPXRDENMPTCMYNQRTL

SEQ ID NO: 188644 - protein, 164 aa, Triticum aestivum
  unsure (1)..(164): unsure at all Xaa locations
  Clone ID: PAT_TA_83062.pep
MTNYEQIAKEAEMDLNTYQAKTGNARPQDIEGAGVNPHAENKFESAQVEFGDELSTNAGYNKRIPPSEGGIVDDKGRXTRGQHYEGEGGLSTTRQNDERGGTMTTMLSAPTHKTPARAADIRLQGQELRRKRRNLRPGGLSQGDTTAEISEDPLGKLSTCIETT

SEQ ID NO: 188645 - protein, 80 aa, Triticum aestivum
  Clone ID: PAT_TA_83063.pep
RGREDQGDVLPHLFLKISWGNPRWLHSRSCLVHFFFFDEGACCSSRGVGSSSTSTFTLIIMLPRHSHDLIRNFLSKDVCF

SEQ ID NO: 188646 - protein, 113 aa, Triticum aestivum
  Clone ID: PAT_TA_83064.pep
SIHGFTTGLKLEQFIFDAFTYSPSTELFEVMREEEFAPVKNANGATYDTPDSAKLMLLRLHSRWVVAAGGFLTHSVPLYMTGVEVSPLSSYAGENLEAICRGRTFHAPSEISF

SEQ ID NO: 188647 - protein, 150 aa, Triticum aestivum
  unsure (1)..(150): unsure at all Xaa locations
  Clone ID: PAT_TA_83065.pep
AGCLTGDCEGRLACNGSVGAPPATLVEVSLHEDAPKGSSYDVSLVDGYNLPVAVSAKPATGGADPNKCAIAGCAKNVNAVCPPELQVTATGSGGGKTVVAFKSACLAFGXDAFCCRXAYRPGTXEGRVSRLSTLPAYKLSTHAATATVVE

SEQ ID NO: 188648 - protein, 55 aa, Triticum aestivum
  unsure (1)..(55): unsure at all Xaa locations
  Clone ID: PAT_TA_83066.pep
PPPPSSSSVDQRAGRXKKRSMASNYVDTTGEEGXFHGPHXHXTSTTPTGGXXXPT

SEQ ID NO: 188649 - protein, 182 aa, Triticum aestivum
  unsure (1)..(182): unsure at all Xaa locations
  Clone ID: PAT_TA_83067.pep
VDLIMAIVEQFMSHHSDNGKMTFQDDDEIVEVEKFASVSSTSKLAVAKLIDEYLGEIAKDPNLPVLKFIALAEMVSASSRQMHDELYHAIDMYLKEHPSLSKSEKKRLCGLMDCKXVQEACMHAVQNERXPLRVVVQFPLEQSEHQPLCKSDSGATSSRHRSPEDGYLKAHTQRREWIHITL

SEQ ID NO: 188650 - protein, 138 aa, Triticum aestivum
  Clone ID: PAT_TA_83068.pep
RNPQYDMTNNSHCLAVENWHHNKPTQNNVLNPHGVNLDLKISSCSCPLLIWKTVRVKQPMDNLISSHHHGDVFMLVESCRRPQNSTMRCNRSQSPAVSVSPTPPVLVSAQHAPSAMSLQPPHSVPSPEASYPFYASPN

SEQ ID NO: 188651 - protein, 100 aa, Triticum aestivum
  unsure (1)..(100): unsure at all Xaa locations
  Clone ID: PAT_TA_83069.pep
VTLGLEPGEAFTIRNIANMVPSYCKNKYAGVGSAIEYAVCALKVEVIVVIGHSRCGGIKALLSLXKDGARRPFHFRPRTGQDWFPGKEXVQTXCASMPFR

SEQ ID NO: 188652 - protein, 76 aa, Triticum aestivum
  Clone ID: PAT_TA_83070.pep
RAAGAEYGSGSSRDWAAKGPMLQGVKAVIAKSFERIHRSNLAGMGIIPLCYKAGEDADTLGLTGHERYTVHLPTNV

SEQ ID NO: 188653 - protein, 94 aa, Triticum aestivum
  unsure (1)..(94): unsure at all Xaa locations
  Clone ID: PAT_TA_83071.pep
CVXSMXMXQWRFVRCXXXKLLFEAKSGXCHNVCYPXEVIGCLDEXLXVLAXSGVPNMSKXCVGMVPLYYDFVGPVKPSLQYGSTPCSGLLLLCN

SEQ ID NO: 188654 - protein, 83 aa, Triticum aestivum
  unsure (1)..(83): unsure at all Xaa locations
  Clone ID: PAT_TA_83072.pep
XSXXXNREXDTKXPIVQGVWIKXCSTQTGVVVRTQFXYYNITIERCLTARVNTSNTTTTILSSTPFIPCSQKGEVPADYSVIK

SEQ ID NO: 188655 - protein, 66 aa, Triticum aestivum
  Clone ID: PAT_TA_83073.pep
EVSQKGKEILTSYGEIARNTTLGLIYCLFLFLSFSHSLYRRKKVVYIYSRGRDLINISDLLYLQYQ

SEQ ID NO: 188656 - protein, 85 aa, Triticum aestivum
  Clone ID: PAT_TA_83074.pep
LSSRGRARPAILQLPLLSSTQGLLNKPNGYSYPNGRNKWEMARRCQGASSRRLMLARQSKSLQNSRQLNANHNFSPRSNREHSPP

SEQ ID NO: 188657 - protein, 81 aa, Triticum aestivum
  unsure (1)..(81): unsure at all Xaa locations
  Clone ID: PAT_TA_83075.pep
HVSGLTNGALLLMPTSVHLQCATKFWVVPTNMNIRFFLSDIAQXQNXYCTDIDSTHXNTDFEYIELSRIQSHIVPIQRXTX

SEQ ID NO: 188658 - protein, 118 aa, Triticum aestivum
  unsure (1)..(118): unsure at all Xaa locations
  Clone ID: PAT_TA_83076.pep
TLESWVYRRHRRPRCPLAGSPLSSNAGGQPLGIFPGXFSMXHHRKRALDLXPQCLLDDLLASMAPVPCNNCSFCHPPNPSSAPAVPLLADPLVLRLRPSSVVASMGVERRKKRRSYEF

SEQ ID NO: 188659 - protein, 170 aa, Triticum aestivum
  unsure (1)..(170): unsure at all Xaa locations
  Clone ID: PAT_TA_83077.pep
KRREKKRGEPYVDEEIRVALXGXYPKGEQTLXWLAAAVVRRLXVLWGPSXRPPLXGRSWXQQDRXGLRSSAASPRDSSSASXTGRPRRVLGTSRRSSSSLLLGGASCSTAGVSSGPAGAAASASAAGSAAAGSSAPAGAAASGSAAACCSAAGSSSGSAGAAASASASAS

SEQ ID NO: 188660 - protein, 65 aa, Triticum aestivum
  Clone ID: PAT_TA_83078.pep
RVPVQTTRCPHLDVKRDPDALSRQPCSSIPCSSRSIRGCLGTNFSAFWEEYCIISNTALLYKKKK

SEQ ID NO: 188661 - protein, 174 aa, Triticum aestivum
  unsure (1)..(174): unsure at all Xaa locations
  Clone ID: PAT_TA_83079.pep
YLRACAQERGSELLAVGGAEEIAVRAAMEKPRQVARKFLARPQHEGAGAVVRRSIGRFELRYFDPFLVLDXFTVSAPAXXPDHPHRASRPHLHALGPLYARRLXGHRGHQAGTXLVTAGRGSSSXXPRPGLQGCTLNSLQRSTRVQDSNKESVRRERGSRASGTPRQTHIPRRG

SEQ ID NO: 188662 - protein, 114 aa, Triticum aestivum
  unsure (1)..(114): unsure at all Xaa locations
  Clone ID: PAT_TA_83080.pep
KAVADYKVYTASSVVDLLHFVAPRMMXRGNVHFSYGIADNLDDPKYQHYKYWSNPLXEXKLPNAPDMEIXSMYXXRIPTERAYVYNWPTRMLYTFPNDTSAEGGEENTAKGTPW

SEQ ID NO: 188663 - protein, 123 aa, Triticum aestivum
  unsure (1)..(123): unsure at all Xaa locations
  Clone ID: PAT_TA_83081.pep
TIXXTFMTPASGLQASVKRHPDLALFKIPXESPQGTKFKDVSFAQFERDVKQTAKYWKDKLSNVGVEDRAVVXVWLRGYAYSDTVHIQGLNWAGYIPQLLSLRMTDPTVIYELLQNPTRWLIA

SEQ ID NO: 188664 - protein, 99 aa, Triticum aestivum
  unsure (1)..(99): unsure at all Xaa locations
  Clone ID: PAT_TA_83082.pep
QXGVRXXELXXFRGSILTPVXSXHPPPFXSSXTXYAXWHGFILYPCXSGEPGRSXSVAAQMSEKIGATPRRQELAADREQGRGTFDYMPRTAKSAFTGR

SEQ ID NO: 188665 - protein, 104 aa, Triticum aestivum
  unsure (1)..(104): unsure at all Xaa locations
  Clone ID: PAT_TA_83083.pep
SILAKCTLGPAGTQVHLYFTWSNSRKQTRADEYCPLRQFKQEHFVHLSSIFQFTLQICSGIRLTSCRSIPCSRHIPTADNXTLSQRSDTVFTKLLXYQATTISL

SEQ ID NO: 188666 - protein, 134 aa, Triticum aestivum
  unsure (1)..(134): unsure at all Xaa locations
  Clone ID: PAT_TA_83084.pep
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKXKNIKHSGNIASTLIRSPRHAKSHGKDWRDLKEIWGLVR

SEQ ID NO: 188667 - protein, 156 aa, Triticum aestivum
  unsure (1)..(156): unsure at all Xaa locations
  Clone ID: PAT_TA_83085.pep
VVLVVAGDGVDLGAIEAEVSKQCNALPRGEFASKALSHSFTVFAKDMVEAISFSNLYAPEHLIINVKDAEQWEEFIENAGSVFLGQWTPESVGDYASGTNHVLPTYGYARMYSGVSLNSFLKYITVQSLTEEGLRXLGPYSRNGEVEGLXPQETLP

SEQ ID NO: 188668 - protein, 101 aa, Triticum aestivum
  unsure (1)..(101): unsure at all Xaa locations
  Clone ID: PAT_TA_83086.pep
IKGQNLAQNAKGTNKPVNIKVLSFGPNQRSSEMTILHRKRGGHSFIDLRTYLWVYDTWAQRVDGNCHTAKKCSRGQDNGTPHESCIPLHIXSAINIIXHYH

SEQ ID NO: 188669 - protein, 120 aa, Triticum aestivum
  unsure (1)..(120): unsure at all Xaa locations
  Clone ID: PAT_TA_83087.pep
FXCSXSLPXQPSPSDXEPCFRLXFAASPSSFCCRCSSIGSSSLDPERISDSRKLARPSTSSSSSLSPPLMGSPPPPSSVSKGPSSGKASSSRTASLSPCTSAILLHRSDTTDGSPHRHRP

SEQ ID NO: 188670 - protein, 135 aa, Triticum aestivum
  unsure (1)..(135): unsure at all Xaa locations
  Clone ID: PAT_TA_83088.pep
PSSPPSPPSNPRNERAGEEVPLSEMARVFRGSLLLMSPAAAAAAAAAAGAKKAASTKPRAPAGITKPMPVSEAFRRFAGGAREVARSEAIKLVWTHIKAHGLQNPSNKTEINCDATLKXLFGGKDKXGMMESRSY

SEQ ID NO: 188671 - protein, 45 aa, Triticum aestivum
  Clone ID: PAT_TA_83089.pep
SSFILGFKCAVVVNDWNFCFSLVPIRSRVDFHSCNLQILYEEMIQ

SEQ ID NO: 188672 - protein, 58 aa, Triticum aestivum
  Clone ID: PAT_TA_83090.pep
NDIFEKLAAEAAKLARYNKKPTITSREIQTSVRLVLPGELAKHAVSEGTKAVTKFTSS

SEQ ID NO: 188673 - protein, 92 aa, Triticum aestivum
  Clone ID: PAT_TA_83091.pep
YAFWASFESCCWCGTVEVGCGLQGWLVYSLLALTVYLSFFSHLVACIIKLLSFLYIVMNVAMPFISNADAIYEFLSLYVCIDIVMNAANVLI

SEQ ID NO: 188674 - protein, 60 aa, Triticum aestivum
  Clone ID: PAT_TA_83092.pep
SLFPDIIVHSTNQFQQNVTQGVSGRQQAWTRRYTNQNTSAMPPTHIQHSHPFLLSVSTRT

SEQ ID NO: 188675 - protein, 96 aa, Triticum aestivum
  unsure (1)..(96): unsure at all Xaa locations
  Clone ID: PAT_TA_83093.pep
RFSATDPAQXVIYVPCCPLPIGXVFMAICQIPITGTGINPARXLGAAVIYNNDKAWDDHWXFWVGPFIGAAIAAAYHQYVLRASAAKLGSSASFSR

SEQ ID NO: 188676 - protein, 64 aa, Triticum aestivum
  Clone ID: PAT_TA_83094.pep
ACHRTIQQTTQEKHVNVKRKDWQDSEAFFRSKEGLSVFCTDNSTTCYIPQPFNNFWVLQLALRH

SEQ ID NO: 188677 - protein, 41 aa, Triticum aestivum
  Clone ID: PAT_TA_83095.pep
IVHDQAKKLYPLNSKLLRRDEQAAFLRISNHSSQPLIISSF

SEQ ID NO: 188678 - protein, 57 aa, Triticum aestivum
  Clone ID: PAT_TA_83096.pep
MKEGTANCIDILIAIILPPLGVFLKFGCKVEFWLCLLLTFLAYLPGIIYAIYVITKD

SEQ ID NO: 188679 - protein, 68 aa, Triticum aestivum
  Clone ID: PAT_TA_83097.pep
LASCLLHKFFARPPSTRPSNNVKLVGAGGGQFELLLVFRGPVLGFQLVVGGAEQLAHRLQRPAAGLRE

SEQ ID NO: 188680 - protein, 169 aa, Triticum aestivum
  unsure (1)..(169): unsure at all Xaa locations
  Clone ID: PAT_TA_83098.pep
AESQLLCVPANASSPAAAAASPLSASRSRSEHAAAGVGAHRRPSCRMDMAPAAVSSNPRSVEEIFKDFSGRRAGLVRALTSDVDDFCSFCDPDKENCVSTASQRSWEARRRRTSSPDXPTGLWKXFAPMACSPXWSXRRGXSDRAIXSPSLXAAQRQXGXLSHIMISSS

SEQ ID NO: 188681 - protein, 46 aa, Triticum aestivum
  Clone ID: PAT_TA_83099.pep
LRTERTEKEKIQGKKRMALQHQPCRGIPVTHSQRTTWPIAFVSKER

SEQ ID NO: 188682 - protein, 145 aa, Triticum aestivum
  unsure (1)..(145): unsure at all Xaa locations
  Clone ID: PAT_TA_83100.pep
GGPHHRSKVHGGGAPSKNLMAERRRRKRLNDRLSMLRSIVPKISKMDRTSILGDTIDYVKELTERIKVLEEEIGASAEDLDLLNTLKASSSSGSNEMMVRNSTKFDVERRGNGSTRIEICCATNPXVLLSTVSXLXVLGLEINAW

SEQ ID NO: 188683 - protein, 115 aa, Triticum aestivum
  Clone ID: PAT_TA_83101.pep
KTAPSGFAAAYATGTELSLYLTTLFLGPAIVPSHVTTHWLLFSIRIMEAFDTHSGYHFPFSLARFIPFYGGAEFHDYHHYAGEKTRSNFSSVFTFCDYIYGTNKGYMYHKRSLPS

SEQ ID NO: 188684 - protein, 101 aa, Triticum aestivum
  Clone ID: PAT_TA_83102.pep
LLTNWTIYTNKAAAVATLLSVAAVNLVLGVLPHVDNLAHLGGFLAGFLLGFVVLMRPHLGWMERYGLPAGAPAPQGTPYKWTSRRRISPDRRMACLRGQSN

SEQ ID NO: 188685 - protein, 153 aa, Triticum aestivum
  unsure (1)..(153): unsure at all Xaa locations
  Clone ID: PAT_TA_83103.pep
LQTGPRPLTPRRSFFFGGSLAPDAAFYRSIVGALQYLTLTRPDCXYAVQQVCLHMHSPRDSHWTLVKRILRYIHDTMTMGLTLTASSSIDMVAYSNADWAGCPDTRHSTSGYCIYLGPSLISWSSKRQPTVSRSSKVAEYRAVANAVAECCWL

SEQ ID NO: 188686 - protein, 131 aa, Triticum aestivum
  unsure (1)..(131): unsure at all Xaa locations
  Clone ID: PAT_TA_83104.pep
MKGKADTSKKDEGRLRAGGAAGKRKKAAASGKPKRPPSAFFVFMSEFRQEYQALHPGNKSVATVSKAAGEKWRAMSXREQPYVDQAGQKXQDYEKTKXNFDKKETQXKEAKTXDEDXRIRGDDKMHSDKKT

SEQ ID NO: 188687 - protein, 144 aa, Triticum aestivum
  unsure (1)..(144): unsure at all Xaa locations
  Clone ID: PAT_TA_83105.pep
MATDVAETPAPLVDAAPEAPADAPAAPAADAKPAKAKKATAPKKRASPTHPPYAEMVSEAITSLKERTGSSSYAIAKFVEDKHKDKLPPNFRKLLNVQLKKLVAGGKLTKXESYKLSSAATSRIQPRRPKNQDGAKKPRRCKTK

SEQ ID NO: 188688 - protein, 103 aa, Triticum aestivum
  unsure (1)..(103): unsure at all Xaa locations
  Clone ID: PAT_TA_83106.pep
RXXQAKXXHSNGQGRWPVXSXRFXLDLLKNAXNNXXVKGLDVDNLXVSHIQLXQXHKXRRRTYRAHGRINPYMSSPCHIELILSKXEQPXNKXADNIVAAXKH

SEQ ID NO: 188689 - protein, 110 aa, Triticum aestivum
  unsure (1)..(110): unsure at all Xaa locations
  Clone ID: PAT_TA_83107.pep
MDEASTSASGAATRGFVPRSGVFYRFTHQNLPAWKPAMTPGCIIAMFLIIXIIFIXFGLLCLXTSXHIAXIIYRYDVDCVPDAYRGNRQAYIKDSSISKNCTLEANVWNT

SEQ ID NO: 188690 - protein, 128 aa, Triticum aestivum
  unsure (1)..(128): unsure at all Xaa locations
  Clone ID: PAT_TA_83108.pep
MAPAVGLKRSATQTITLPPPDTRLAVRDVMRSTIPSQPAVAPASTERQAPAAALQGFLCLEEVDGRRWSYVVDGGAAKGKXQGRGRPAGAAVRAVPLXSPLPPAEEIMDHKIYVVLKVQKCTNYLILV

SEQ ID NO: 188691 - protein, 176 aa, Triticum aestivum
  unsure (1)..(176): unsure at all Xaa locations
  Clone ID: PAT_TA_83109.pep
NHDTLWTGGPGNYTNPNAPAVLSKVRSLVENGKYPEATSAAYDLSGDQTQFGRYLLISCSRPGTQISNLQGIWSNDTSPPWDAAPHPNINLQMNYWPALPCNLSECQEPLFDFIGSLSINGAKTAKVNYEAMVGQSSITDLWXKTSPDAGDXVWALWQWVGLVXLILGHYVYLAKF

SEQ ID NO: 188692 - protein, 122 aa, Triticum aestivum
  unsure (1)..(122): unsure at all Xaa locations
  Clone ID: PAT_TA_83110.pep
MATISAAAATTVVARAAIARPQALXLPQXEDXEREGEVQLLQGRQGGDXGGRRPRGRXVPARRXGRCDXVSXGRRSLWXTXDVXGXHRAXPAXDQQTXGXXFLFGLSYHGLLGRSISLSRIH

SEQ ID NO: 188693 - protein, 67 aa, Triticum aestivum
  Clone ID: PAT_TA_83111.pep
HTQHPQPRKTPHPLSYSALPATRIVSLRLQSSLLLSERSYCLVDARSTSLRQEPEASSASSSSRFAE

SEQ ID NO: 188694 - protein, 89 aa, Triticum aestivum
  unsure (1)..(89): unsure at all Xaa locations
  Clone ID: PAT_TA_83112.pep
VEDQSAHLGRMVAVISPCAAAAVSHTIRDACPIRVRRGGXWRXGVATLPLLLSSASRTALVIRSGLVLAITLXCGRTAAHRRRIIXHNR

SEQ ID NO: 188695 - protein, 56 aa, Triticum aestivum
  unsure (1)..(56): unsure at all Xaa locations
  Clone ID: PAT_TA_83113.pep
ASXLTQAFGAKGLIQAEMVALSGAHXVGAARCXSFAXRLYSYGPSGAGQDPSMDPA

SEQ ID NO: 188696 - protein, 100 aa, Triticum aestivum
  unsure (1)..(100): unsure at all Xaa locations
  Clone ID: PAT_TA_83114.pep
CCSFQSSSQIMKIMIFSCLSYLTGLLCPFAQVFFSFYQAFISFQPKCYPNRSSFLXQPKEELDEVCPCVFRSIDSNGPLGHRDLCTLGNLLIGRIGLMCR

SEQ ID NO: 188697 - protein, 132 aa, Triticum aestivum
  Clone ID: PAT_TA_83115.pep
YGLVRQPKWGHLRDVHKAIKLCEPALIATDPSYTSLGPNVEAAVYKVGSVCAAFLANIDGQSDKTVTFNGKMYRLPAWSVSILPDCKNVVLNTAQINSQTTGSEMRYLESSNVASDGSFVTPELAVSDWSYP

SEQ ID NO: 188698 - protein, 159 aa, Triticum aestivum
  unsure (1)..(159): unsure at all Xaa locations
  Clone ID: PAT_TA_83116.pep
ATTIVALAGLAMLSFIGATIWFVKKKRRRIEPPATLPTQQPAPPPPPNYIPSSAGSSLASDGFYLRSPGYPFMRYSTGSRGFPYSPADSGIGYSHMLFTPENLAAITDDFAXENXLGEGGFGCVFKGILQDGRQLPSXTQDGNGQGNVSSSESIHHRYS

SEQ ID NO: 188699 - protein, 120 aa, Triticum aestivum
  Clone ID: PAT_TA_83117.pep
ESQRITHIAVERNRRRQMNEYLAVLRSLMPPSHAHRGDQASIVGGAINYVRELEQLLQSLEVQKSLKQSRGRRPAGGGASCSPPFAGFFSFPQYSTAPSTTSSSGGEKCCGTTPRPRTSR

SEQ ID NO: 188700 - protein, 179 aa, Triticum aestivum
  unsure (1)..(179): unsure at all Xaa locations
  Clone ID: PAT_TA_83118.pep
EMDIWEANSISTAFTPHPCTKLTQHSCTGNSCGGTYSDDRYGGTCDADGCDFNAYRQGNKTFYGPGSNFNVDTTKKMTVVTQFHKGSDGRLSEITRLYVQNGKVIANSESKIAGNPVLSYSDSAPSRRRLGDIDDXTKKGGGTHERSLAAPWSVILSGRHIKCSGRSTTYDLQGGSSAH

SEQ ID NO: 188701 - protein, 127 aa, Triticum aestivum
  unsure (1)..(127): unsure at all Xaa locations
  Clone ID: PAT_TA_83119.pep
MGQQSLIYAFVARGTVILAEYTEFTGNFTTIASQCLMKLPASNNKFTYNCDGHTFNYLVEDGFTYCVVAVESVGQQIPIAFMDXVXEDSQKVWWWETATAAANSSIEIWXKLKETSVCVVPESTTGK

SEQ ID NO: 188702 - protein, 167 aa, Triticum aestivum
  unsure (1)..(167): unsure at all Xaa locations
  Clone ID: PAT_TA_83120.pep
APDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATXLKGWEHDSSVSPCALLLYLWPGPCFVICITSRKR

SEQ ID NO: 188703 - protein, 69 aa, Triticum aestivum
  unsure (1)..(69): unsure at all Xaa locations
  Clone ID: PAT_TA_83121.pep
SCRKXRPLPXXHCTXRXSGCXXSSESEPGTSKGGRGAXASWPLNKVTRRDXXXVWXRQRLISRLLXXXS

SEQ ID NO: 188704 - protein, 145 aa, Triticum aestivum
  unsure (1)..(145): unsure at all Xaa locations
  Clone ID: PAT_TA_83122.pep
RDTYSRGNTPSNAVVGSLNSSPAASAKKLQREREMLARQMQKRLTAEERERLYTKWGISLDSKKRKLQVARRLWTEAEDLEHVRESASLVAKLIGLQEPGQXLREMFGLSFAPQQQXPPRRRSXNGWRYGSFVRLIGRMNGATTD

SEQ ID NO: 188705 - protein, 181 aa, Triticum aestivum
  unsure (1)..(181): unsure at all Xaa locations
  Clone ID: PAT_TA_83123.pep
PKPSGRRQSEGRSSPSPNCNCNCYRTRFPETDTAAIATAAAMEMASSSAPTASYNVSVAQAVLTLSINAILLWLTTVIKSYSSSSSSARRRDAAPATAPAPPSPSPAKPAAAAAAAVDLDXVLGLMGAGAESSGSXRRRAVXGXRATWRRQAGFAVFTARDGXHARTRACXSSGXSGFPAP

SEQ ID NO: 188706 - protein, 66 aa, Triticum aestivum
  unsure (1)..(66): unsure at all Xaa locations
  Clone ID: PAT_TA_83124.pep
HFDVRXKLXXXTPGAPXHARGVXCSSSLRCTAETIXSEHGAQVREXXXGPXASXXLXXXFRXIDEV

SEQ ID NO: 188707 - protein, 100 aa, Triticum aestivum
  unsure (1)..(100): unsure at all Xaa locations
  Clone ID: PAT_TA_83125.pep
MSCNCXSSCGCGSSCKCGXXYPDLXETXTAXQATVVLGVAXXKNAAPXFVEAAAESGEAAHGCSCXGNCNCDPATADIDLTTMYDYLTCGGNNNKRWVHT

SEQ ID NO: 188708 - protein, 136 aa, Triticum aestivum
  unsure (1)..(136): unsure at all Xaa locations
  Clone ID: PAT_TA_83126.pep
LRVAYMLSTHDLVEAVRDAASECAASLIAEYQEGLLKIGKYAARYLAVRQRRLSLAAKLRSEDRFMDVEDDSVSRNEHYFXSEMSAYTTRESTLGMSSNASKSRAARRQKXGGKAXXNPGEEMASLXSQGMPLTXG

SEQ ID NO: 188709 - protein, 90 aa, Triticum aestivum
  unsure (1)..(90): unsure at all Xaa locations
  Clone ID: PAT_TA_83127.pep
MQWYLVAALLTILTSSQGILTTLSQSNGKYNYDYATIPFLADSSIICLRLFLWEGMPSSSPPRMTKEWXSVRLYVVPSIYIPQPTHVHFA

SEQ ID NO: 188710 - protein, 134 aa, Triticum aestivum
  unsure (1)..(134): unsure at all Xaa locations
  Clone ID: PAT_TA_83128.pep
TERNRQSATPQQRPTGAAAAAADGDGDRETTTTTTGHINSCACTVEFYFRPRFRLRLRLLRSVSTFKAGKQVDRPRFTVSPGYLWXPKLLPRHAPLAVLAAAWGLLHRPQXVFYPRLIGITFKXFFXQSFFXXG

SEQ ID NO: 188711 - protein, 118 aa, Triticum aestivum
  unsure (1)..(118): unsure at all Xaa locations
  Clone ID: PAT_TA_83129.pep
MAEPNPELSGLITQTKKKNIVPKFTEIFPVEDTAYPYSAFITSVRKEVIKYCTNHTGIVHPCCRWEKIPPXLVYTRXKNEDXXITSPYVWHSTWSVQTPGGCLWXSXKDGNHSSTTPG

SEQ ID NO: 188712 - protein, 76 aa, Triticum aestivum
  unsure (1)..(76): unsure at all Xaa locations
  Clone ID: PAT_TA_83130.pep
GVRLRFLTCSHLGFAILVCDHXVKVHMXSKMSKVXXETFSTXNWKGSXLTAVPXPVPXFRYTTLVTNIQXFGXGLN

SEQ ID NO: 188713 - protein, 76 aa, Triticum aestivum
  unsure (1)..(76): unsure at all Xaa locations
  Clone ID: PAT_TA_83131.pep
SADRRFKIFAAADGFGQPLKDAVVAYLRAHPAVAEVVDLGVDKYYAAAAAVARHVSSPDSEPDPPXSAGRICGTGP

SEQ ID NO: 188714 - protein, 104 aa, Triticum aestivum
  unsure (1)..(104): unsure at all Xaa locations
  Clone ID: PAT_TA_83132.pep
MFLCIIKDDVDGTCFKLLLAFLYVQRLTRVPGNWRGASLFPVVPCLLCLISFHDLYLNFIPCSTGKGRXYWKDXNIIEEMPCCRQMFNXFHPFDPVAYRLNTCM

SEQ ID NO: 188715 - protein, 73 aa, Triticum aestivum
  Clone ID: PAT_TA_83133.pep
LHEFTFFFDCCSTASDHPPPDSLLEKFQIDCKGFDPPAGSGNGVSFLFTSEDDNVSPRVRMGPSTAFRMASCR

SEQ ID NO: 188716 - protein, 99 aa, Triticum aestivum
  unsure (1)..(99): unsure at all Xaa locations
  Clone ID: PAT_TA_83134.pep
RGKATCHVVYGEPIAVLAGDALLALAFEHMASLDSYPPDVDPAKHTARVVRAXGELARCIGSEGLRRRPVVDLEMTGSTETVXXDRLGYIHLHKTAALL

SEQ ID NO: 188717 - protein, 101 aa, Triticum aestivum
  unsure (1)..(101): unsure at all Xaa locations
  Clone ID: PAT_TA_83135.pep
VSASSPRRRRRAEPLSTPIARHRXAPDHRXWWVAAXDRFLTSLSSLPLLVLLPPPLLLLVLFAICMPAFGYPPVMACFRXNRSLPPLRSSSWRRCAAAVAC

SEQ ID NO: 188718 - protein, 138 aa, Triticum aestivum
  unsure (1)..(138): unsure at all Xaa locations
  Clone ID: PAT_TA_83136.pep
XFQSNGIGCFARTCLRFHLSFLCQTVQRDSKHTGTSRNCSSYHTXTYLSVINYWAEMSSSFVLDSLYRCQIKGCPXAEERRGEERRDSSAGVPAGGQAMLPVQPPPAPAGTHDSSGKHLDGNGEEGCSSLLFRNSLLI

SEQ ID NO: 188719 - protein, 65 aa, Triticum aestivum
  unsure (1)..(65): unsure at all Xaa locations
  Clone ID: PAT_TA_83137.pep
TLAQPTDPHRGQGTSDDARAESGGRVEHGXPSALAAEAVKGAALALERVXXSMAVTVLRRRAXCR

SEQ ID NO: 188720 - protein, 103 aa, Triticum aestivum
  unsure (1)..(103): unsure at all Xaa locations
  Clone ID: PAT_TA_83138.pep
SPKFAHRVVGYLEEEAVHSYTEFLKDLDDGKXDKVPAPGIAIDXTGRLPANATLKGLXSTLXRRQQRSTTANLNNXQSGVLQQGINXKATPAPFXTLKLGVFC

SEQ ID NO: 188721 - protein, 171 aa, Triticum aestivum
  unsure (1)..(171): unsure at all Xaa locations
  Clone ID: PAT_TA_83139.pep
ADERGESSAPAMAGVQREVYSKKGVMRRLMRWSRPRWAAAEQAECAVCLDEFRAGDVLAHLRCGHRXHWACALPWLEGXTCPFCRAAVDPAPPPPPTAPKNGRSSVLLGLAWLGTRRAPPVRQLRYPMCTLAIANGVCNGDRLHLPDREETHTLCLEFDLAKTLILLALAS

SEQ ID NO: 188722 - protein, 84 aa, Triticum aestivum
  unsure (1)..(84): unsure at all Xaa locations
  Clone ID: PAT_TA_83140.pep
YNEHADDGYDRTAFPDITSISFKGIHGQGVRVPVRAHGKRRHPHQRDISFQXXMSVGISYKKEXHIFKCPNXKGLFKAGVPETI

SEQ ID NO: 188723 - protein, 159 aa, Triticum aestivum
  unsure (1)..(159): unsure at all Xaa locations
  Clone ID: PAT_TA_83141.pep
DANHHHGNGKAEAEAEAVLCQPASEFLPVMQEVYAALVAKVERAIPGAKVEDNXFCLSVXFRCLEEXSGPALQQVAXSKEHPGLRLTKAQXAGVRPXIRWTXGXPGVLLPRLPAEANRNSINFGNAPTRTLVLPPGRPGISKFPRNNALSQPSFCQLGQ

SEQ ID NO: 188724 - protein, 87 aa, Triticum aestivum
  unsure (1)..(87): unsure at all Xaa locations
  Clone ID: PAT_TA_83142.pep
HLVLRLRGGMQIFVXTLTGKTITLEVEXSDTIDXNVKAXIQXKRXASPKTNKXLISAGKXLEGXPHLADYXIQEXEHSQPVLRLXXG

SEQ ID NO: 188725 - protein, 134 aa, Triticum aestivum
  unsure (1)..(134): unsure at all Xaa locations
  Clone ID: PAT_TA_83143.pep
RPHHYLPSFAHNKPHDDQVRQQCSRNTSQPSLPMRPVARSIQRITQILSHLQHTMSAHHQMPAAPWRSAFLSHVDKMDLQLSCSAPQSQWSHHSSFPYRLYXGLGRDSVNPRQARSTLSLQXDXYITLISMEKY

SEQ ID NO: 188726 - protein, 143 aa, Triticum aestivum
  unsure (1)..(143): unsure at all Xaa locations
  Clone ID: PAT_TA_83144.pep
RNSLPDKTPTTTHHPAQGQAAQATTPYLFPPLLFLHSRIPSSSFLGLLHLIAETRXLPHXEGNXERRNGRAGGXRVLLTVQDGPHRRXRRPXSPISSLASXANTSPSIQVQHRVNSHKSLXMAXKHKXKXGTXWAXRYXQLXC

SEQ ID NO: 188727 - protein, 162 aa, Triticum aestivum
  unsure (1)..(162): unsure at all Xaa locations
  Clone ID: PAT_TA_83145.pep
MTRMSSRAAAVTAAAFLVLAAACPLLASAQPAPGMPPPSPAANNSRLEKAYVALQALKRAITDDPKKLTKNWVRADVCSYFXVSARPAPDDPANAXVAPLDLNTATPGTLPEDWAPSDSPLQLNQRSVLPRSSTLHSHSAQQLRARRTLCSNSVWTSHNFRS

SEQ ID NO: 188728 - protein, 136 aa, Triticum aestivum
  unsure (1)..(136): unsure at all Xaa locations
  Clone ID: PAT_TA_83146.pep
KFGYCSRFRCWLPTPKNVXYTXEVVTAYTTYCPGPTXIVHGDKTYTVXEATXLTITDCPCTVXNPSSHSAVVCHDXXVLPPTRQQSTMAPFTYGNPLVSCWPVLPHAVLLRPRGSSRCRLLRVVCASVIVEHCAYL

SEQ ID NO: 188729 - protein, 126 aa, Triticum aestivum
  unsure (1)..(126): unsure at all Xaa locations
  Clone ID: PAT_TA_83147.pep
PRGRPALQAVAVQAGGRGGGGGGGQAAEQQAVGLHAVAVGHLRAGDRGAEDRVQPRHRGRGHGQATKACLHQRRRHARRRREAGRGRAXVASGPVPPVLVQEVEDQAATTTSVLLSTSCSLSILLA

SEQ ID NO: 188730 - protein, 55 aa, Triticum aestivum
  unsure (1)..(55): unsure at all Xaa locations
  Clone ID: PAT_TA_83148.pep
GNXRSVATTXQHVGPXXLNSAITXGRLPLRXLATEXXSFIXSQXIPXVLXRFRVX

SEQ ID NO: 188731 - protein, 138 aa, Triticum aestivum
  unsure (1)..(138): unsure at all Xaa locations
  Clone ID: PAT_TA_83149.pep
MPXXHRLXSRXXYXXXHXFXXKGYIPXTSXLRTYKIGDYLHIKVNXAVHTWDAAQFYXGXXXRVWNFTXXXIXVYINXQVNGHIXRXHIHVRXDHIHHAAEKILLAKMTPVHRSPRITQELGNLLNPGYITSSIRTLA

SEQ ID NO: 188732 - protein, 185 aa, Triticum aestivum
  unsure (1)..(185): unsure at all Xaa locations
  Clone ID: PAT_TA_83150.pep
PKSLDGERKAKQATLSKMHRNPRAVIRAAVSLTRRPPAVPAAEALQTLPKATPSPALGAWRPDQAVGPLGSVSRRRAFSSSAAEYGKDXGRXEPQFXEAREEXXAAWRQGDGLLNXEXPSRLTRQRXSLLRPLYGSANDPSLRRSMGKDGHEANSTVXIPIXRKVDFXNWRMLVXLSXXXIKFRL

SEQ ID NO: 188733 - protein, 160 aa, Triticum aestivum
  unsure (1)..(160): unsure at all Xaa locations
  Clone ID: PAT_TA_83151.pep
SGAYYISFFFSILGETFIFFNKQIKGNKREIIQLGVPLFQPTTEDANCHTEPIPLVLQAVIDHLVLWXRLIPESRKPNSXVINFFXDEDEHSAAYXQPPHLDNPICTFCCLKPRWIWQALVTDSNGNYKDSHTSLNKLTMSWEHADRTCASSNGLTHFAR

SEQ ID NO: 188734 - protein, 67 aa, Triticum aestivum
  Clone ID: PAT_TA_83152.pep
DTYYSLTRSMLHKLGLEKYEKNFRKGLLNDQTLPLLTDSALRDVKIPPGPRLLILDQIKRDPGLRAK

SEQ ID NO: 188735 - protein, 98 aa, Triticum aestivum
  unsure (1)..(98): unsure at all Xaa locations
  Clone ID: PAT_TA_83153.pep
RRGLVGGCWFPARAAAAARGGRRRKQLRGGGGVPAEEGAVRGRVHQLRGAHREQGRLLRLVRRSWAGVYPRLPGHLRVPRWPLINQKQRVXSXXCLXN

SEQ ID NO: 188736 - protein, 82 aa, Triticum aestivum
  unsure (1)..(82): unsure at all Xaa locations
  Clone ID: PAT_TA_83154.pep
SKYFKPGSVVTFHFPAPASASPGPAAEITFATEGKGDARIAVENGNVAGMIXTWYLGGDSAVSPSTVRSLANRFAALLAVAA

SEQ ID NO: 188737 - protein, 74 aa, Triticum aestivum
  unsure (1)..(74): unsure at all Xaa locations
  Clone ID: PAT_TA_83155.pep
XEDGNXXDRFAKAIDFSLFQQKFLDATIQGALVRLLQTKSLKPAHPASEYFCHSSIIRPLRTNQICTRRRSHLQ

SEQ ID NO: 188738 - protein, 168 aa, Triticum aestivum
  unsure (1)..(168): unsure at all Xaa locations
  Clone ID: PAT_TA_83156.pep
SHNNLSGSIPAGFASVSFAYLDLSRNAFAGDASGVFGKGKPLQHLDLSRNGFAFSLTAVDLPEQLAYLDLSHNAIXGRIPAXVADLAGLQLFNVSYNKMCGVVPTGGSMAKFDAYSYQHNKCLCGTRCRHAAPLLLIDSSSIDESVMLVLCTFNKVNTFKQGKVTQMD

SEQ ID NO: 188739 - protein, 149 aa, Triticum aestivum
  unsure (1)..(149): unsure at all Xaa locations
  Clone ID: PAT_TA_83157.pep
VLQAYMVGEHGDSSVAVWSSVSVAGMPVLKSLQESHRCFDEEALEGIRRAVVDSAYXVIXLKGYTSWAIGYSVANLAASLLRDQRRIHPVSVLARGFHGIPDGNDVFLSLPAKLGRAGVXGVXEMELTXXEXKXLRRSAXTSGTAAPRL

SEQ ID NO: 188740 - protein, 63 aa, Triticum aestivum
  Clone ID: PAT_TA_83158.pep
PFFPLGRQLTAYFLLTLRAKFNLYSSRVTDMLLTPSPSIFLFTAAFRSIGLTRITPPLIPPHG

SEQ ID NO: 188741 - protein, 59 aa, Triticum aestivum
  Clone ID: PAT_TA_83159.pep
VMSPVCNALEAPSLDPLSYLFVGVWIHYLLSAYQMLKRSDGLLAVFMVSPFQRHAGINC

SEQ ID NO: 188742 - protein, 76 aa, Triticum aestivum
  unsure (1)..(76): unsure at all Xaa locations
  Clone ID: PAT_TA_83160.pep
VLSSPLRPPLPTARPRALHYLGGRWPTYPTPAPPNTSSAPAXAAAGWSVVEQLAAAAPGGRPSHSPRRGGRRWRPS

SEQ ID NO: 188743 - protein, 142 aa, Triticum aestivum
  unsure (1)..(142): unsure at all Xaa locations
  Clone ID: PAT_TA_83161.pep
MVQRLTYRKRHSYATKSNQTRVVKTPGGRLVYQYTKKRASGPKCPVTGKKIQGIPHLRPAEYKRSRLARNRXTVNRPYGGVLSGTAVRERIIRAFLVXEQXIVXKXLKIKKTKDKAPRTRHIASSMLSPNCSTKFPWFGEDT

SEQ ID NO: 188744 - protein, 137 aa, Triticum aestivum
  unsure (1)..(137): unsure at all Xaa locations
  Clone ID: PAT_TA_83162.pep
GHCSSFTGRLSEPPSQINPAYRDLLNYKCPQGSNPPVANNVRDEDYGVVARYMPGFTSRVRKIPDFLDNSFYHNNLAKIVNFNSDWTLLTNKEAFGNXVEYPXXRTLWDKDSRLAAQTSCQCNRKHGRNNELLNTPI

SEQ ID NO: 188745 - protein, 163 aa, Triticum aestivum
  unsure (1)..(163): unsure at all Xaa locations
  Clone ID: PAT_TA_83163.pep
GTGGRRAGAQDRGARAQEADEAPVARPLRLPCWTHRRRAAARGPRCRRRREEAPEEEGQQSRPAAGGCCGCAAAVAPLARRHLRXVQQQHRRRQVRKAASWDLARALPRAHGGKQYRHLENASPCXRSRRRXPVLIMRRXAXISSSTRTRRGEDIEQQNTTQH

SEQ ID NO: 188746 - protein, 95 aa, Triticum aestivum
  Clone ID: PAT_TA_83164.pep
MAPFPRRLPAAVPLLLLLGAAVASAGAEDTDGGNSRRRHSRLLFAFGNSLTDTGNGAIFPVTAGGPFTRPPYGETFFGRPKRRVSTARPRLLLEE

SEQ ID NO: 188747 - protein, 172 aa, Triticum aestivum
  unsure (1)..(172): unsure at all Xaa locations
  Clone ID: PAT_TA_83165.pep
MRTAAVITLLASVVSATPFGQRSQVLPRASETCPVVFDGRVPANASLTDFDTANGGGWNPYNPGFVKGNNISWSEILKLPKTKTKSRFDTXAGTIPLXVTISDKSIFMKQLGFRRAGLQFTXDSNEGSPGSXGVXTLHLHQQDTTPLTESTELCKRRFPGTISNHRNNSDRL

SEQ ID NO: 188748 - protein, 166 aa, Triticum aestivum
  unsure (1)..(166): unsure at all Xaa locations
  Clone ID: PAT_TA_83166.pep
LVLQEFVNHGGVIFKVYVVGGHVTCVKRRSLPDVSPEDDASAQGSVSFSQVSNLPTERTAEEYYGEKSLEDAVVPPAAFINQIAGGLRRALGLQLFNFDMIRDVRAXGDRYLVIDINYFPGYAKMPGYXTVLTDXSGXCHKDXWEQQEEKGQHLEKDDDYGPLGMR

SEQ ID NO: 188749 - protein, 105 aa, Triticum aestivum
  Clone ID: PAT_TA_83167.pep
VIDTSIDGWKAAKVLIRRGDVWKVRNKKPSAVSELEDAIAKGKRRAGLVSKLQRDKEKEKQKEKEAITSGNTPCWQWEMLTKTPDYPIQTPEKSYSVLEPRSQIA

SEQ ID NO: 188750 - protein, 119 aa, Triticum aestivum
  unsure (1)..(119): unsure at all Xaa locations
  Clone ID: PAT_TA_83168.pep
MTAGFQLGVIGSLTLSVASSVAIVICNKXLISTLGFHSATTLDNWHLDGDLLHLHVAQRLRFFQPKGDSTGRRILFGLLXNGTSIGLLNLIXVNSIXFYKMTXLGIIXYXALETYPEER

SEQ ID NO: 188751 - protein, 31 aa, Triticum aestivum
  Clone ID: PAT_TA_83169.pep
FTLPIALGGAPHLDNALVGYFSIHLNLRVLR

SEQ ID NO: 188752 - protein, 117 aa, Triticum aestivum
  unsure (1)..(117): unsure at all Xaa locations
  Clone ID: PAT_TA_83170.pep
MASLPNGGGAAASGSCGARPVDKEVDFANYFCTYAYLYHQKEMLCDRVRMDAYHSAVFRNAPHFQGKVVLDVGTGSGILAIWSAQAGARXVYAVXATNMAEHXRELARAXXVTDIVE

SEQ ID NO: 188753 - protein, 120 aa, Triticum aestivum
  unsure (1)..(120): unsure at all Xaa locations
  Clone ID: PAT_TA_83171.pep
FHGERGVLDRLLSVVTYGQPRVGDKVFAGYVRANVPVEPLRVVYRYDVVPRVPFDAPPVADFAHGGTCVYFDGXYKGREIAKGGDAPNKNYFDPVPAVHVRQPLGGTLQGPFLLGKGRQG

SEQ ID NO: 188754 - protein, 77 aa, Triticum aestivum
  Clone ID: PAT_TA_83172.pep
RESVAVAVDSAEPYEDFRESMVQMVVEKEIYAWDDLNDLLHQFLSLNSPRHHPLILHAFADLWTRNGLFCPPSPCQF

SEQ ID NO: 188755 - protein, 96 aa, Triticum aestivum
  unsure (1)..(96): unsure at all Xaa locations
  Clone ID: PAT_TA_83173.pep
DVVDLVLIMSVNPGFGGQSFIESQVKKIAELRRLCAEKGVNPWIEVDGGVGPKNAYKVIEAGANAIVAGSAVFGAPDYAEXIKGIKTSQRPLAVAA

SEQ ID NO: 188756 - protein, 108 aa, Triticum aestivum
  unsure (1)..(108): unsure at all Xaa locations
  Clone ID: PAT_TA_83174.pep
FPFQIECAILLNSFKRSFVNCLTLVERVSMIFVSKVIFLSLKGRIYESPFPKVPRYGSWVINSSLLWNPCTILSKLGLLPPNQTHRCXSTLSTCLCPTQGGPVPIRPK

SEQ ID NO: 188757 - protein, 87 aa, Triticum aestivum
  unsure (1)..(87): unsure at all Xaa locations
  Clone ID: PAT_TA_83175.pep
PDXXHSXLLFPNXTNDXVPHXVKXLHXXVSPXFKVDDVQDSXKSLNXXLXXXLLTXNDXNDLGXSXHXSCRRGCCKLWNXLKXXLXL

SEQ ID NO: 188758 - protein, 98 aa, Triticum aestivum
  unsure (1)..(98): unsure at all Xaa locations
  Clone ID: PAT_TA_83176.pep
SASSKELKDLQERPPTSCSASPXGXDMFXWASNNLWGPPDIPXSGGVFLXNINFPPXDYPFKPPXVXFKDKXFIXNINNNGXISLDILKRQXDPALXF

SEQ ID NO: 188759 - protein, 66 aa, Triticum aestivum
  Clone ID: PAT_TA_83177.pep
KIMPCYYTATSQDLFFLIVVGARCPRQSTRKQGFVSIRPDDLQPLLHSNSPCNSSDLKHLYRGSIN

SEQ ID NO: 188760 - protein, 149 aa, Triticum aestivum
  unsure (1)..(149): unsure at all Xaa locations
  Clone ID: PAT_TA_83178.pep
MDGNRIARFSVTWRGSQLDVDADPSCTVKEFGQLLQDLTSVRPETLKLIVPRSTNKGSKLIMPFSXDAHSEIDTEWMGISEGKPIPNDGXYDDEIRGGIRQWQXPDQRIIGFDEEEQRLKQSSLGXHSFTQTPQGTIHLRDFGPSLTWD

SEQ ID NO: 188761 - protein, 83 aa, Triticum aestivum
  unsure (1)..(83): unsure at all Xaa locations
  Clone ID: PAT_TA_83179.pep
GAENALGNAERCCLHVEDYFVRDLAGNHPYSSFSATLDDFELKITRISTRAFAQWGRRGGQPSLXYISVGTLNLXPLDSCVHF

SEQ ID NO: 188762 - protein, 202 aa, Triticum aestivum
  unsure (1)..(202): unsure at all Xaa locations
  Clone ID: PAT_TA_83180.pep
GMYLGEIVRRILLKLAHEASLFGDVVPPKLELPFILRTPDMSAMHHDSSHDLKTLGAKLKDIVGVADTSLEVRYITXRHICDLVAERAARLAAAGVYSILKKIGGTNYQAGGXGKMPXTVVALGRWVYEHYKNSALRRTTLTDFSGXEXSSVVANWANDGLDWTPLAPQLQYSMAAYLNGRSLVITFFLQNLWFRSLCNRET

SEQ ID NO: 188763 - protein, 103 aa, Triticum aestivum
  unsure (1)..(103): unsure at all Xaa locations
  Clone ID: PAT_TA_83181.pep
IKYXAKPEEQPLKTALNMRVXFRSCGTVGYGPTMWVKSTSGDIFHSHDSKAFRXYMLVMSATTXYQGRWXKRTISCLLKQGRQXANSXPXWLPECHNNSNSFC

SEQ ID NO: 188764 - protein, 97 aa, Triticum aestivum
  Clone ID: PAT_TA_83182.pep
KAETLDRFCKPIMTKPKPAPKPQTPPVAENQAPEPQTPEQQQSGGESTASEGAAEEPRAEQMETDKPEGATVPRLTLPVIKHCVIDPVHLLLYVGGS

SEQ ID NO: 188765 - protein, 147 aa, Triticum aestivum
  unsure (1)..(147): unsure at all Xaa locations
  Clone ID: PAT_TA_83183.pep
DSXQXLHIRGGEQVMSGLFCLVQVPFAVRSGIHVPSNWHWVWEVARGRVAWRSGVWRVLXLFPVVAAEAAEVGVPQRVAAPLARRAARAGRALPQHRAPVDVARPVGLARREEQRQQRDGRHGHGTLAAHPSPGHLRSADVLASLGC

SEQ ID NO: 188766 - protein, 117 aa, Triticum aestivum
  unsure (1)..(117): unsure at all Xaa locations
  Clone ID: PAT_TA_83184.pep
QRVLRRSNGAXSLGGGXSLLVXLGDNVGGRQDMPGDQHGPALLSWPLAWVLRRGHPRSRGDSRRERHLDHRRFIIIIIGEVTKELPLPRGRGFLHHLVRGGLGGSIIGGQVHQGRRR

SEQ ID NO: 188767 - protein, 125 aa, Triticum aestivum
  unsure (1)..(125): unsure at all Xaa locations
  Clone ID: PAT_TA_83185.pep
VPTPSGARRCVGRPHARSPAPGLLSSRAMRISTGTTTSNPVPWVHPRFAEKNDGDWEAEGREGPITLQFLGGGRRRPTINWEXPTTEDXAKAPWPQGTXKRRXFSSSNXTPALAGFASDPPXXTL

SEQ ID NO: 188768 - protein, 48 aa, Triticum aestivum
  Clone ID: PAT_TA_83186.pep
ILLLAHVTGVLGRNKILVDRPRIRVEFQKECTSKFTLRSSCFMSFLME

SEQ ID NO: 188769 - protein, 81 aa, Triticum aestivum
  Clone ID: PAT_TA_83187.pep
HSHRPWRSCAKLTKPGCYDSELRPCPLCMGDSRPLTSPGNLLEDCKESAVFPTGLPSALLALNWSFMCSAAQSKTCRVDVV

SEQ ID NO: 188770 - protein, 217 aa, Triticum aestivum
  unsure (1)..(217): unsure at all Xaa locations
  Clone ID: PAT_TA_83188.pep
EESMELKITWEEAQELLRPPPKAPSIVIVDGHEFEEYEEPPVLGRKTYFVADKSGSNHQWAQCEDCSKWEETXPIDALLPSKWXTCSDNKWGFKKVSCDLHRKXNXEDLXRIIPIKPAKNPIEDRSDAIDASXXWDTLXNLAILGEGNXPSXPTTKHPQRPGCSCIVASTTSGKVKHSNFTVRLIRSPFRTHLHRHKVLPKSIHKAKSSHDICMNHA

SEQ ID NO: 188771 - protein, 61 aa, Triticum aestivum
  Clone ID: PAT_TA_83189.pep
ERERERERERERMSFSSWLDFILLSTVPIVKVRTRVCIYQTCNKHDVQSNKMVYLYFQKKK

SEQ ID NO: 188772 - protein, 174 aa, Triticum aestivum
  unsure (1)..(174): unsure at all Xaa locations
  Clone ID: PAT_TA_83190.pep
MDASGAGSKGKKGAAGRKAXGPKEESVTRSVKAGLQFPXVGRIXGRYLKEGRYAQRXXHWAPPSTRRLPGLLPAKVWIXKGTXRKDNKKTPSPAHXLLAIRNDEDSGXLAGSHRQXXSPNSPVLLPXKAAXKXQRRXKDQSQEGASPKKARSRSISLSYSVKCGSPRCYEFLTK

SEQ ID NO: 188773 - protein, 185 aa, Triticum aestivum
  unsure (1)..(185): unsure at all Xaa locations
  Clone ID: PAT_TA_83191.pep
AIMPNNGVRAVATPVAREEPLLRREDDAAPPKAAGGDGQPLDAGARDAGSFPWLPAAGVVYLTLSSAMALHRCWPTPATSRSSCRRTSTSSCSSAASGGTSARSLGRRSXSGQLAVWLLTSALTSSSPISPAVMPAAVAASSGHGLTHLRWXSLLXFXXXVLRSWTREKFRGDMKIRYKFIXYKF

SEQ ID NO: 188774 - protein, 178 aa, Triticum aestivum
  unsure (1)..(178): unsure at all Xaa locations
  Clone ID: PAT_TA_83192.pep
MSSSPSFGLLALAAVLLALNLAQHGSLAATVGPRVIVVGAGMSGISAAKRLSEAGITDLLILXEATDHIGGRMHKTXFAGINVXFRPNWGXRAXNGGKMNPSGPSSIHLKXRNFRSRLRLLAQNFYKEDXGXYDEDYXKKRMNWADXVEEWGKTLALSRSARQFIHRLTTQPTAARAC

SEQ ID NO: 188775 - protein, 153 aa, Triticum aestivum
  unsure (1)..(153): unsure at all Xaa locations
  Clone ID: PAT_TA_83193.pep
MRRPAYGADDCGYGGRQTAVYADEYSRGGRYEGYGVEQEHFKREEKEHKHKERLGEVGALAGGAFALYEGTXXKKDPANAQEAQXQAGXGNGGXAGPGGTPYHXHRXQEGAHYETXTRHRCRTARHGTXSYYXTETLYPSMKFIRTHIIPALL

SEQ ID NO: 188776 - protein, 166 aa, Triticum aestivum
  unsure (1)..(166): unsure at all Xaa locations
  Clone ID: PAT_TA_83194.pep
MQSQASRMARSSGSRPVALVLLALCAAALSSATVTVNEPIANGLSWSFYDVSCPSVEGIVRWHVAEALRRDIGIAAGLIRIFFHDCFPQGCDASVLLSGSNSEQIEVPNQTLRPEALKLIDDIRAAXXAVCGPTCPAPNNKLATRDPXSFGGPSSGPLGGXRSGPV

SEQ ID NO: 188777 - protein, 161 aa, Triticum aestivum
  unsure (1)..(161): unsure at all Xaa locations
  Clone ID: PAT_TA_83195.pep
MAPTAAKDSGSADRWREVQAFEDSKLGVKGLVDSGVKSIPAMFHHPPESLKDVISPPALPSSDDAPAIPVVDLSVARREDLVAQVKHAAGTVGFFWVVNHGVPEELXGSMLSGVRQFNEGSLEXKXALYHGTRSQLRFASNXTLQFRGGQWPPVFAGLGPD

SEQ ID NO: 188778 - protein, 143 aa, Triticum aestivum
  Clone ID: PAT_TA_83196.pep
FYGYITSDCDAVAIIHDAQGYAKTAEDAVADVLKAGMDVNCGSYVQDHGASALQQGKITEQDINRALHNLFAVRMRLGLFNGDPRRNLYGDIGPDQVCTQEHQDLALEAAQDGIVLLKNDGGAGALPLSNPTSRPRRDRFNNP

SEQ ID NO: 188779 - protein, 171 aa, Triticum aestivum
  unsure (1)..(171): unsure at all Xaa locations
  Clone ID: PAT_TA_83197.pep
VPKKILTPESNITNQNSSSKVGVANSTTDIKENLSSGSDNNSSTPINGSNVQEIITEKVLKKRTFRVPLKVVEKTTGGGTILSKELYSEAKNRLEALDKKDAERRKTAELKNNLESYVYSMKEXLEESTDILTVSTEQEXEPLXRNLASQDWLYMAGXIPNESKNWQLRHW

SEQ ID NO: 188780 - protein, 154 aa, Triticum aestivum
  unsure (1)..(154): unsure at all Xaa locations
  Clone ID: PAT_TA_83198.pep
XVVRSFSXGPKISHPXXARWXPWGSASCCRCRCCSARPVCFSRCSXASSNLELLXPALLAAETAGHLCNMKMSLLPDRSLRHRKQMSEVVVAAVELVAVVAGVAEHAAGPPRRGRGLQRGGGVAGEASLEVLVSVRGHGVVVRHFLGLAMRRIG

SEQ ID NO: 188781 - protein, 126 aa, Triticum aestivum
  unsure (1)..(126): unsure at all Xaa locations
  Clone ID: PAT_TA_83199.pep
MGSTSSMLTQYDIEEVQDHCNHAFSQQEIVSLYHRFCQLDRNGGGFVSADEFMSVPEFAVNPLSQRLLRMLDGLNFKEFVAFLSAFSPRTSLQQKIEFNFKXVYDTDCNXERLLLMTLXILQXXXG

SEQ ID NO: 188782 - protein, 103 aa, Triticum aestivum
  Clone ID: PAT_TA_83200.pep
PSSSTWRSGGTRCARTCRCRSGRRTAAGRRRWRRRPPPTTLTCRRRSGRTWLMLPRRHGDALVRAVTISINPVHAYDLWIVVERRAGSFVCSVTEFVRVRRLS

SEQ ID NO: 188783 - protein, 158 aa, Triticum aestivum
  unsure (1)..(158): unsure at all Xaa locations
  Clone ID: PAT_TA_83201.pep
GAQFPGDNDVAEVDAARDGEVDRRDVGKMEHGCEHYRRRCKIVAPCCNQVFPCRHCHNEATASGDRHTICRQDVEKVVCLLCETKQPVSQVCISCGVNMGEYFCDICKFYDDDTDKGQYHCIDCGIXKVGGKENXFHCXKCGXCXXLXRDNHXCVENQ

SEQ ID NO: 188784 - protein, 143 aa, Triticum aestivum
  unsure (1)..(143): unsure at all Xaa locations
  Clone ID: PAT_TA_83202.pep
QADTTSFKQVVQMLTGAEQPANNDATAAGAAAAAAANGGGAGAQAXSGGPCCRPKKPSFKLYXRRSSLKNLKMIAPLAMGSXPSPXPSPRRAAPEILSPSVLDFPXLTLSPVTXLAGXPFXRLPAXVXSSXEGYXXAIPGXGV

SEQ ID NO: 188785 - protein, 43 aa, Triticum aestivum
  Clone ID: PAT_TA_83203.pep
VLPSGIHDCSQLASVQSWPSCLKLTFGVLCTGTSACPHQLEEQ

SEQ ID NO: 188786 - protein, 58 aa, Triticum aestivum
  unsure (1)..(58): unsure at all Xaa locations
  Clone ID: PAT_TA_83204.pep
SXNQGDVXADXYXSFSLIMTTLLITMHACMPLNDQKLQHALVSXFLIFAXSDLMHREI

SEQ ID NO: 188787 - protein, 107 aa, Triticum aestivum
  unsure (1)..(107): unsure at all Xaa locations
  Clone ID: PAT_TA_83205.pep
REPHGHGGAAAAVHGDDAATADDEWSRRRRRRRVPGDGVRVRPAGDAVPTAAAVLLPPRCRSGTRTTTCSATRTPTAATVMLSXPCHACQGGKGPPVSXFPPGLDXF

SEQ ID NO: 188788 - protein, 107 aa, Triticum aestivum
  unsure (1)..(107): unsure at all Xaa locations
  Clone ID: PAT_TA_83206.pep
LPSAFDPFAEANAEDAGAGPGAKDYVHVRIQQRNGRKSLTTVQGLKKEFSYNKILKDLKEGICCNGTVIQDSRARPVIXLQGDQRXDVATFPIPGGDLRRRVHKFHS

SEQ ID NO: 188789 - protein, 114 aa, Triticum aestivum
  unsure (1)..(114): unsure at all Xaa locations
  Clone ID: PAT_TA_83207.pep
GREGLPRVPSRASRRLLLSLVKPPLPRARYRHPPPPPLPRTRAPTVARHPRSSSLPPLPRAKRTATTGGRTAQLAPDPEHLLSPQLTHDDLLSPPSASXRREQNWVSDSDSVXN

SEQ ID NO: 188790 - protein, 170 aa, Triticum aestivum
  unsure (1)..(170): unsure at all Xaa locations
  Clone ID: PAT_TA_83208.pep
MVGPGLYTEIGKKTRDLLYKDYQTDHKFTLTTYSSNGVAVTATSTKKADLIFXSEFHSQIKNKNMTVDVEXKLQIQISFTTXTVXNEFATPRTEDYLSFAVPXDKNSGKVXLHYLHDYPXFMQRLHPVPLVLLDGHWCFIDLQRGITIKRVSHHKTHPYIHRRNYGLHVA

SEQ ID NO: 188791 - protein, 86 aa, Triticum aestivum
  unsure (1)..(86): unsure at all Xaa locations
  Clone ID: PAT_TA_83209.pep
DRCXVYXVHVHXHXHXLHXHTXHXFSXPCCYMNMDIHIXLGTSKKDKLRRKTQSNXRVDKSAMALYXWXXVSELFRPCRTXCSPVX

SEQ ID NO: 188792 - protein, 89 aa, Triticum aestivum
  unsure (1)..(89): unsure at all Xaa locations
  Clone ID: PAT_TA_83210.pep
RECPSARPPSGSPVVLAGRLGQSRERRGPAALGXAXLSTAYFLAAXPLGWATRSGVXKSSAXSFXRXTRXKVSXPFNSXTFRGKLXMGD

SEQ ID NO: 188793 - protein, 66 aa, Triticum aestivum
  Clone ID: PAT_TA_83211.pep
FFFLLSSVTSVTKYGICTITTRQKFRIISTVKPGYRSLISFFLWVQHIVTLKPIGPLKPGYRSLLS

SEQ ID NO: 188794 - protein, 105 aa, Triticum aestivum
  unsure (1)..(105): unsure at all Xaa locations
  Clone ID: PAT_TA_83212.pep
TGIPRSRSKVKASASHSPTAATAAGLECCRCRTLQLIPHSLQFSMVDQYVCMTPVPPRKGSRQSMLIAAAAAAAAXPKHSATAFNPPNXTSVSSWQXXLLLTLLQ

SEQ ID NO: 188795 - protein, 124 aa, Triticum aestivum
  unsure (1)..(124): unsure at all Xaa locations
  Clone ID: PAT_TA_83213.pep
MSERAPMVDGCVFCEIVRGAPASTTALLYSDDKVVAFRDINPSAFRHYLVIPIDHIPTVNSLRKTKDDHQLSEHMVXVGKRLPQSRCSKFLKNTSLGSHQPPFXNILINLXLHCLALXLSPILN

SEQ ID NO: 188796 - protein, 141 aa, Triticum aestivum
  unsure (1)..(141): unsure at all Xaa locations
  Clone ID: PAT_TA_83214.pep
FFLIIGYYXDVXLXXXLTECILXXPVAXXSLKLQQVIKLLHSTFQNDSSILXRXPSAIMCVQATNSQAFAGGVXQHTQGRRXCLSRAGWPSTRSGLCWHAQASARGRAPTANALARRKHPRREGELRRRVQTWMSAGGELQ

SEQ ID NO: 188797 - protein, 82 aa, Triticum aestivum
  unsure (1)..(82): unsure at all Xaa locations
  Clone ID: PAT_TA_83215.pep
SYQLNLXDNTEMXYCNVEHTXGYITXISYFVHVEHIDSRPQLPGGPXIPNIIXPXAXXXGNWYTTLKTFMEQGPFLNXXRXX

SEQ ID NO: 188798 - protein, 166 aa, Triticum aestivum
  unsure (1)..(166): unsure at all Xaa locations
  Clone ID: PAT_TA_83216.pep
EASASTIRRAHAVHPISAVQLEWSLWSRDVEADIIPTCRELGIGIVAYSPLGRGFLSSGPTMVRQLSDQDFRKXLPRFQPGEXWEKNAXDIXRDQRDGGEEGVHPFATGVGLGYTTKDRLXPIPGTTKRTTQRCGLVDSPSRMANIYPGRQGILHSQHLEGKTPCL

SEQ ID NO: 188799 - protein, 110 aa, Triticum aestivum
  unsure (1)..(110): unsure at all Xaa locations
  Clone ID: PAT_TA_83217.pep
WISKVMGKWHKLDNIXKVLGXTLKLLDPNLSSWSILXTYLGTLERRIRLGFEPKFHNVYXRFLLWSGEHHFIQFXLFWILLSHSFPWVCGTSNVVFSPTCPEFPMILGIS

SEQ ID NO: 188800 - protein, 61 aa, Triticum aestivum
  unsure (1)..(61): unsure at all Xaa locations
  Clone ID: PAT_TA_83218.pep
GQXLEIGGRGQTTITLYDGIGTGDGSRRSFASYSLHIFRERCRGDMPCLDFRFGRRIHICF

SEQ ID NO: 188801 - protein, 146 aa, Triticum aestivum
  unsure (1)..(146): unsure at all Xaa locations
  Clone ID: PAT_TA_83219.pep
TKSSTNTCTYTYMPFKTKSSLTCIGKWRLNLPSIKDTLQTRSISWMKQINTKFLLHPSIRNPFLCRYDHLLDNLSLXAWHQWFQLSYQGYLLRIKLVANAKTSLLGQVLIHHIKYFXAHLMLILPRQLVDVNHVDPAIYAKSPTRS

SEQ ID NO: 188802 - protein, 127 aa, Triticum aestivum
  unsure (1)..(127): unsure at all Xaa locations
  Clone ID: PAT_TA_83220.pep
PIEGIKKFETLSYLPPLSTEALLKQVDYLIRSKWVPCLEFSKVGFVFREHNSSPGYYDGRYWTMWKLPMFGCTDATQVLNEVEEVKKEYPDXFRVIGFDNMRQVQCXFIAFKPPSCXESGKPKMQVE

SEQ ID NO: 188803 - protein, 41 aa, Triticum aestivum
  unsure (1)..(41): unsure at all Xaa locations
  Clone ID: PAT_TA_83221.pep
SSALLEAVGEYSGLCHIPSFKGAVQTALPHMKLLDEXXKKK

SEQ ID NO: 188804 - protein, 102 aa, Triticum aestivum
  Clone ID: PAT_TA_83222.pep
KIPGLTQAWISNCYMDYTSIVAEDPVLLHVSGSFFLGDANVVLKAVSGVARGVQVVGNIFSGRDKGVDIVQLDGAFATVDQVYVQQNSATGMTVRSTSARAS

SEQ ID NO: 188805 - protein, 97 aa, Triticum aestivum
  unsure (1)..(97): unsure at all Xaa locations
  Clone ID: PAT_TA_83223.pep
MATSEPVQESLVVHYSQPSRPRVLLAASGSVAAIKFETFAXYFSEWADVRXCGTTPSLHSLIXISTKWXLLYTDDDEWPTWKKIGDXILHIELPEWA

SEQ ID NO: 188806 - protein, 47 aa, Triticum aestivum
  Clone ID: PAT_TA_83224.pep
LDLAFGLTETSRLGCQVIAKPELDGMRLALPVATRNFAVDGYVPKPH

SEQ ID NO: 188807 - protein, 193 aa, Triticum aestivum
  unsure (1)..(193): unsure at all Xaa locations
  Clone ID: PAT_TA_83225.pep
PRPIPGNRKLESCQALAVLPPTAYRCRLPPAGHPTQRKSAYTVVLRFARAAHPFGCLARPKIPCCASKASSRQVPLQKQAACACVTGSSCLSQCASVSRQEPXDRHGGRRGGGXGPNAGGXRMPLHXAEAGPXEXTPIGLPLKGFXXPGXXAXKCPLGALLXPXXGFAVXNXIRRSXXTLICXTLRYSLAXSF

SEQ ID NO: 188808 - protein, 166 aa, Triticum aestivum
  unsure (1)..(166): unsure at all Xaa locations
  Clone ID: PAT_TA_83226.pep
MDATGTGAGGKAKKGAAGRKAGGPRKKSVTRSVKAGLQFPVGRIGRYLKKGRYAQRVGSGAPVYLAAVLEYLAAEVLXLAGNAAKDNKKTRIVPRQXLLAIPQRRXLRELLTGXTIAQXXLLPNINPVLLPKKTXXKXQXAGQGXNPPXRRQSPKKRLGAVVSCVV

SEQ ID NO: 188809 - protein, 69 aa, Triticum aestivum
  Clone ID: PAT_TA_83227.pep
CPTPWAHPPASWLSRCLSDFISKFSGLLSVQERSSRRFHSVWTPFGIPFPRNSKIGKKQKLALGPRLIG

SEQ ID NO: 188810 - protein, 173 aa, Triticum aestivum
  unsure (1)..(173): unsure at all Xaa locations
  Clone ID: PAT_TA_83228.pep
NNATSSGGSGSHRKMSHNAYERDRRKQLNEQYSSLRSLLPDDDHNKKMSIPTTVSRVIKYIPELQKEVDGLEKKKEELRXPATSKRHEAEHGPIVSATCLDDXEXMXKSASDTMAGXCHFKCIKVLESSSAXNPRFRFQNRFTSIFEPTNMTRRQTFLQRRTNKRGNRTYGCT

SEQ ID NO: 188811 - protein, 167 aa, Triticum aestivum
  unsure (1)..(167): unsure at all Xaa locations
  Clone ID: PAT_TA_83229.pep
FILAQPAAQLPSFSSLIVEDVVAMSSLLKLVVFLGLTFATSFARSNDPMFAYNGFSNTNLRARRHGLHHGERPARADQRQVMSKXTFFPVHCASAIPQHTSSFSASFVXGLLGVQQPYNHGWHVLXPSKISRRXPWQLAXKAKRRNGQRSXLXSXYKXXSRLTTTFG

SEQ ID NO: 188812 - protein, 187 aa, Triticum aestivum
  unsure (1)..(187): unsure at all Xaa locations
  Clone ID: PAT_TA_83230.pep
EDAHAFDVISVKIADLGNACWVNHHFTNDIQTRQYRSPEVILGSKWGASTDVWSMAAMVFELITGDYLFDPQSGTKYGKDDDHIAQIIELLGXFPKSLCLKWAXGVRNLQTRKGELPNIHRLRIGLLPDXLRXNYTFKEDEQSVLQIPHPMFGLVPENDHAGGWKHSGWRKLHKGRNEAESCVITWH

SEQ ID NO: 188813 - protein, 133 aa, Triticum aestivum
  unsure (1)..(133): unsure at all Xaa locations
  Clone ID: PAT_TA_83231.pep
IIDSGMGITTFPRAVFQTLRDELAKQVPLTVLDGTTIDGAELLCFSTSPNQKVPTIPKVILHLEGADWDLPRESYVLDFEDGCACRYLRRARAXDHHRQLQQQNMHIIYDLXXQQXGSVPAPCDCDHSNCTCM

SEQ ID NO: 188814 - protein, 186 aa, Triticum aestivum
  unsure (1)..(186): unsure at all Xaa locations
  Clone ID: PAT_TA_83232.pep
LSLXSCXPGXFRGGSRGXXCXRLRXRXDPGRGFAXCPGKMSXTXXDARPGWLFGWNXGTGARFDDDVVXIPSFKXXRRXVLEEGSSLLGLLFLGIISFTCSNASLSPLAEPRGWSWTERPPPSSSSRSPSLSRKPMMALAPWWQGAQMAFLGSLYTDATGLQMQQSMPCCCFFFLLPPXSSETRCY

SEQ ID NO: 188815 - protein, 110 aa, Triticum aestivum
  unsure (1)..(110): unsure at all Xaa locations
  Clone ID: PAT_TA_83233.pep
PPPLXFYIYIYIYIYIYIEEGEGNTPXNQPCAAPPLXLVLVXPPXTSVVLGEALQIVSPSLLPRCRAVGIIYYFASLARSRRRGRHRAEPVLNAEVPYVQYLIEMDREGV

SEQ ID NO: 188816 - protein, 140 aa, Triticum aestivum
  unsure (1)..(140): unsure at all Xaa locations
  Clone ID: PAT_TA_83234.pep
GIGSRNGYGPPFKNLEFXVFSWEXKAPGAQLLLWGLRMFXKPGYPXGGSLAGYQKXPASNMCMYFPRFAAFNFTKGGMALFNHGRGQPLQYVVANSFIAALYADYMEAVNVPGWYCGPNFMTTNDLREFARSQINHVAHL

SEQ ID NO: 188817 - protein, 89 aa, Triticum aestivum
  Clone ID: PAT_TA_83235.pep
NPEVNMCLGFHCLWSLVYQKGLHRSLHGRSAGIFARSKSCPLLPWTNVSLAGSAGPASKNFFHFDICPIVVFMFLLNPVVNEKGRHLPP

SEQ ID NO: 188818 - protein, 86 aa, Triticum aestivum
  Clone ID: PAT_TA_83236.pep
RVPEEILHQQLLGSEAATKISSLPVEVPLTCTLNKTLRNTSGPIYFITLCFALFELDLITWSSLLNEMVSASETVVTHRPCFPSSC

SEQ ID NO: 188819 - protein, 84 aa, Triticum aestivum
  Clone ID: PAT_TA_83237.pep
TRCLEEGADEFFLKPVRLSDMNKLKPHILKSRCNQEQHQQSDSHSGERRNPTIGSSSDSINNRKRKGAGTEEILPQLANSSRHS

SEQ ID NO: 188820 - protein, 135 aa, Triticum aestivum
  unsure (1)..(135): unsure at all Xaa locations
  Clone ID: PAT_TA_83238.pep
ALLDDSHHAWRAASELNRSNFGCQXXXLXLXGXNQXXHSTCPIQFKXKIXXXIGTQRXNLIGDXNNKTPCXPXNRXGVXTXPFPXXPXXLRVLXQXFNXXEHNFXEDKRXTXEXXRTKQAGGSTPQRXSPRGPXF

SEQ ID NO: 188821 - protein, 187 aa, Triticum aestivum
  unsure (1)..(187): unsure at all Xaa locations
  Clone ID: PAT_TA_83239.pep
RIIPAIATSTAMATGLVCLELYKVLAGGHKVEDYRNTFANLAIPLFSMAEPVPPKTIKHQDMSWTVWDRWTVTGNMTLXELLXWLXEXGLNAYSISCGTSMLYNSMFPXRHKERLDKKXVDVAXKWQIGVPSYXRHLDXVVACXDDDDXDSNPSFNLLRGTRRLMILCLSFIPCNSRAKPSMIPTGN

SEQ ID NO: 188822 - protein, 122 aa, Triticum aestivum
  unsure (1)..(122): unsure at all Xaa locations
  Clone ID: PAT_TA_83240.pep
DGGEFHAYEXMSCGGIGRDVGAXDAFGTVFSRPVAVSVCGRXGVARPHRGVYLVLCRLLVFDPAAAPVPSWLAGSRVPLLCVGGERRAGLLVRCVRWLQPHYRVLLGDMGPRHAVGAAPSTA

SEQ ID NO: 188823 - protein, 103 aa, Triticum aestivum
  unsure (1)..(103): unsure at all Xaa locations
  Clone ID: PAT_TA_83241.pep
KXECPPXFLQXSRVILLXYNNXLYQGIWYNMXYXGLNXFXLXXSMXSDLVRFXDELCELYFSXXFXILCLLDPMSYIEITXXQPAXXPRXAQTYPXPRTGQMP

SEQ ID NO: 188824 - protein, 42 aa, Triticum aestivum
  Clone ID: PAT_TA_83242.pep
NRRNREPPQRFRRRDDGPRPGQGPPRPGAAATAAPPAAAPRT

SEQ ID NO: 188825 - protein, 153 aa, Triticum aestivum
  unsure (1)..(153): unsure at all Xaa locations
  Clone ID: PAT_TA_83243.pep
MAALLRLAAARSALPRRALAPHRRLAAAAAAAMEEWWSDWEQDGEEEARASAPAAGLDPAGGGPGGVQWVVMGRPGPQKHAHAARLAEVLAVPXISMGALLKQELNPXSQLYXKIANSVNXRKLVPEEYIWLLTKRXRTVQQGEXGHSGSSTV

SEQ ID NO: 188826 - protein, 82 aa, Triticum aestivum
  unsure (1)..(82): unsure at all Xaa locations
  Clone ID: PAT_TA_83244.pep
KISGIPSLLIGSKSDKELSGLTKQVEKMNVASAFYLVLHALLYFPLPRLRPPFXDGPTSMTISNEGIQDLIGVDGQQHSCIW

SEQ ID NO: 188827 - protein, 175 aa, Triticum aestivum
  unsure (1)..(175): unsure at all Xaa locations
  Clone ID: PAT_TA_83245.pep
XXRNVVQTILNXMXILHXFIXIXALHNRXYLTDFYSQFTQEEGIDHFHVHLVNCTXDNSILQKLRXREGLSSGHGSAVLAPSMPSGLSRTAAALAPWSAACRGGGRGASGGGCGAARRPCPAPPPRGAGTGSSSPARPRRRCLRRRRTRPAAARSWTPWRTTWRGRCWFLFLPLM

SEQ ID NO: 188828 - protein, 124 aa, Triticum aestivum
  unsure (1)..(124): unsure at all Xaa locations
  Clone ID: PAT_TA_83246.pep
TNSTTKRVNAVNGDRSLISLYAWKREHGYIILIVFXFVRRVFLLLLLXLGCATMPAIFNRWSLGFNTKEXIXGXMTQTSSSNTLXIXCPXDILXPGXTLKTMQFRVNAQLLQNXSXXXXLXTPH

SEQ ID NO: 188829 - protein, 99 aa, Triticum aestivum
  Clone ID: PAT_TA_83247.pep
RKGCPFLVFSGARRVATLLNEMKRRGRDCRFGVVTMCIGSRMGAAAMFELCSARLEVSTITQHCNPMVIGDRELPCYCVLILETFIMTMYEILSLISTG

SEQ ID NO: 188830 - protein, 134 aa, Triticum aestivum
  unsure (1)..(134): unsure at all Xaa locations
  Clone ID: PAT_TA_83248.pep
RAARLLLLLLLASSLLLSVVVAAXXTCPADLDSKCDGGAPDDWEGEFFPGVXKIKYEGXNXXEPLAYXWYTXXEVILGKXXKDWMRFIVXVLXTFRGXXADPFGAXXXXWPWXDGKIMMIYEPILKTGVKMCSW

SEQ ID NO: 188831 - protein, 150 aa, Triticum aestivum
  unsure (1)..(150): unsure at all Xaa locations
  Clone ID: PAT_TA_83249.pep
FXLLVVVSCVRQSYCRTGFPEIKSLXERKITKREALSAVDRVLVRAVVVPPHXCPWYFQCVIMYAWHGFHRLAGTGVGAALLCELGMCQAVLLQITPGALDGVRVFNHRTGGLPEEVALCFCYEGRSVLLRAERALCVSIDCDDPPRSWH

SEQ ID NO: 188832 - protein, 141 aa, Triticum aestivum
  unsure (1)..(141): unsure at all Xaa locations
  Clone ID: PAT_TA_83250.pep
SRLPFRCXKVQTPTQLKKXARQREKATRXKPPFRPPHPHPISSPPRLQGRRDEXSGAGCXGGXAXVXAAXRALXXPAERPRXVXGRQXGGXAXAAAACDTCRGGVMLLGRVMXXCSAGXVTXXLRILPHSLXLQARLLXSS

SEQ ID NO: 188833 - protein, 36 aa, Triticum aestivum
  Clone ID: PAT_TA_83251.pep
QVSKEKIKSIGIELIPLETSVKETIESLKEKGFASF

SEQ ID NO: 188834 - protein, 62 aa, Triticum aestivum
  unsure (1)..(62): unsure at all Xaa locations
  Clone ID: PAT_TA_83252.pep
CXAXXSXCXXASLPNXAAXXPDPPRRPGTPXRCRXXPDPRGSRRFYSKNRLVLFENLDAFFY

SEQ ID NO: 188835 - protein, 119 aa, Triticum aestivum
  unsure (1)..(119): unsure at all Xaa locations
  Clone ID: PAT_TA_83253.pep
GRLTASKAAPYLSSAGHYGMSHGLSSGMATTIPCSSGARTTWQPRRACLLTRGPGRAREHYRSSXDVVELVKHSCAIGLASADSVISSRGAGTNRLYESYTRAHGVVXSLRENLRTTXP

SEQ ID NO: 188836 - protein, 153 aa, Triticum aestivum
  unsure (1)..(153): unsure at all Xaa locations
  Clone ID: PAT_TA_83254.pep
KTLTGKTITLEVESSDTIDNVKAKIQDKEGIPPDQQRLIFAGKQLEDGRTLADYNIQKESTLHLVLRLRGGMQIFVKTLTGKXTITLEVEXXDTIDNXKGEIQDKEXSPXPRTSXFXXKXLRMQTPKRPLWPFPGIIRVFNSIALAGANTPFL

SEQ ID NO: 188837 - protein, 67 aa, Triticum aestivum
  unsure (1)..(67): unsure at all Xaa locations
  Clone ID: PAT_TA_83255.pep
TSCSASCPAGSSSPASGGAVVAVSKIRPXEEGXDRLXGFSGXXAXLWTSKXXFSVFYSGXLFVDRSM

SEQ ID NO: 188838 - protein, 93 aa, Triticum aestivum
  Clone ID: PAT_TA_83256.pep
QPLPLLDSGELIISAPALGAVRPTAMAKLAAQLKSKFFGLVGRITSCGRAGATHKDAAGATEANHQWDPSLLRSGQRGGAPPRLMEGQGQHQQ

SEQ ID NO: 188839 - protein, 174 aa, Triticum aestivum
  unsure (1)..(174): unsure at all Xaa locations
  Clone ID: PAT_TA_83257.pep
MANCFGDVVDNYKLDTMPRYIGKKKTREDRAREASYLSNENEKYKKAKDYVNMLKDWXYGNGASTLCVIYNQTGGTLRYVDDKDWAGATRGPXPTPTEIGNGNWXPPPLHKTGXXXXPMAAVVYRGKDGGXXSATXHGWTPWGAPKNRATANNSVLPIQKITRDTYTWTTSPKE

SEQ ID NO: 188840 - protein, 75 aa, Triticum aestivum
  Clone ID: PAT_TA_83258.pep
TYVHTRFFFFAGSSHKTRTSRTKRTCSIHVIVFKATDRRRCAGPNLGRSHRYRTICKNEPHDLLPFLLCLVVLSL

SEQ ID NO: 188841 - protein, 116 aa, Triticum aestivum
  unsure (1)..(116): unsure at all Xaa locations
  Clone ID: PAT_TA_83259.pep
SLGIALTVYGREEEADTLIEQMTRDQDPILRYGGMYALALAYRGTANNKAIHQLLHFAVSDVSDDVRRTAVLXALGLSCYNEPEQTPKNCVPNYQESYNPHVPFXGTLXVRXSCAG

SEQ ID NO: 188842 - protein, 144 aa, Triticum aestivum
  unsure (1)..(144): unsure at all Xaa locations
  Clone ID: PAT_TA_83260.pep
VIFGAGGRRSPRWTRRPEIPGLPCCRIPLPAKTQVSSANQHYNKPFNWKAPAIILAFESWESIAYSGITLNLVXVTLGTVLQWEPPPPNATNVDXWNGATFXNAXVLGPFLXDTYWGXKXKTATISNNIHLLGCSKLQLWRNTS

SEQ ID NO: 188843 - protein, 106 aa, Triticum aestivum
  Clone ID: PAT_TA_83261.pep
VVARTLVQGEPKSHGGLMTLNDRFCAGEDNWLARSSTTPHSGTSDVWDNNGKPWHNRHKRRNNGDSTEDTTFNAGFSGSKSGQRKKPFKRNNQGPSSLDRILERSC

SEQ ID NO: 188844 - protein, 184 aa, Triticum aestivum
  unsure (1)..(184): unsure at all Xaa locations
  Clone ID: PAT_TA_83262.pep
LHSDLKPQRYQQPQQYQQYQPRQHQVQTDSYGRGRGRSRGRGRGWGTRGGYGGGYGGYEYDNNQVGYGGYEHHGGYGHQGGYGNQGGYGHNQGGYGHDQXGYGGYGYNQGGYGGYVFLPSENGGWNYNRNXSGGRGRAGLCGPGYTLWQKPSGLQGLCGLDNGCRLDGQQTLTRFTAYVSHPQF

SEQ ID NO: 188845 - protein, 61 aa, Triticum aestivum
  unsure (1)..(61): unsure at all Xaa locations
  Clone ID: PAT_TA_83263.pep
LASALAPAPFAFFPSFLATFAGFPRQALNRGLPLGFRFSALRHLDPKKLDXGDGSRSGPSP

SEQ ID NO: 188846 - protein, 139 aa, Triticum aestivum
  unsure (1)..(139): unsure at all Xaa locations
  Clone ID: PAT_TA_83264.pep
RGKGGKGLGKGGAKRHRKVLRDNIQGITKPAIRRLARRGGVKRISGLIYEETRGVLKXFWENVIRDAVTYTEHARRKTVTAMDXVYRSNRQGAPLRFRLPHLVANASAVGLFVCLSSVILLSCFVLVPIPIQPLSWKKK

SEQ ID NO: 188847 - protein, 90 aa, Triticum aestivum
  unsure (1)..(90): unsure at all Xaa locations
  Clone ID: PAT_TA_83265.pep
SGIWAKKNLKKAKDKTAIMGGNHSSTSTYDSCXFSSLEPSDSLEQCRSENCNLSSRRCILDKXTTRKKGRXAXQXXQINTXAKXGHXXEK

SEQ ID NO: 188848 - protein, 182 aa, Triticum aestivum
  Clone ID: PAT_TA_83266.pep
MPVRRRQPRRPETGAAERYREMGIGAALSRPWDYPTACGELAALLRLGYADLPKAAQALVASDVLLAFRLLPDVQTGYAVSTANVLLQAVEVALQNKRRPCSKFKHSIIAHKRRQESTNSGHTHTQDILSLSSDIILYKSLSLRENTKGKLPFFATLFKIGKTCFNLGGLKRALFTFQIQNN

SEQ ID NO: 188849 - protein, 72 aa, Triticum aestivum
  Clone ID: PAT_TA_83267.pep
DREAWEKWAAAYPASRVFVGVVASPEADKDAYMFQKDLYYNVLQFAQKAPNYGGLMIWDRYYDKMNHYISSS

SEQ ID NO: 188850 - protein, 129 aa, Triticum aestivum
  Clone ID: PAT_TA_83268.pep
APANSGRSLCVGGWGEQVVRGKSEVERNKRLEEAWVRSCTYDREIVSGHSFIHSFIHGHILWYYGVLRCTCSVPQERRRDGSSAFSICDGTGAFEEMMAMAWFCVLYGNICRWELIIKNPWLADAAKKK

SEQ ID NO: 188851 - protein, 66 aa, Triticum aestivum
  unsure (1)..(66): unsure at all Xaa locations
  Clone ID: PAT_TA_83269.pep
SVTATLASALAPAPFAFFPSFLATFAGFPRQALNRGLPLGFRFSALRHLDPKKLDXGDGSRSGPSP

SEQ ID NO: 188852 - protein, 144 aa, Triticum aestivum
  unsure (1)..(144): unsure at all Xaa locations
  Clone ID: PAT_TA_83270.pep
AIFDKKIDALFINNNHFEFTLPASFTNSTASVIVLANLPRVSGCLPSSIGDMAGTLNELILLNSGISSCIPPEIGKLDKLTVLDLSFNSIAGALPXTIGGMRAXEQLDVAHNRLNGEIPEEHLXLPHLKNXTYSYNFFCXEQAG

SEQ ID NO: 188853 - protein, 146 aa, Triticum aestivum
  unsure (1)..(146): unsure at all Xaa locations
  Clone ID: PAT_TA_83271.pep
MAEPSAAAVTAAEVGEESDAAAMEEVAAAAKRWPGWPGDSVFRLVVPVLKVGSIIGRKGELIKRLVEGTKAXIRILXGPXXATERXVLGSGKEXQXLELXSTMDALMRXFKRSMGITVDCQLLLPWCIAADVGSGAKELTNWNKCT

SEQ ID NO: 188854 - protein, 79 aa, Triticum aestivum
  Clone ID: PAT_TA_83272.pep
MELSRKLFTAVLLVMLLLLSAEVGPVAVAEARTCQSQSHRFRGPCLRRSNCANVCRTEGFPGGRCRGFRRRCFCTTHCH

SEQ ID NO: 188855 - protein, 118 aa, Triticum aestivum
  Clone ID: PAT_TA_83273.pep
DGTVETEPERTAAQPKHGGDVAQSQRYSPAREQCSSPKPVEVQKGISSTSKSNEPPCVSAAADSPAETASRWASMKTGFQNLKSDHGRLQGIPPIGLSPKGRDERSATESLRRILPET

SEQ ID NO: 188856 - protein, 151 aa, Triticum aestivum
  unsure (1)..(151): unsure at all Xaa locations
  Clone ID: PAT_TA_83274.pep
VQPNRTPSTLRMGLLLYAKGVTDRWQRREGYKCKKWGGWYSYLYSAPYLTLTAGDKGIKCPSGSPKQCRKGLLGAPPFATMAILSAXHATVHRWLHSLPPRAPGEAPXRHLVDAWXXAQSGPCHGNALPLLXLSVRNCPNGPQGGRTXSPX

SEQ ID NO: 188857 - protein, 145 aa, Triticum aestivum
  unsure (1)..(145): unsure at all Xaa locations
  Clone ID: PAT_TA_83275.pep
FLSSREGKNRQGERSGESREQGSAVTSSFSKVSRSAAMATRAASRFLQRRLLSSGGKVLSEEEKAAEKVYIKKMEQEKLEKLARKGPSSXEQPSSTTVSAASDVKTGAGPTDQRLQTCLPTKNXNYAVLASTIAALNGWLDHCQS

SEQ ID NO: 188858 - protein, 51 aa, Triticum aestivum
  Clone ID: PAT_TA_83276.pep
FFFFNSSNNRTIDPNETIIHATKITKSRQNQPLVIGAAKTPTNQVNKVITL

SEQ ID NO: 188859 - protein, 49 aa, Triticum aestivum
  unsure (1)..(49): unsure at all Xaa locations
  Clone ID: PAT_TA_83277.pep
PPLFFSTKLRINIIVIEMSXNNHILISPLPCTITKTKHNPNIPKAPKYL

SEQ ID NO: 188860 - protein, 144 aa, Triticum aestivum
  unsure (1)..(144): unsure at all Xaa locations
  Clone ID: PAT_TA_83278.pep
IVGTPAALLLQKANATVSIVHSQTKNPEQITRQADIVIAAVGVANLVRGDWIKPGATIIDVGINPVDDPXESPRGYRLVGDVCYXEPPRSPGAITPGPXSGVXPMTXAMLLKHLSAKTVQRIKLPPHQRSFNREKALALPTNPD

SEQ ID NO: 188861 - protein, 45 aa, Triticum aestivum
  Clone ID: PAT_TA_83279.pep
EPAADAAAGDAPRRARKEATMRAKWKKKRMRRLKRKRRKMRQRSK

SEQ ID NO: 188862 - protein, 79 aa, Triticum aestivum
  Clone ID: PAT_TA_83280.pep
MAVSSRFPSQPAARGLLRRTPQRILPVERTPRRLALVVTAVSGGPVPGGLPVPKRAPTPEDAATVAPTQCRCRRLGIDS

SEQ ID NO: 188863 - protein, 138 aa, Triticum aestivum
  unsure (1)..(138): unsure at all Xaa locations
  Clone ID: PAT_TA_83281.pep
VILETLFFRKKFSRNIKLSLSVLLLGVGVATITDLQLNLVGSVLSLLAIITTCIAQIMTNTIQKKFKVSSTQLLYQSCPYQALTLFLRRPFLXDGFLTNQNVFAFDYTTQXLFLIVLSCLISARXKLNTSXVIGKTRL

SEQ ID NO: 188864 - protein, 38 aa, Triticum aestivum
  Clone ID: PAT_TA_83282.pep
IIYSQPGRRSNMQMIPKLGLNEICYSITAQNVSLNGAQ

SEQ ID NO: 188865 - protein, 187 aa, Triticum aestivum
  unsure (1)..(187): unsure at all Xaa locations
  Clone ID: PAT_TA_83283.pep
MASTEQSMDLPVIDLDVYLNNPLDSEAVQEECRKAANALITYGALVLHDSRVSEEDNSTFLXDILEDYFAQPEEVSRKDEKPRADYQIGVTLREYRKPKCAVDXPCLXVIKRPVXHKRRWVFSXSPIQSANLWRMXXQPPLRPXPGXTPEVXLXPSYXXRGAIITWGLIQLENRGKKQFNGERKFSN

SEQ ID NO: 188866 - protein, 104 aa, Triticum aestivum
  unsure (1)..(104): unsure at all Xaa locations
  Clone ID: PAT_TA_83284.pep
ELRKVPNLKLTGPSRAVLLVDPVTIEADLKVKGRTESEDKHLSFLXVPILVMIPLESCLRTKRFTASLPEVALAMLFSQWRYNVQFVVGKAEGLVPIAATRDKV

SEQ ID NO: 188867 - protein, 111 aa, Triticum aestivum
  unsure (1)..(111): unsure at all Xaa locations
  Clone ID: PAT_TA_83285.pep
MSGRGKGGKGLGKGGAKRHRKVLRDNIQGITKPAIRRLARRGGVKRISGLIYEETRGVLKIFLENXIRDAVTYTEHARRKTVTAMDVVYALKRQGPHLYASEVGPLRTGEC

SEQ ID NO: 188868 - protein, 146 aa, Triticum aestivum
  unsure (1)..(146): unsure at all Xaa locations
  Clone ID: PAT_TA_83286.pep
PQTVLAPMPLDVPAATGIWASPMPAASDVGGVALEDAFLADLGAYGDLLLGGFGGQLLQDNKATAAMELPGACYFPNMAEMWAADHAHVHAKPPQGSATRSHRIHEMICSIGFVSTHVTETFSPIVYERSXITCEYYTRIDRKCTM

SEQ ID NO: 188869 - protein, 48 aa, Triticum aestivum
  Clone ID: PAT_TA_83287.pep
SSDVLEDSKTLADQKVDNDSIVALALRKDDGEFEEVFIARPEDFMSSS

SEQ ID NO: 188870 - protein, 84 aa, Triticum aestivum
  Clone ID: PAT_TA_83288.pep
VNLLGFHVSGNQPVHWIVARHRVSYLLFRSTVHLYWTLLCDSTARVMHGRFELNYLRIQTGPYFFLESNNSIESANQKRLFRFQ

SEQ ID NO: 188871 - protein, 143 aa, Triticum aestivum
  unsure (1)..(143): unsure at all Xaa locations
  Clone ID: PAT_TA_83289.pep
DFLSRFPGSPTVQPFCPLTQHLLXSIYLLVLVNKNRSWSWEGHDDPDSSFSTLKTGLKSQLTGQEKSGRSPLADSAARRTRTGEQPATACPGGVDGASSTGRERVSSCQVFGVRGSCGKQGGEEAEKLFWCALLLRLRGGEKG

SEQ ID NO: 188872 - protein, 89 aa, Triticum aestivum
  unsure (1)..(89): unsure at all Xaa locations
  Clone ID: PAT_TA_83290.pep
PPXGEVIRDAVXYTEHARRKTVTAMDVVYALKRPGRTLYGSAARLMGSSRCSPLLQMRRFLAVPTSLAVKKVSGTLVSSSLAVVGLSES

SEQ ID NO: 188873 - protein, 197 aa, Triticum aestivum
  unsure (1)..(197): unsure at all Xaa locations
  Clone ID: PAT_TA_83291.pep
PRPTSTRFLSYEELKVATNNFEPSSVLGEGGFGRVFKGVLGDGTAVAIKKLTNGGHQGDKEFLVEVEMLSRLHHRNLVKLIGYYSSRESSQNLLCYELVPNGSLEAWLHGTQGASRPLDWDARMRIALDAARGLXYLHEDXQPCVIHRDFKASNILXENXFHAKVSDLVWKARKSDNYLHRVMELRVCRSHTDTAVK

SEQ ID NO: 188874 - protein, 42 aa, Triticum aestivum
  Clone ID: PAT_TA_83292.pep
TEQARKDLERLTIIRQQRAEATKKREEEKAAKEERKANKALK

SEQ ID NO: 188875 - protein, 92 aa, Triticum aestivum
  Clone ID: PAT_TA_83293.pep
CSFTPEYLQAPIFFGSCFSELLELAFSGELDLISTEPFVLTFCSSRDDTGRGLGLSSLILADVSIRSGRPRTRLYMSSPKGMLSKSALPYDF

SEQ ID NO: 188876 - protein, 86 aa, Triticum aestivum
  Clone ID: PAT_TA_83294.pep
MKVRAAVKRLCRFCKVVKRRGIVFVQCTANAKHKQRQGFSTIAEAAAVSCVHLPPPPPASGSASAAAFAETRRWRGKNVYEFNWRL

SEQ ID NO: 188877 - protein, 74 aa, Triticum aestivum
  Clone ID: PAT_TA_83295.pep
TPELDSNRLVCHAILSSFLKVDAYCITLLVNFTSIVNLSLCKDLGVLSRCHFSEYCICPPSVICGSVYSIWLFA

SEQ ID NO: 188878 - protein, 88 aa, Triticum aestivum
  Clone ID: PAT_TA_83296.pep
PSLSSCSTPPFSLSSLLSSFSRVLVKKRQFDCTASPPLISSASPRPPSLSLSHSQTNKQTSLDRANSAELQKPLQARSNFSQPYSAFF

SEQ ID NO: 188879 - protein, 64 aa, Triticum aestivum
  Clone ID: PAT_TA_83297.pep
MASGIGSGQQQPPAPAADADPGAVGDKLVFEAPPQPVREDYVQNAVKFLSHPKVRGSPVVYRRS

SEQ ID NO: 188880 - protein, 156 aa, Triticum aestivum
  unsure (1)..(156): unsure at all Xaa locations
  Clone ID: PAT_TA_83298.pep
FKLLSGATFVGAIFCFGAFCFKSLYGFIPSFAVGELSVFATQAPVNFVCLHAVKPHLRPLAMAVSTVSIHIFXDVPSSPLVGLLQDKINNWXRETALILTSILFAAVVFWFIGXIFVPSVDRFXERERIWLTAAESQVSHCLGENDHGHLTKTAQS

SEQ ID NO: 188881 - protein, 169 aa, Triticum aestivum
  unsure (1)..(169): unsure at all Xaa locations
  Clone ID: PAT_TA_83299.pep
MADVDVEPEVAAGAPKKRTFRKYSYRGVDLDALLDMSTDDLVQLFPARARRRXQRGLKRXPWALIKETAQGEKGCPAGEXLTIKDTLRNMIIVPGDDWEHVGVYNGKTSNKLXVKPEMIGXLPAEFPISYKXVNTQAGIGATISRLSNELDLYPELGVIHSSNIIKKKK

SEQ ID NO: 188882 - protein, 142 aa, Triticum aestivum
  unsure (1)..(142): unsure at all Xaa locations
  Clone ID: PAT_TA_83300.pep
PLLRRLLLLAALAASCSYYLLFLQAQASVPPRYDGFAYGGGAATAWKDAVLVEAFLDPLCPDSRDAWQPLKLAVERYAPRVSLIVHPFPLPYHTYAFYACRALYIANXLNSSSTYPLLELFFKEQGKFYNSAHHLSRGPPVL

SEQ ID NO: 188883 - protein, 159 aa, Triticum aestivum
  unsure (1)..(159): unsure at all Xaa locations
  Clone ID: PAT_TA_83301.pep
RXPKXLXHLWAXLXSGYFCGVWSXIQXWXVSPKPWXXWEYWGXWXXIGIEXSVSIPCCRXWXMRRVLVQQGTSVRSCAQRXLQVLISRQIPLVPAFFIPPVXVYEYXXEGLCXLCRDLASSAWSSMSPIFSVASWXFXTLGDGFTLEVNHACYYSAIWR

SEQ ID NO: 188884 - protein, 52 aa, Triticum aestivum
  Clone ID: PAT_TA_83302.pep
QITRSAMAISSKHLLVGRGCAITCHCNIRLLTATQVALAYVVQVGNLASSTT

SEQ ID NO: 188885 - protein, 137 aa, Triticum aestivum
  Clone ID: PAT_TA_83303.pep
AGAPPGSSSRPPGPSSSPLLNAPPSPSSPPRAAPPRSPTLAGRSSPAPAPTTGRDPTPRRDGEHRCRIPAAFTCSKDQGGHAAEMERTFIAINPTASKEADSEIVNRFEKYNLLPSTDCPSKGSLRTYMIQGKASVV

SEQ ID NO: 188886 - protein, 74 aa, Triticum aestivum
  unsure (1)..(74): unsure at all Xaa locations
  Clone ID: PAT_TA_83304.pep
GCGSWIVIDGDRGVAPQSWRAFLAVLPALLAWVPHDPPQRTKGGSQPPGGSPGSTHCGTRDPXDTHGVLLIPGW

SEQ ID NO: 188887 - protein, 179 aa, Triticum aestivum
  unsure (1)..(179): unsure at all Xaa locations
  Clone ID: PAT_TA_83305.pep
PTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRXGDVVPKDVNAAVATIKTKRTIQFVDWVPTGFQXVGINYQQPASPSGDSPSQKAVCMIPTQRCGLSASTKRLMYLTCSYW

SEQ ID NO: 188888 - protein, 156 aa, Triticum aestivum
  unsure (1)..(156): unsure at all Xaa locations
  Clone ID: PAT_TA_83306.pep
MAAVLNSRKTPQAVVAVLVAAALLASSASAAITCGQVGSSLAPCIPYATGRASALPASCCSGVKSLNSAARTSADRQAACRCLKSLANSVKSVNMGTVATIPGKCGVSVGFPISMXTDCNKIAKLRRQANKLPNYTYSARCTNGRINKCMQDTSSK

SEQ ID NO: 188889 - protein, 70 aa, Triticum aestivum
  unsure (1)..(70): unsure at all Xaa locations
  Clone ID: PAT_TA_83307.pep
MADWGPVVVAVVLFVLLSPGLLLQLPAKGGRFVEFGNFQTXXASIFVHAIIFFALAAVFLIAIGVHITTD

SEQ ID NO: 188890 - protein, 201 aa, Triticum aestivum
  unsure (1)..(201): unsure at all Xaa locations
  Clone ID: PAT_TA_83308.pep
KRKFLSQKELKKQKIRTERAIGFTFTHSYYTCENAYSNFFLARDLAVGPRGKIALLVPHPPPADLAGVLVVGVVAASLVAAGAVVVVRLDASSAVGYWTHRPAAVVLGPGTSAPGKYDSTLLSTAAPPILPLYNSASAASTTRSRRCPCSACLGLNCRSRTPPPLPRLGSGSGSQVIGTKPXRHAXSPAXLXVPXALSEFS

SEQ ID NO: 188891 - protein, 173 aa, Triticum aestivum
  unsure (1)..(173): unsure at all Xaa locations
  Clone ID: PAT_TA_83309.pep
MEQNAGSFLAVRRLSGGAIHHHRHHSSPAEVVGVSTAWLGKGLSCVCAQRRESDVRLSFDLSPIQEECLNRLQNRIEVQYDGSNLEHQKALEALWXRSSFPGTELLGLXSDQWKEMGWQGKDXSTDFRGGGLXILGELLXFSRNYPKSFKSXSKQNGDRXXWEYXYWVNIHHA

SEQ ID NO: 188892 - protein, 129 aa, Triticum aestivum
  unsure (1)..(129): unsure at all Xaa locations
  Clone ID: PAT_TA_83310.pep
MIRFILLQNRQGKTRLAKYYVPLEDSEKHKVEYEVHRLVVNRDPKFTNFVEFRTHKVIYRRYAGLFFSICVDITDNELAYLECIHLFVEILXHFFSNVCELDLVFNFXXYLILDELILXGELQETSKKE

SEQ ID NO: 188893 - protein, 50 aa, Triticum aestivum
  Clone ID: PAT_TA_83311.pep
VLTMHFTSLVYSPVANLQSNRTTNTANRMYTRHKTADQISSSKQVVVQPA

SEQ ID NO: 188894 - protein, 89 aa, Triticum aestivum
  unsure (1)..(89): unsure at all Xaa locations
  Clone ID: PAT_TA_83312.pep
IVSPVVTLDVKXWDDETXMVXLEAAVRAIEKDGLVWGASQVVPVGFGVKKLQINMVVEDEKISVADLEEEIQELEDYVQSTDVAAMQKL

SEQ ID NO: 188895 - protein, 189 aa, Triticum aestivum
  unsure (1)..(189): unsure at all Xaa locations
  Clone ID: PAT_TA_83313.pep
MAASRSALITLLVLVSSVAAASATTFTVGDSSGWSRSVNYDNWASGKTFTDGDQLVFNFATGNHDVVEVDKSGYDGCSTTNAANTIQNGPATVXLTSGTHYYICGISGHCSGGMNSLSPSARLRLRLRVPTPAAVATHHTTPERPAPSGGRRRYGHAPVRTLSPLRSIIMTSDRGSDKIFICTLIGLPY

SEQ ID NO: 188896 - protein, 154 aa, Triticum aestivum
  unsure (1)..(154): unsure at all Xaa locations
  Clone ID: PAT_TA_83314.pep
EQDVAKITNLNAFDIISLSEGFNLSGLFEESEKRKEARFTSSQSASTIISKLEDAATCSKMTIKKKEGGVLKMEGANEGRKGVLSIDAEIFEVTPAFHLVEIKKNNGDTLXEYENLFKQDMKPALKDIVWAWQGESKDNKPRTINHKLLNQFVP

SEQ ID NO: 188897 - protein, 164 aa, Triticum aestivum
  unsure (1)..(164): unsure at all Xaa locations
  Clone ID: PAT_TA_83315.pep
DHVRLHPAAVDDWHKKGGTVLKTTRGGFDLGKIVDGIVARGYTQIYAIGGDGTMRGALAIFEEFKRRGLNISITGIPKTVDNDIGIIDRSFGFQTAVEVAQQAIDAAHVEAVSAVNGVGIVKLMGRSTXHIALHATXSSRDVXCCLIQSGFTWKQGGCSILYNG

SEQ ID NO: 188898 - protein, 49 aa, Triticum aestivum
  Clone ID: PAT_TA_83316.pep
LRYQVPCYFTSAPSVCYVHYLAKSGTEFSLMGKFLLDWSTELFSVRPLF

SEQ ID NO: 188899 - protein, 98 aa, Triticum aestivum
  unsure (1)..(98): unsure at all Xaa locations
  Clone ID: PAT_TA_83317.pep
MADWGPVVIATVLFVLLTPGLLFQLPAHGRIVGFGTMHTXSGVAILVHAVLYFALITIFLIAIGVHIYAGLRPGVFNHTPSSLPLIIGPASFLVMYYY

SEQ ID NO: 188900 - protein, 72 aa, Triticum aestivum
  Clone ID: PAT_TA_83318.pep
MSCCGGNCGCGTGCGGCNMYPEVEAAGATLLVSATATHKASSGGMEMAAENGGCGCTQCKCGTSCGCSCCNC

SEQ ID NO: 188901 - protein, 165 aa, Triticum aestivum
  unsure (1)..(165): unsure at all Xaa locations
  Clone ID: PAT_TA_83319.pep
FQQGLYMGNGGGANVVAPGYTKGDGLGAEIVGTFILVYTVFSATDAKRNARDSHVPILAPLPIGFAVFLVHLATIPITGTGINPARTLGAAIIYNRDHAWSDHWSLGRPFIGAALAAIYXVIIKGIPFKTSLNCRGCAEVGNYCLPSLFAESSSLSLKTTAHARY

SEQ ID NO: 188902 - protein, 70 aa, Triticum aestivum
  Clone ID: PAT_TA_83320.pep
AKRVYCLGLLSCNKMSSNHLQSIFSHGGPLHYYSGEETISTSLDDGSSSSSSDISSPMLMTSVLVGCLTN

SEQ ID NO: 188903 - protein, 152 aa, Triticum aestivum
  unsure (1)..(152): unsure at all Xaa locations
  Clone ID: PAT_TA_83321.pep
FTPHIITVKPNEDVASKIMAFSQQGPRTTCIISANGALCTATLRQPATSGGIVTYEGHFDILSLSGSFLLAEDGDTXRSRTGGFERGTGLGSDGRILEVVLLGMLMAATPVQVVIGISIAELKTKRRQPNVTNIGATAQTSLGRLDATPIWT

SEQ ID NO: 188904 - protein, 187 aa, Triticum aestivum
  unsure (1)..(187): unsure at all Xaa locations
  Clone ID: PAT_TA_83322.pep
AHSAVGRGALEQKRATSSELATRARSGRRIGSDGVVQGAPPVGCRRRRCGVPGRRRGRQVRPAGTARHHRRRALQHRQPHRHRXSPAFPNADVELRCAGRXXGXRDDQHQRTFSMELDMTTAGAFNRRCTWWWNPLVNATRLTTRNSLLTARPAKRLLXXSQLFPPVSSRRXLLYQQXFTTTXXPIT

SEQ ID NO: 188905 - protein, 135 aa, Triticum aestivum
  unsure (1)..(135): unsure at all Xaa locations
  Clone ID: PAT_TA_83323.pep
LPDATGTTCGQRLEKVLGTEHCHILRVPFRTENGIVRKWISRFEVWPYLETYTDDVAHEIAGELQANPDLIIXGNYSDGNLXACLLPHKMGVTXHCTIAHAXLEKTXYLTPDSNWXKXFEXHXHFSXHSTTDLMQ

SEQ ID NO: 188906 - protein, 60 aa, Triticum aestivum
  Clone ID: PAT_TA_83324.pep
YLPTFFCNLVFFSFFYKYVLLQFHFKYESSTASVGHCFSDVETTVCLYVFANNRTEANTV

SEQ ID NO: 188907 - protein, 83 aa, Triticum aestivum
  unsure (1)..(83): unsure at all Xaa locations
  Clone ID: PAT_TA_83325.pep
GFGTGPPYPXXFLSGIXLESSITYLDLQXYFITKMEHQSLPVASHKQFSVACFQNAEIIACYLGYQGQVIYVPPQETIXFREQ

SEQ ID NO: 188908 - protein, 99 aa, Triticum aestivum
  unsure (1)..(99): unsure at all Xaa locations
  Clone ID: PAT_TA_83326.pep
MATEQAAENYTVEDLVALNPYNPDILNDLEXFVNEQVSSQTYNLXDANLSLLRLYQFEPERMSIQXVAHILIKXLMAMPTPDSICXLILIPEHVQMEDN

SEQ ID NO: 188909 - protein, 79 aa, Triticum aestivum
  unsure (1)..(79): unsure at all Xaa locations
  Clone ID: PAT_TA_83327.pep
MSCCGGNCGCGTACKCGNGCGGCNMYPEAEAAGATLLVSATATHKASSGGMEMAAENGGCGCTQXCKCGTNCGCSCCNC

SEQ ID NO: 188910 - protein, 70 aa, Triticum aestivum
  Clone ID: PAT_TA_83328.pep
IVKGDYLMIKGCCVGPKKRVVTLRQSLLKQTSRLALEEIKLKFIDTSSKFGHGRFQTTDEKQRFFGKLKA

SEQ ID NO: 188911 - protein, 109 aa, Triticum aestivum
  Clone ID: PAT_TA_83329.pep
NSSTSLAPYQRLEKRHRRQDTDAGEARPAGSECSEVIGGARVRPAEVEVSESSCPVSVLESDLACPKQLADDAEAIEKSSACDELTPSSEPDEEEVLSDSSHSGTPPVP

SEQ ID NO: 188912 - protein, 87 aa, Triticum aestivum
  Clone ID: PAT_TA_83330.pep
QILRVKNCTLASQLATGRFEQMYRYQLKKNGLHCDHVDDKTVDSGICSTANSGNSFPPPTRQKNNRKTKGMSQLMCCSLLTTARLSS

SEQ ID NO: 188913 - protein, 89 aa, Triticum aestivum
  unsure (1)..(89): unsure at all Xaa locations
  Clone ID: PAT_TA_83331.pep
MGGAVSGGAAVGDAAGAATYPVVLNVYDLTPVNNYLHWGGLGIFHSAVEVHGSEYSFGAHDHXIEWSFEVEPKTAKVHIQMYGLKGTQL

SEQ ID NO: 188914 - protein, 91 aa, Triticum aestivum
  unsure (1)..(91): unsure at all Xaa locations
  Clone ID: PAT_TA_83332.pep
MERYEVIKDIGSGNFGVGQLVRDVRTKDXLRRQFIERGMKIDENVQREIMNHRSLXHPNIVKFKEVXLTPTHWHNYGYLLVVTGRIVCWKL

SEQ ID NO: 188915 - protein, 173 aa, Triticum aestivum
  unsure (1)..(173): unsure at all Xaa locations
  Clone ID: PAT_TA_83333.pep
VDADDNHSDADSSLGADNASSTDSLRSSILDFRQENGRTYHAFRDGKYNLPNDDEENERLDLQHNLFLLTLDNKLGLSPPNHPDSKVKRVLDVGXGTGIWAIDFGDEHPXATVIGVDLSPSQPEXVPPNVRFEIDDIDXEWTYSEPFDLFTTDYELGIKTGIYTRLQNLVSGI

SEQ ID NO: 188916 - protein, 117 aa, Triticum aestivum
  unsure (1)..(117): unsure at all Xaa locations
  Clone ID: PAT_TA_83334.pep
MVGPGLYTEIGKKTRDLLYKDYQTDHKFTLTTYSSNGVAVTATSTKKADLIFXSEIHSQIKNKNMTXDVKANSXESNIITTVTVNEIATPGLKTILTXVPDQXSGKVXLQYLHDKLD

SEQ ID NO: 188917 - protein, 179 aa, Triticum aestivum
  unsure (1)..(179): unsure at all Xaa locations
  Clone ID: PAT_TA_83335.pep
MINFVLLISRQGKVRLTKWYSPYTQKERTKVIRELSGLILTRGPKLCNFVEWRGYKVVYRRYASLYFCMCIDAEDNELEVLEIIHHFVEILDRYFGXSVCELDLIFNFXGYYILDEIXIAGELQESXKKNVARLMLHKINGXAAKXEXLISTQCQAQMLSCPLPQLYVKQCHRIIARQL

SEQ ID NO: 188918 - protein, 152 aa, Triticum aestivum
  unsure (1)..(152): unsure at all Xaa locations
  Clone ID: PAT_TA_83336.pep
VGKMTKQCPGFSLITVRVKDNQVLRGWIPDETNLRPITPKDDLAPDLPMLQPSKLQKKASAIHRQAAPPLPVHLRERYNCKPPQDEEAVGDIYWLSTSSLPAXKTLRWSWVVATTPVXVISGNVSKPCQTRHWXLSQEPQLRGAITIKPPTV

SEQ ID NO: 188919 - protein, 141 aa, Triticum aestivum
  unsure (1)..(141): unsure at all Xaa locations
  Clone ID: PAT_TA_83337.pep
SCRKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASHXKLNQLNSSGGADDDDEDDE

SEQ ID NO: 188920 - protein, 69 aa, Triticum aestivum
  Clone ID: PAT_TA_83338.pep
RASTQATRVRSPTAAYYSPLFFLSCTVRMTGWPHLSYSLSLSVYYLFIYLFIIIKCFISVPREFSISGI

SEQ ID NO: 188921 - protein, 81 aa, Triticum aestivum
  unsure (1)..(81): unsure at all Xaa locations
  Clone ID: PAT_TA_83339.pep
PFGXGTAPLXRRHYIXSIXVSAVXWAXHEGGXLLTDPQGQDLPMGSSSASRTTVAVCDVCSRLISQLARMLNLDATSVXST

SEQ ID NO: 188922 - protein, 47 aa, Triticum aestivum
  unsure (1)..(47): unsure at all Xaa locations
  Clone ID: PAT_TA_83340.pep
KIKVTRYQSTLYTMHYGEYVAYLKKNRGAAPSIXGAPPVVNGFKPSH

SEQ ID NO: 188923 - protein, 88 aa, Triticum aestivum
  unsure (1)..(88): unsure at all Xaa locations
  Clone ID: PAT_TA_83341.pep
LNATSXSWFYVAVXSTXTEKHQTKFQDYXRSCDXIXWXXTXKXDXYVMFISCSSCIVXRAVIGAGSPANSWTGLAPTARSSDYESXDX

SEQ ID NO: 188924 - protein, 82 aa, Triticum aestivum
  Clone ID: PAT_TA_83342.pep
AVHAVKCWRSLVVASQQGYIYAGSSGSGDSDVHAEDDVTHGGLPCGGLPGCYSDYVSTDASLPGSPRSLPCLFGRWFDSCVL

SEQ ID NO: 188925 - protein, 139 aa, Triticum aestivum
  Clone ID: PAT_TA_83343.pep
FTQVFSFINVQLFNSLLLRRECCSFSNGEYVKAGLDELEHWCFWLTEEYAGSAWDELKHIRQAVTLLILDDKHSRSLAEITDDFCPVLSMQQLYRISTMYCDDNLGPWAFHQNRLQHADQDDRRSSNSRRRTTTSTRSC

SEQ ID NO: 188926 - protein, 121 aa, Triticum aestivum
  unsure (1)..(121): unsure at all Xaa locations
  Clone ID: PAT_TA_83344.pep
MAQGRGSAXRGLALGSLLAAAFLLLLGVADAATHRVDWSFNXDSWSKGKSFRAGDVLEFNYDPSVHNVVAVDAGGYNGCRPSGTSYGSGSDRITLGPGTSYFICSLNGHCGMGMKMVVNAS

SEQ ID NO: 188927 - protein, 102 aa, Triticum aestivum
  unsure (1)..(102): unsure at all Xaa locations
  Clone ID: PAT_TA_83345.pep
ASVAATAIVADNHIPSSCSRLLTIRICSFSWGIILITKLSLGFCLPLAIWVSMSPKXVTXETCACINXCVREYTIYVIICLRXTYNVVDXMXASNTIISKKK

SEQ ID NO: 188928 - protein, 151 aa, Triticum aestivum
  unsure (1)..(151): unsure at all Xaa locations
  Clone ID: PAT_TA_83346.pep
GQDPTRHAAADPALVGKLPAAGAKQRRHDEKPRRAAPADAPRHGRPGPAAAAAGELRLRWAPRAPPRPRAVAPPSSKREAVSAVRRWLSLTLGFNKNNNRTYVADLSPAALPAPFPAGGRXRPYVMQGTLLXRQDAIPKGDGRHNLCMTGR

SEQ ID NO: 188929 - protein, 129 aa, Triticum aestivum
  unsure (1)..(129): unsure at all Xaa locations
  Clone ID: PAT_TA_83347.pep
MNCETCQLKELGXELTEIRDVLRCILHTIFFHRTSTWVRPKDVDCDXLDITYVQCGLTELEKELXRKDRQLSAWVEKHQTAEADCLSFRQNTDTWWLYKQAINGQHNPKIRVTVKVQTLTQGLGAYMGH

SEQ ID NO: 188930 - protein, 65 aa, Triticum aestivum
  Clone ID: PAT_TA_83348.pep
ARLISRRGLAGAADGHGSAKVPLWKDPLSPSKWKEEHFVLASLSMWGVIFYGGYKLFKWKEGSQD

SEQ ID NO: 188931 - protein, 139 aa, Triticum aestivum
  unsure (1)..(139): unsure at all Xaa locations
  Clone ID: PAT_TA_83349.pep
MATPAVKVYGWAISPFVSRALLALEEAGVDYELVPMSRQDGDHRRPEHLARNPFGKVPVLEDGDLTLFESRAIARHVLRKHKPELLGGGRLEQTAMVDVWLEVEAXPTDPPAIXIVVECVXPPFLXRERNKRGGQNWRN

SEQ ID NO: 188932 - protein, 77 aa, Triticum aestivum
  unsure (1)..(77): unsure at all Xaa locations
  Clone ID: PAT_TA_83350.pep
SHQDIRXVVKLPIXSSDMTYLCHLSESPPSYPXQIMIKXKHHXSVNXXLXGXXSPXPQKXXGEMXQLTTFTXRVQXX

SEQ ID NO: 188933 - protein, 80 aa, Triticum aestivum
  unsure (1)..(80): unsure at all Xaa locations
  Clone ID: PAT_TA_83351.pep
FSXCQYLXWEXSDQIXYXGFPFEFSCHPLXFYQXXLSSLQIXLDLGRRXNLRIGGTTXXERVRREGIGWRSLGSSPGEDM

SEQ ID NO: 188934 - protein, 112 aa, Triticum aestivum
  Clone ID: PAT_TA_83352.pep
DLLGGPTDWRRHRRRLPPVRAEGQRHQARVLPEQRLSSARTRQELGTVPILFLHMTPCSVSVWPGLRSLAAVFYFGPKCDISLLSVYVCRNASCKENLEYNCVSFYPIKKKK

SEQ ID NO: 188935 - protein, 100 aa, Triticum aestivum
  unsure (1)..(100): unsure at all Xaa locations
  Clone ID: PAT_TA_83353.pep
YADAITCYTEVLRIDPTAADALVNRGNTFKEIGRVNEAIQDYVQAATIRPNMXEAHANLASAYKDSGHXETXIINXKQXLRLRPDFPXXTCNXLHTLQCV

SEQ ID NO: 188936 - protein, 184 aa, Triticum aestivum
  unsure (1)..(184): unsure at all Xaa locations
  Clone ID: PAT_TA_83354.pep
EVPHPTAVPELPKPEVPHPVPELPKPEVPPHPTAVPELPKPEVPYPVPELPKPELTPHPAAVPELPKSEVPHPVPELPKPEVPPQPTAVPEXPKPEVPHPVPELPNXELPPHPASQTSKPEVPHXIAPKLPNLNPPHPTCKTAAPVPECKHNCRLYETDCNEAGGHTGAGGKHGVIRDRYSIFR

SEQ ID NO: 188937 - protein, 116 aa, Triticum aestivum
  unsure (1)..(116): unsure at all Xaa locations
  Clone ID: PAT_TA_83355.pep
RLSQIELDGSFEAGLVTCMEKMVEDVVLQDKINDELVAYRKEQGTFGREIAKRQRRNKSFDPAQWWPSWVKIHQTQEYWAMRILXWTCXSSACEEDLSVFKQVRKXYNYPVLNFSY

SEQ ID NO: 188938 - protein, 116 aa, Triticum aestivum
  unsure (1)..(116): unsure at all Xaa locations
  Clone ID: PAT_TA_83356.pep
MAYVERGVVKDKRTIWRLSIISDFFRAIVNFIRIFFDTLFSVDKTDSYKKGYGAGKKWDGGPVVVVGGAKEGGRWSVFWRXGXGVXRGPRTLSDIQSNDHSLSLLVVPAANDPRSA

SEQ ID NO: 188939 - protein, 222 aa, Triticum aestivum
  unsure (1)..(222): unsure at all Xaa locations
  Clone ID: PAT_TA_83357.pep
PGPWASSQQAAAAQLMALLNSARSVQGGGGGNMHRLLGLDAVAHLPLHVLPGAGNNAGGTAPSFWPQAAPRVIPAPPHMDPTRHGAAGPARRAVQPPGKVPRHRRRRRQXLQRPLHPVVTRRRTRTRLRNTACATHCLAHXADSSRRARXAFAHWQRARRLXSAGLLSRPXQYGPAAHXVLADXHPXXFLXTXXTVRXXXHNTYYLXSIXTILLYXXXTXGV

SEQ ID NO: 188940 - protein, 132 aa, Triticum aestivum
  unsure (1)..(132): unsure at all Xaa locations
  Clone ID: PAT_TA_83358.pep
AEELTRGYVXMRKRGNXPGSXXKVITATARQIESLIRLSESLAXMRFSEVVEVRDVVEAFXLLEVAMQQSATDHXTGXXDMXLIXXGIXAXXRXRRENLIAXTXNLIAXXMXXGGPHFPGGTEEMEHSTIRA

SEQ ID NO: 188941 - protein, 100 aa, Triticum aestivum
  Clone ID: PAT_TA_83359.pep
MISTTFTRLRPMISSRNLYLRGVSKRTYANKPPSPVSQFYRTFTRPIAKTLLIAVFTYQLAYWTWVKLETDEIRAEREATIEKLEATIKDYDAATKANKA

SEQ ID NO: 188942 - protein, 140 aa, Triticum aestivum
  unsure (1)..(140): unsure at all Xaa locations
  Clone ID: PAT_TA_83360.pep
MPPNRKRRAAAMDPAAGGAGQQRQNKASAGKKVKKGGGSGGRWPAVKPKKDLQINRLKGTHLLTIPDFFTSAEAKAFIDIAESMGFTHQGSLGPLKGXAYRDNERISVTDXLLAQAIWESGITXFTDINVSGKVQQDESI

SEQ ID NO: 188943 - protein, 146 aa, Triticum aestivum
  unsure (1)..(146): unsure at all Xaa locations
  Clone ID: PAT_TA_83361.pep
MKIIPVPCLDDNYAYLIVDESTKKAAAVDPVEPEKVLKAAGEVGAYVDCVLTTHHHWDHAGGNEKMRLQVPGIKVFGGSLXDNVKGCTDQVENGXELSLGKDIEILCLHTPCHTKXHISYYVXSKEGEDXAVFTGDTXFNAGCGXF

SEQ ID NO: 188944 - protein, 128 aa, Triticum aestivum
  unsure (1)..(128): unsure at all Xaa locations
  Clone ID: PAT_TA_83362.pep
MAARSSSSQPQLVAAAAVLAAALLLLAAGAGTASAAVSCGEVTSSVAPCLGYAMGSAASPSAACCSGVRSLNSRASSTADRQAXCNCLKSMTGRLGRGVSMANXANIPXXCGVSVGVPTHRRWHKITD

SEQ ID NO: 188945 - protein, 178 aa, Triticum aestivum
  unsure (1)..(178): unsure at all Xaa locations
  Clone ID: PAT_TA_83363.pep
LVFNAVGGGTGSGLGSLLLERLSVDYGKKSKLGFTVYPSPQVSTSVVEPYNSVLSTHSLLEHTDVAILLDNEAIYDICRRSLDIERPTYTNLNRLVSQVISSLTASLRFDGALNVDVNEFQDKLVPYPRIXMXSSYAPIISAEKATRAALCAXXTTVPSIFMQVDHAWSWLLSLRWPK

SEQ ID NO: 188946 - protein, 112 aa, Triticum aestivum
  unsure (1)..(112): unsure at all Xaa locations
  Clone ID: PAT_TA_83364.pep
MGQQQQGPAARRMATLASHLRHPSVSHPQMEDVPLLRGSNCRAKGAAPGFKVAILGAAXGIGQPLALLMKMNPLVSVLHLYDVVNAPGVTADIXHMNTGAVVLALGQPQLEP

SEQ ID NO: 188947 - protein, 93 aa, Triticum aestivum
  Clone ID: PAT_TA_83365.pep
AFASGIFITIGNSAGVAAPFLFSNEYEPHYRPGYGASIGMLALAVCIHTTVYLHFKRLNKRKLSGQEDWRMEGKTEEEIAELGEHNPRYMYTL

SEQ ID NO: 188948 - protein, 122 aa, Triticum aestivum
  unsure (1)..(122): unsure at all Xaa locations
  Clone ID: PAT_TA_83366.pep
GSNRAATNQTGASSKLYEASRGKMCTCAGSGDXHLDXLFWQKEXDLTTDTEITXNNLXEKSIXVTXLEXVMETNYIXFVRWHTNXKXXEXLXXXTXXKSXILTQGPTFQGLTPGXKRGTVQY

SEQ ID NO: 188949 - protein, 167 aa, Triticum aestivum
  unsure (1)..(167): unsure at all Xaa locations
  Clone ID: PAT_TA_83367.pep
SLSSRGISSRPVPRSTMKFVAAYLLAVLAGNASPSADDLTAILESVGCEVDNEKMELLLSQLSGKDITELIAAGREKFASVPCGGGGVAVAAAAPAAXGGAASAAEAKKEEKVEEKEESDDDMGSTSTKLHSHHSIVLGSETRGKQIMLDLNLKLESTGKMHCKLIT

SEQ ID NO: 188950 - protein, 74 aa, Triticum aestivum
  Clone ID: PAT_TA_83368.pep
SLRRLLGRLSYNLVVPGTTPLSIKSIKEPDLLGFELLNGYTPDILWVANPIHSSNRKSLLFLLARVESKSGEPG

SEQ ID NO: 188951 - protein, 73 aa, Triticum aestivum
  unsure (1)..(73): unsure at all Xaa locations
  Clone ID: PAT_TA_83369.pep
MGGGMEVHKNRWIEEWNAGRENLEFNFRWXTRRSLAVVRLFRLAVPILXVYKGIXRESNMQDEDASPAYRXSL

SEQ ID NO: 188952 - protein, 116 aa, Triticum aestivum
  unsure (1)..(116): unsure at all Xaa locations
  Clone ID: PAT_TA_83370.pep
GLLPRLEEEAYDTADRPPRGRDREAFLRKAQPSPQRHPNKNAWGDMPDLRDILGGQSKAFKDRSTXNEGAPLLRDGKRHPXIQLKLTRQARTQRAXPIRXLRNIPQYKSAHTLYAS

SEQ ID NO: 188953 - protein, 100 aa, Triticum aestivum
  unsure (1)..(100): unsure at all Xaa locations
  Clone ID: PAT_TA_83371.pep
KRLGEPTVPTLEDGLWRYSRHPNYFGEQLWWWGLYLFAWNLGQRWMFLGPLXVNSLCLGYVTVLVERRMLKXEHRAEAYNYTKKXTXVWXPWVKEVPEPN

SEQ ID NO: 188954 - protein, 99 aa, Triticum aestivum
  unsure (1)..(99): unsure at all Xaa locations
  Clone ID: PAT_TA_83372.pep
MNGINPNGGFLSYGNMESYAMWVATGVASAFFASLERCSCIHLHTAEDDGDXEEEXXXRPPSFSRRFPEYYYDRXRSSRSVAKMLPDRTAPPSAPRNAW

SEQ ID NO: 188955 - protein, 47 aa, Triticum aestivum
  unsure (1)..(47): unsure at all Xaa locations
  Clone ID: PAT_TA_83373.pep
RXXNILRILILGFYSNIKQNKIKWHCKDXTTYVKEAKLXSTDTNRYC

SEQ ID NO: 188956 - protein, 54 aa, Triticum aestivum
  unsure (1)..(54): unsure at all Xaa locations
  Clone ID: PAT_TA_83374.pep
APFAFFPSFLATFAGFPRQALNRGLPLGFRFSALRHLDPKKLDXGDGSRSGPSP

SEQ ID NO: 188957 - protein, 108 aa, Triticum aestivum
  Clone ID: PAT_TA_83375.pep
MADTFAHPLASGFTDVANACCGGGRLGAEAPCAPNATLCADRGLYYFWDSVHPSERAAALRAQAFCDGPAQYTTPINFKQLGPHGMIGLTHLLITQRNNYTKMILCQK

SEQ ID NO: 188958 - protein, 155 aa, Triticum aestivum
  unsure (1)..(155): unsure at all Xaa locations
  Clone ID: PAT_TA_83376.pep
PTAVASSLPNTVRHRPRGPASNQSPKLSHGASQPPPRPREARRALLLRRWRLPPRASASAWSPERSPSGRLPPSPPCSSTSSAPFPHVAAVCGALYSSSLDRATXATAPTPWLSMHCRAAXKRLSPXIGAQRQVYXXQXFXXXGNISRASSRCRL

SEQ ID NO: 188959 - protein, 52 aa, Triticum aestivum
  Clone ID: PAT_TA_83377.pep
KYRSSGQSTLLLLYYTITTSLPPFDFSTCCRCCSGVRSLDMFGYIGTILKLF

SEQ ID NO: 188960 - protein, 91 aa, Triticum aestivum
  unsure (1)..(91): unsure at all Xaa locations
  Clone ID: PAT_TA_83378.pep
XNWXMXAFXYPXEGXLXVIGXRFSRQXLXTPWXVXIFWAIGTGPPWXKXRDLLRPQGKESSQGPVRILPSVQHPHPGVXCGEVPTLGIALR

SEQ ID NO: 188961 - protein, 56 aa, Triticum aestivum
  unsure (1)..(56): unsure at all Xaa locations
  Clone ID: PAT_TA_83379.pep
VXHDPXXXGXPIGKIFLSXLIFKNIFFLSSXXIFIXIXXFTXXXPLSPFXHXKIQL

SEQ ID NO: 188962 - protein, 122 aa, Triticum aestivum
  unsure (1)..(122): unsure at all Xaa locations
  Clone ID: PAT_TA_83380.pep
MPVDVEAAMAPPQAASACSSSSIGRDSDECSPPGKEEEKGRGKGAERXXGEGGGGSLAGLEALEEALPIRRSISKFYNGKSKSFVCLKEAITFSRLLQKDITKXXNAYSRKXXNFLIIMYGT

SEQ ID NO: 188963 - protein, 120 aa, Triticum aestivum
  unsure (1)..(120): unsure at all Xaa locations
  Clone ID: PAT_TA_83381.pep
EYRSIVFKEPRFVEYFRLATPETEYGRMNIGSRPSKRKPSGGIDSLRAIPWIFAWTQTRFHLPVWLGFGAAFKNVXKKDIRNLHMLQEMYNEWPFFXRVTIDLVXEMVFPKGIPGIAALL

SEQ ID NO: 188964 - protein, 149 aa, Triticum aestivum
  unsure (1)..(149): unsure at all Xaa locations
  Clone ID: PAT_TA_83382.pep
GHKDVLEGDPYLKQRLRLRESYITTLNVCQAYTLKRIRDPSFQVSPQPPLSKEFTDESQPAELXVQLNQQSEYLQAWEDTLILXTMKGIPAGHARTPAKPNLPCANNCLPMRRWTICVSLWTFIHRAFPGVFMSDLLLVACCCQGTYWC

SEQ ID NO: 188965 - protein, 108 aa, Triticum aestivum
  Clone ID: PAT_TA_83383.pep
ANRPIVHSHEDLAKKLQEAMDINKRSSSGTRSSDVSGKRMREVACPTCTVHLQVEVPASGSETIECGVCQNPFLRQRPLNRVQRFRLAADSSRIRKRRFALFNTWRLI

SEQ ID NO: 188966 - protein, 56 aa, Triticum aestivum
  Clone ID: PAT_TA_83384.pep
LSYLFTAAHSALPAHLHRSFVLPLYARIESLHVDICGDLTAGDCPRALFSTSCALP

SEQ ID NO: 188967 - protein, 107 aa, Triticum aestivum
  unsure (1)..(107): unsure at all Xaa locations
  Clone ID: PAT_TA_83385.pep
XADERRRLXVLSRRXSPMPVESXPGXILSGSVXPRXGITPESFTLSVRWPSLXNLKPEXPTPSVVCSVQRRREEVNNXSNMQSSAIMWIGQYXTAQEALVHEWGRRI

SEQ ID NO: 188968 - protein, 140 aa, Triticum aestivum
  unsure (1)..(140): unsure at all Xaa locations
  Clone ID: PAT_TA_83386.pep
RSKWVPCLEFSKVGFIFREHNASPGYYDGRYWTMWKLPMFGCTDATQVINEVEEVKKEYPDAYVRIIGFDNMRQVQCVSFIAFKPPGCEXPARPKQSLTTGIYKHCILSILTCFGVSSPLLPNCSLKKLYMFMQTGRISY

SEQ ID NO: 188969 - protein, 112 aa, Triticum aestivum
  unsure (1)..(112): unsure at all Xaa locations
  Clone ID: PAT_TA_83387.pep
VMKRTTLVANTSNMPVAAREASIYTGITIAEYFRDMGYNVSMMADSTSRWAEALREISGRLXAEMPADSGYPAYLAARLGILLMNVLGKVKCPGPRQGMACPQLLDCLSLPG

SEQ ID NO: 188970 - protein, 162 aa, Triticum aestivum
  unsure (1)..(162): unsure at all Xaa locations
  Clone ID: PAT_TA_83388.pep
NFEEVDFDRTDAVDKVMDDFDTSRNDVVEEEEFVQGMRKWLDEARRSVPVGGAFSSKFIHEYHERTRQEHDELVDRSDEAVESVENPGWCIAKXVALLLLGSAAAAAFADPLVDAVHXXSNATRIPSFXLLIALPLXTIQRXSRIIFATRRTXDCPSXSEVY

SEQ ID NO: 188971 - protein, 147 aa, Triticum aestivum
  unsure (1)..(147): unsure at all Xaa locations
  Clone ID: PAT_TA_83389.pep
SSAATKPNPKPKAAPKKPKTGAKKPKAAAKTKAKTPAKAKPATKPKPAAKPKAVVKPKTPAKPKAKPAAKAXPKTAGAKPXPLAKKXAPAKAAKTRQGHAKEEAPVAKNPAAAAKKPCQEAVPXKKXDXVRKXSRKARINGKKGAHL

SEQ ID NO: 188972 - protein, 146 aa, Triticum aestivum
  unsure (1)..(146): unsure at all Xaa locations
  Clone ID: PAT_TA_83390.pep
FLNPEINYNEKSYVCMYKITLEQFNDILFQENRLVLEDGKDGNTVYPDSPLIGSSEIKFISTNRAVHLEPIKDSWYSNVLYLGNEDEVPILTMTCPASDIERYKSGELRLAPPSETYAATXIKGLVESKQMDAGRTASSQPAAARC

SEQ ID NO: 188973 - protein, 100 aa, Triticum aestivum
  unsure (1)..(100): unsure at all Xaa locations
  Clone ID: PAT_TA_83391.pep
AIHTASIKYNPQLPRMASGYSRTRICQRQRCEKSKQANRLPVSSNGIELVVILVGVSSGTCLDNFTRISXASSPANMSRTIHSSQRHISMPPNNPLNNSY

SEQ ID NO: 188974 - protein, 122 aa, Triticum aestivum
  unsure (1)..(122): unsure at all Xaa locations
  Clone ID: PAT_TA_83392.pep
RLFRPSSCAGRHDLPAGLLLQRGAAPRGRAVQDHPRRGAGGRAGPLLPGPLRFPYDPEDHAPVINGRARGGRDPLGRSVKRTPVLDSWTDGGGPPXXGRSGPLRFPXAERDGXGWKSXASXA

SEQ ID NO: 188975 - protein, 146 aa, Triticum aestivum
  unsure (1)..(146): unsure at all Xaa locations
  Clone ID: PAT_TA_83393.pep
VGVVATARRVTCCCSSWAVVAGCMVMTILCRERVQCSVLPKGDGSLLLGWTRRLQPCKPRPTLQVPTTAHVSTSTSGGSSSQRNKQLPXNXTHSLLXTSXTXPXXXARCXRLLCXPDWTTSXALSRPNNHCSPLTRAAKXQSTAXK

SEQ ID NO: 188976 - protein, 180 aa, Triticum aestivum
  unsure (1)..(180): unsure at all Xaa locations
  Clone ID: PAT_TA_83394.pep
FGFRIAYLTSTVGEPFVSGEAVRALQPAGQEQATKKMSTLDTRTLKDELTSMDRKCLVDLGHPLLNRVADSFIRAAGVGAARAVSREAYVVTVEGFXGDSSGLGRRRRQAGPFSNIKVTTAKVAPRSGKNAGKEPMGVNRILGHYRGSKGSTTGKNASPLGVPHGERIDNSLHTGPSGTV

SEQ ID NO: 188977 - protein, 152 aa, Triticum aestivum
  unsure (1)..(152): unsure at all Xaa locations
  Clone ID: PAT_TA_83395.pep
MFGNIGKIPIIGDLTGSNKNAHLKGNLVLMRKTVLGFDVTXSIAGSLMDGLGEFLGRGVTCQLXVAPPSVDPNNGNRGKVGQXEASLGAWXLHPPPAAGRRXPFRVTFRLGKWEKHGXPGXIILKEQHXSRFFLQDITSIPRQGHRLANGVP

SEQ ID NO: 188978 - protein, 162 aa, Triticum aestivum
  unsure (1)..(162): unsure at all Xaa locations
  Clone ID: PAT_TA_83396.pep
VEXLPVMSCMMDLXFXNXITCCLXIXGLTICYXPGEERWCSHGLDTQSGXLXERIVALKEXPGXIIXPCLRMKLQVPNSLLLQSYPAGEDREHRVVWCRRLPTCCRVPCLPGRAGSPRRADRGVEEASGGGGGGGVCGTGRKKGRAAAGLPVSTRVALRYFL

SEQ ID NO: 188979 - protein, 99 aa, Triticum aestivum
  Clone ID: PAT_TA_83397.pep
LFNRKKGKLNSDQKTYYDGKLKEIEQIFSLSTNADEDGPESDKGKKTESADTDTDAEMKKLCEYSVRKAAKMAAGYVYPSLPCGFTTSMLVLIFSFVKY

SEQ ID NO: 188980 - protein, 87 aa, Triticum aestivum
  unsure (1)..(87): unsure at all Xaa locations
  Clone ID: PAT_TA_83398.pep
QHAAAQEAVASASHYNPKFHLWISXRQSLVLNQLKPKSLSLGXVQNSHGLYIHVHTLVVGAQXLHXITXLSLNQFFXVPPXXXLXKL

SEQ ID NO: 188981 - protein, 95 aa, Triticum aestivum
  unsure (1)..(95): unsure at all Xaa locations
  Clone ID: PAT_TA_83399.pep
KISINAKIGIGQLIHLPFSVHLGNERRNLIGSRSKLLISCIRSPMQGSYLKLMVRTQTLVTHNIYIERQYPREIPPGRLTTQYVTXALLTSXGXH

SEQ ID NO: 188982 - protein, 197 aa, Triticum aestivum
  unsure (1)..(197): unsure at all Xaa locations
  Clone ID: PAT_TA_83400.pep
DREAISPPPGQPTDRPTHGPPSCSRRLSAPAPGAPPAPRASLLRANASRIDEEGGGSDARVRLRDPVAGPLRAQPDARLHLRLPSPIRAEPXLSRARYRASNQQSRQXDWCFSPPPXRAAATRNSPRXVLSPRKVGXTRNSPGGRAXTXXXTPAMQEXDXWCPXXGKXDSXGPNNGNEEDSLXGXLANAQKXKPFLT

SEQ ID NO: 188983 - protein, 84 aa, Triticum aestivum
  Clone ID: PAT_TA_83401.pep
MDQSPKNWTVPTHSYDTFNQTHPKLTNVACINLPPRYQKSFFNQASFSWQSVTIQITGQVASLVSILVVVLFRKHERHILPGGD

SEQ ID NO: 188984 - protein, 44 aa, Triticum aestivum
  unsure (1)..(44): unsure at all Xaa locations
  Clone ID: PAT_TA_83402.pep
XSYLEXSTLXQTVXLYXVXSINXIISTLXYELSXXIXXLXYGLG

SEQ ID NO: 188985 - protein, 107 aa, Triticum aestivum
  unsure (1)..(107): unsure at all Xaa locations
  Clone ID: PAT_TA_83403.pep
MAAVQRLLRAVAPGGSAAAAVRRRMTSLAPEQAPSAAAGFPFAAEQRARRPVAAERNVQWVFLGCPGVGKGTYASRLSRLLXVPHIXTXGDLVRDELASTGPLLPTC

SEQ ID NO: 188986 - protein, 109 aa, Triticum aestivum
  unsure (1)..(109): unsure at all Xaa locations
  Clone ID: PAT_TA_83404.pep
MAASMITSPIVAPTSVPSLSRRGSSFAVVCSGGKKIKVDKPLGLGGGLTVDIDANGRKVGKKGVYQFVDKYXANSTVQPSTRQEEWSXSGDRYARXNXRLXIWASPSAP

SEQ ID NO: 188987 - protein, 142 aa, Triticum aestivum
  unsure (1)..(142): unsure at all Xaa locations
  Clone ID: PAT_TA_83405.pep
VSRRSNGASLGSVSNGGRIRCMQVWPIEGIKKFETLSYLPPLSTEALLKQVDYLIRSKWVPCLEFSKVGFIFRXEHNASPGYYXGRYWAMWKAXPSSGATDATQVXNEVEXVKKGXPDALSATXGFKXMRQVXXAXLTALSN

SEQ ID NO: 188988 - protein, 109 aa, Triticum aestivum
  unsure (1)..(109): unsure at all Xaa locations
  Clone ID: PAT_TA_83406.pep
PLDSIXNQGSVXQQSRCFPKVVSSFQNFSLWYMSICWSAGLGTLTLSSFDDPLHLSNRRIGARLDLEVGALEGLDVKLHFARRLLSPLTLSLLAPLRGGRGLRVSTPRL

SEQ ID NO: 188989 - protein, 86 aa, Triticum aestivum
  Clone ID: PAT_TA_83407.pep
AKPFRNPSEKRRRAIGERDHGGASCGGDGGVGQAHRVPVLPALRREELGQKQEVGEGSWVCSLDPSCSCAPVVIWWHLGSLQNCLP

SEQ ID NO: 188990 - protein, 111 aa, Triticum aestivum
  unsure (1)..(111): unsure at all Xaa locations
  Clone ID: PAT_TA_83408.pep
LXGSFAXWEXWGNPSLFXPGXKTQXLKSCMXFTNRXDXVYSQNXFVSLKGGNXXSNCPXYILGPSXYHFXXKLIQFXDNRFTLTCSMSMIMHNTTINLRYYFYPQKLDVSV

SEQ ID NO: 188991 - protein, 61 aa, Triticum aestivum
  Clone ID: PAT_TA_83409.pep
FFFLTNLAFTANLDILKRTCLGSNRVLPSIPWHTPVLGKFLSPFHKKGKRTCLVPQGAQQH

SEQ ID NO: 188992 - protein, 155 aa, Triticum aestivum
  unsure (1)..(155): unsure at all Xaa locations
  Clone ID: PAT_TA_83410.pep
XXSXYXGNXXSXSFXWIXXIPXXFPTXSXXLTVXSDFXWPLXHLFFVRGVPSFCXQMGKFSAKSCWVWPVWVHRXIIWHSHPGGIRLDCDTXQLXYLDGDGTISTDSTIITNRPRHNCHFCKTWVDGSGWCGAGVIYDIRFGASGCVCLCQGSKR

SEQ ID NO: 188993 - protein, 63 aa, Triticum aestivum
  Clone ID: PAT_TA_83411.pep
LCSSKLISMALVASESYNMYCSIVLHKCCFCDLRKLDFFVTTVAPYKISEIIYFLDYLAIVFL

SEQ ID NO: 188994 - protein, 167 aa, Triticum aestivum
  unsure (1)..(167): unsure at all Xaa locations
  Clone ID: PAT_TA_83412.pep
GKLDLAAECYINALKIGHTRAHQGLARVHFLRNNRVGAYDEMTKLIEKARNNASAYEKRSEYCERELTKTDLQMVTKLRPSAIYPYRYXRXAVLDGQHKEKEXFXELXQAISFXXGLXVQLRAAFXXTFXDISXASGLRXASLVDPNHQEIWTHTGGPRHGAWGYQD

SEQ ID NO: 188995 - protein, 122 aa, Triticum aestivum
  unsure (1)..(122): unsure at all Xaa locations
  Clone ID: PAT_TA_83413.pep
ENGAKMVIISNSSRRSSVTMKKLKSLGFDTSCFLATITSGELTHQHLQKRDDPWFAALGRKCIHITWDDRGAISLEGLXLQIVNNVDDAXXILTHGTELLGXPPXFLLPKILXDLTSSNALA

SEQ ID NO: 188996 - protein, 99 aa, Triticum aestivum
  unsure (1)..(99): unsure at all Xaa locations
  Clone ID: PAT_TA_83414.pep
LGVNMPARAEQTPKEDESKPFREVYDVVLYLGIIDILQEYNMTKKIEHAVKSMQYDSGSISAVDPILLRSVPLNFIQXSSPEKFVLHPTIFPGKCPPTC

SEQ ID NO: 188997 - protein, 136 aa, Triticum aestivum
  unsure (1)..(136): unsure at all Xaa locations
  Clone ID: PAT_TA_83415.pep
MALLSDLINLDLSGRTGKIIAEYIWVGGSGMDVRSKARTLSGPVDDPSKXPKWELRRSSTGQXPGDDSESPFPRALQGPFKXGQNILALXTGYDRTGTVPDNKRRRARNFYHPDRRRHGPDQNSPAQWSVCAGVPG

SEQ ID NO: 188998 - protein, 53 aa, Triticum aestivum
  unsure (1)..(53): unsure at all Xaa locations
  Clone ID: PAT_TA_83416.pep
EHPTDMQFITRVQISIMLNNVQKYTTMPAFKLIWTLGRKTNXLQRTNYLQVIQ

SEQ ID NO: 188999 - protein, 100 aa, Triticum aestivum
  unsure (1)..(100): unsure at all Xaa locations
  Clone ID: PAT_TA_83417.pep
PGCASFIHHVIYFGDTFLGRMIAVXFRVMLXXCPXTXLDKVXFLDRAXRCXQMVENIRINDVRTGDLGAGLIVYHRRSGGSLAYIGVXXMTGRGVDPSIQ

SEQ ID NO: 189000 - protein, 49 aa, Triticum aestivum
  Clone ID: PAT_TA_83418.pep
QGENYKRQYNMIIIVPTVIHRKLGTNNLSYVIHLSYHRSLWLVTLGCRI

SEQ ID NO: 189001 - protein, 135 aa, Triticum aestivum
  unsure (1)..(135): unsure at all Xaa locations
  Clone ID: PAT_TA_83419.pep
FLQNAEGSGLAPFDCWLCLRGIKTMALRVEKQQANAQKIAEFLASHPRVKQVNYAGLPDHPGRALHYSQAKGAGLFSFSHRLTGLSKHSWETTKYFSVTXTSGSVNPSSPACFIPTHHPCLGRXERXLTDNSSGI

SEQ ID NO: 189002 - protein, 84 aa, Triticum aestivum
  unsure (1)..(84): unsure at all Xaa locations
  Clone ID: PAT_TA_83420.pep
PHXXVFLVVLPVXPWSSPLLXPGCCQXXECHRXXXLRXXVFXYIAXWYDXCLSXXVMSERXIEPGFLTXFXVXSFXCIXGKSLP

SEQ ID NO: 189003 - protein, 128 aa, Triticum aestivum
  unsure (1)..(128): unsure at all Xaa locations
  Clone ID: PAT_TA_83421.pep
MNMVHGKLEVLLVSAKGLEDTDFLNNMDPFXVILTCRTQEQKSSVANGXAGSEPEWXNETSVFTVSDDTPAVHLKIMDXDLTNDISSGEQHPLGAVFQRXTFPXGGHPAXKEENYAEGSHLIPTTDPA

SEQ ID NO: 189004 - protein, 77 aa, Triticum aestivum
  unsure (1)..(77): unsure at all Xaa locations
  Clone ID: PAT_TA_83422.pep
GIEATVDPSTQVVYSESPDSGVLADKYXYAIVVVGEPPYAETFGDNLNLTIPAPGPXVIHSVXGAXKCVXVLISGXP

SEQ ID NO: 189005 - protein, 113 aa, Triticum aestivum
  unsure (1)..(113): unsure at all Xaa locations
  Clone ID: PAT_TA_83423.pep
SEQSTRPSRGSKRDGVLELRDRPPHRWILRQRRRPQPRMVDLAMAMQAPLGKRASMEDSMRQKLIVFMVRYWPFGXXDGKVVXXXQSKFKKTXQQXFXSIQXHNDTXXLIXSL

SEQ ID NO: 189006 - protein, 140 aa, Triticum aestivum
  unsure (1)..(140): unsure at all Xaa locations
  Clone ID: PAT_TA_83424.pep
MNRKPGDWDCRACQHLNFSRRDICQRCSEPRGVADRGGGGGGGGDYASFGGRGGXSFGGGFGAAGLTSALGDWXYCSCGAHNFANRSNCLNAPAYKEEAPVNMAFYTSGTVPERLWSGLPVYNARWINGLTNVKNFNKMI

SEQ ID NO: 189007 - protein, 182 aa, Triticum aestivum
  unsure (1)..(182): unsure at all Xaa locations
  Clone ID: PAT_TA_83425.pep
PLGSNFSNGVNFAIAGSTAMPGVTTFSLDVQVDQFVFFKERCLDSIERGESAPIVEKAFPDAIYTMDIGHNDINGVLHLPYHTMLRNLPPXLLKSKKXSKRLHENGXKNSWIHGTGALXCMPQXLSYPXDDDSDSMTWCTQALIILQDSSLPNPWTPTLKFDSWFRNSVAKMDNMIHGMEPL

SEQ ID NO: 189008 - protein, 78 aa, Triticum aestivum
  unsure (1)..(78): unsure at all Xaa locations
  Clone ID: PAT_TA_83426.pep
AADVXKQIPAXIPGSRXNNYYRANXXHTXNFLXDRPSTKXVHAAPXGGLIPWGXLFGRKVMLTDGCLLNERMWPRLPW

SEQ ID NO: 189009 - protein, 101 aa, Triticum aestivum
  unsure (1)..(101): unsure at all Xaa locations
  Clone ID: PAT_TA_83427.pep
YIFFEGKKXRKGTRNTKSQRKTIDTCIFTRGYAXDASRNGALQPRTVPGTTTTRARSRLRLTCRRHRRRRRLACRRSPPPCSHSSSSSPPPPLARPRQRRR

SEQ ID NO: 189010 - protein, 124 aa, Triticum aestivum
  unsure (1)..(124): unsure at all Xaa locations
  Clone ID: PAT_TA_83428.pep
FXGLGCQPQIETSXVGNQGKHQVQVIFGLGSWFIXRRTFDSCSFKHGXHLKHLALQHQMFTXDIEIGIMTLEESRSDSHCGRRLPSSTSHASCGGGASEAVADSTWGMGGRGASTGGLVDARHR

SEQ ID NO: 189011 - protein, 86 aa, Triticum aestivum
  Clone ID: PAT_TA_83429.pep
HRKVLRDNIQGITKPAIRRLARRGGVKRISGLIYEETRGVLKIFLENVIRDAVTYTEHARRKTVTAMDVRLRAQSAKGRTLYGSGG

SEQ ID NO: 189012 - protein, 57 aa, Triticum aestivum
  unsure (1)..(57): unsure at all Xaa locations
  Clone ID: PAT_TA_83430.pep
FIPFLGRFQFLXVVRSKNQPPLELXNSLGXXINSIVPXKXKTGEFXKIFQXFPXNXP

SEQ ID NO: 189013 - protein, 139 aa, Triticum aestivum
  unsure (1)..(139): unsure at all Xaa locations
  Clone ID: PAT_TA_83431.pep
MAGRRQIKKEWVQAAADAASWCVALSLVAMLVVVCTLGRXGKGGGGAPVVVVRXAALXARPFEELRXXAEGETLHNIXSDKCGDXHXWERNPHXHDPDDXSPASQPDAVASNDSRLNKILATRSPSDIPYYKRNKTIHS

SEQ ID NO: 189014 - protein, 65 aa, Triticum aestivum
  Clone ID: PAT_TA_83432.pep
PPRVMCLQHFRPRQGDIQLYTKFSTLAALSTLPPEIQLPHATILAHITSHPSDMSSVLLGMSCLS

SEQ ID NO: 189015 - protein, 77 aa, Triticum aestivum
  unsure (1)..(77): unsure at all Xaa locations
  Clone ID: PAT_TA_83433.pep
TQQAXLXRGYDHXWIKXIVRFKNQDVFNVXGTFIFRKVQVYSHSFFPLLTQNYYLYXEGKRDVGGGLRXAPIIQKGL

SEQ ID NO: 189016 - protein, 124 aa, Triticum aestivum
  unsure (1)..(124): unsure at all Xaa locations
  Clone ID: PAT_TA_83434.pep
MXTXFNXNRKKRXHVSAGHGRIGXHRKHXGGLXNAGGMXHHRXLFDKXHPGYXSNVGMXYFHXSRXXFYCHAVNIXALSLXSRXQGGEAXSRRPXDSSXAFXYLKGXEGGLPPNHCYQGNLQDN

SEQ ID NO: 189017 - protein, 44 aa, Triticum aestivum
  Clone ID: PAT_TA_83435.pep
PPLGESCLLHLVSSKMIACWLCCVSSIYGGLAETGIWLRSYLAM

SEQ ID NO: 189018 - protein, 149 aa, Triticum aestivum
  unsure (1)..(149): unsure at all Xaa locations
  Clone ID: PAT_TA_83436.pep
FLTLRFTLSSQHFTRLIKSRVREAVWQQLLTMNKPPSTGGKIRTNNTHIFTMLTMALFNSKKIIITIFPQPNPQQPTNTHSTXLIMFPXSVGPKNFVGXLTINTNNXXKALXXQEITXXXIGFHVLPXIXGWRKTLXTGCFXXHRDSTI

SEQ ID NO: 189019 - protein, 134 aa, Triticum aestivum
  unsure (1)..(134): unsure at all Xaa locations
  Clone ID: PAT_TA_83437.pep
PAPSRTRTRSCSPRPSTSTSSRSPRSSSRGGTTSSRPRSWGTTSSSSASRSSSRWTXLVLRRLHDRGLTRLKEHECQDQGIHSTCPAAXYDGDEFXTTIAACXVKKXFEESPRIXRINCLTXARFXGTDRLAQT

SEQ ID NO: 189020 - protein, 167 aa, Triticum aestivum
  unsure (1)..(167): unsure at all Xaa locations
  Clone ID: PAT_TA_83438.pep
PVPEGGYKKITSLEMSEHVGIRHFGSFLKQVHDMLDDDGVFFLQYAGLRKAWQYEDFTWGLFMNKYIFPGXADASTLSGWVVRQXWEGTGFEIKAHPIPSVFNYXATLXWKWYRNWDVQPPQGXGKYRKHGPLGLLAYPTQLPPRYALLPINPGKNPPRLNHSHNGT

SEQ ID NO: 189021 - protein, 114 aa, Triticum aestivum
  unsure (1)..(114): unsure at all Xaa locations
  Clone ID: PAT_TA_83439.pep
CXSXVIXTGDWAPXRIXXSGYLSTVRNXIFCTPVTIATXYNQLHGXRGTRPGAPTTXPLFIILVFHLHQHLHSTYXTSGPXQLXCQRMNGEDGLDLFEPSSLSGGIGPSLVTVT

SEQ ID NO: 189022 - protein, 148 aa, Triticum aestivum
  unsure (1)..(148): unsure at all Xaa locations
  Clone ID: PAT_TA_83440.pep
SLPXWXDVNCSXGMLNCSXRMMNCSNRYSXRXRGGGGRKGGCTXSINLSXPAAAGPAQKRLLLQLEVVDCCSRSISDDQRHPPAPRKVVPANPRRLSPCSAAASFATAAASRPCAATCERERAARMPSPPSPPRLLRAEGVGILEREI

SEQ ID NO: 189023 - protein, 169 aa, Triticum aestivum
  unsure (1)..(169): unsure at all Xaa locations
  Clone ID: PAT_TA_83441.pep
ITMDPTKFRPSSSHDTTVTTTNAGAPVWNDNEALTVGPRGPILLEDYHLIEKVAHFXARERIPERVVHARGAPAXGFFQCTHDVXXLTCADXLRAPRXGPLSCLLXVIHXRVPRNISRPRGSRXFXXRQGNWTAGIPVSPRRIPVSKPTRSTDTRCIDSRNFSPHTFHQ

SEQ ID NO: 189024 - protein, 148 aa, Triticum aestivum
  unsure (1)..(148): unsure at all Xaa locations
  Clone ID: PAT_TA_83442.pep
RVSSFEALHSXTKALPPDFVRLNQDILSPRAGKKELYTXXTLDFWEQIKXPGMSLRCSGLYLSRFRRTSPHLLXSXDXKRTAXTVXXVYIHPXAKVHPTSXIGPXVSXSANXPVGLGXRLIKCKILYGXGLMANALXXIQFWVTNMSR

SEQ ID NO: 189025 - protein, 81 aa, Triticum aestivum
  unsure (1)..(81): unsure at all Xaa locations
  Clone ID: PAT_TA_83443.pep
TIGRVADTAHTGLFITHRSHLNILWIHIVLSTPIIYTFCYXSNMENLKTTPPXRPKTRGYNDMTQQXCHFNKLKNPVIGGR

SEQ ID NO: 189026 - protein, 99 aa, Triticum aestivum
  unsure (1)..(99): unsure at all Xaa locations
  Clone ID: PAT_TA_83444.pep
MGDRNHGRSLPLLLYLHLLLPILPFAMADIASEKQALFAFAXAVYHGNKLNWSQNIPVCSWHGVTCSLDXSCILALXVPXAGLIGTNXADTLGKLVPPF

SEQ ID NO: 189027 - protein, 84 aa, Triticum aestivum
  Clone ID: PAT_TA_83445.pep
ADKPNYVRYHEQLLRLVRVGGTVVYDNTLWAGTVALPPDAPLSDLDRRFSAAIRELNVRLSQDPRVEVCQLAIADGVTICRRVV

SEQ ID NO: 189028 - protein, 156 aa, Triticum aestivum
  unsure (1)..(156): unsure at all Xaa locations
  Clone ID: PAT_TA_83446.pep
GGEACDVFDGAWVPDDTGRHPLYNSSECPFAERGFDCLANGRNDTGYLKWRWKPRRCEVPQFAARTALERLRGKRVVFVGDSMSRTQWXSFICMLMAGVDDPRTVXXVNGNEXXKTIRHLAVRFASXRLTVXFFRSCPRARPPQRPQKKSLGGDDI

SEQ ID NO: 189029 - protein, 160 aa, Triticum aestivum
  unsure (1)..(160): unsure at all Xaa locations
  Clone ID: PAT_TA_83447.pep
RYLLASSAPPPPLAVIYVGDVHGYITKLESLCSNLXAALPADALATALVIFLGDYNDRGPHTRRVLNFLLALPTRYPAQRHVFLCGNHDLAFVAFRWGAAAAAQTVPVLWAPAQRHLSVLPLSLILPNALLITPFLRKIDTVIKDSRNAAESGMGHTTHN

SEQ ID NO: 189030 - protein, 66 aa, Triticum aestivum
  unsure (1)..(66): unsure at all Xaa locations
  Clone ID: PAT_TA_83448.pep
CRXGGXGMVVVGXXPRXRGXXERGARGEEXTXEGENGSPXRGDTTESHGGGGWRWRLTXAPXIGFR

SEQ ID NO: 189031 - protein, 125 aa, Triticum aestivum
  unsure (1)..(125): unsure at all Xaa locations
  Clone ID: PAT_TA_83449.pep
IRLSNHELGHQSNYSYLPVVSAVTQSTASPRSKPPSLSTNHHVRSPPQPCLRSPGPPLRDPPRLISRLHHTCSLXISLQLLCRSLXCTPNRNXWRRLXQATDLNATCGATXQSVXNQHPRATRTX

SEQ ID NO: 189032 - protein, 134 aa, Triticum aestivum
  unsure (1)..(134): unsure at all Xaa locations
  Clone ID: PAT_TA_83450.pep
LIQVYEGERARTKDNNLLGKFELSGIPPAPRGVPQITVTFDIDANGILNVSAEDKTTGQKNKITITNDKGRLSKEEIEKMVQEAEKYKAEDEEVKKKVDAKNALXNYXYNMXNTIKDDKFLQLPAEDKKKSKIR

SEQ ID NO: 189033 - protein, 121 aa, Triticum aestivum
  Clone ID: PAT_TA_83451.pep
EKLRSLWKMYLSNSDALIYVVDSLDRERIRDARQEFQTIIKDPLMANSIILVFANKQDLRGTMSTDEVSEGLGLHDLRNRIWHIQGTCALRGEGSTTGPTGLASTLKHCKNRARDSVAPSI

SEQ ID NO: 189034 - protein, 140 aa, Triticum aestivum
  unsure (1)..(140): unsure at all Xaa locations
  Clone ID: PAT_TA_83452.pep
ENYWYRVCEGRAAKVIQRPWYAIWKSKRLMNIVTEIAGRMDWDYDGLHVVRGWKAQNKQMYPNLDSDTSPDALVDKVTKLVKPMRDLYIATNDXYNYXDNSGTLHVHLLDDYKDFGSNTSEWYNETTTLNXGQTIPFDPT

SEQ ID NO: 189035 - protein, 98 aa, Triticum aestivum
  unsure (1)..(98): unsure at all Xaa locations
  Clone ID: PAT_TA_83453.pep
MHSSASARGGRXLLLPAAAAAVVVLLLGAVAPAAGCYPXVFNFGDSLADTGNYXFVYGNDSAXLXXPYGXTFXHRXTGRASNGRLMVXFIXDTLRLXF

SEQ ID NO: 189036 - protein, 167 aa, Triticum aestivum
  unsure (1)..(167): unsure at all Xaa locations
  Clone ID: PAT_TA_83454.pep
SIPIAGRDITYFVQSLLRDRGEPDSSLKTAQEIKEEYCYVCPDIVKEFSKYDRDRTRFAQHVVSHPNGRQVSVDVGYERFLAPEIFFNPEIYSSDFLTPLPVVVDGVIQQSPIDVRRSLYKNIVPSGGSXLYKDFGRRLQXDIKQLVVPEFDQVPTWCPTVGLSLHP

SEQ ID NO: 189037 - protein, 149 aa, Triticum aestivum
  unsure (1)..(149): unsure at all Xaa locations
  Clone ID: PAT_TA_83455.pep
MDASGAGSKGKKGAAGRKAGGPRKKSVTRSVKAGLQFPVGRIGRYLKKGRYAQRVGTGAPVYLAAVLEYLRREVLELARNAAKDNKKXRIIPRHVLLAIXRNDXDSGTAGXLTSRKXALPKHHPCSCPRRRXXXAXAEQGPIPQEAIPK

SEQ ID NO: 189038 - protein, 62 aa, Triticum aestivum
  Clone ID: PAT_TA_83456.pep
WPLTVYFPVEMYIKQRRVPRGSTKWVCLQTLSVACLVVSIAAAAGSIADVIEALKVYHPFSS

SEQ ID NO: 189039 - protein, 129 aa, Triticum aestivum
  unsure (1)..(129): unsure at all Xaa locations
  Clone ID: PAT_TA_83457.pep
HPTDPRSAQASRLLRFIKLQKSLRHSXANSKHQAXNFLXSYGWLGTRNKPSKSIICDSEGHQXEGSMKXRISFLVLALXNSNFPLAHPAGKRTXINNSDALXKLSXXINWXXHQXKXQVXNAPCXXFSY

SEQ ID NO: 189040 - protein, 143 aa, Triticum aestivum
  unsure (1)..(143): unsure at all Xaa locations
  Clone ID: PAT_TA_83458.pep
NSKVVEHARNMSSLGLEGQSILQRRAAKFSLPNSDIHIRSNISCPVSPCGSPLLRSRSPQHQNGRMSPSPICSPRTTSGASTPLTGXVGAVPLNHVXQPTYRNGSRHTRLMTHPNLLHTGLLSNAHFPGSGRKVRIDIRQYGR

SEQ ID NO: 189041 - protein, 63 aa, Triticum aestivum
  unsure (1)..(63): unsure at all Xaa locations
  Clone ID: PAT_TA_83459.pep
LESDPSFPGAAKVGVVEFLNGVGKGVEAHAAKLEEAVGGDLQSSLXGRTLRLKEXRHPCKHRK

SEQ ID NO: 189042 - protein, 78 aa, Triticum aestivum
  Clone ID: PAT_TA_83460.pep
TRAYGPVWSTDRAPAGPLQFRAVVTGGYDGKWVWAEQEVLPADWRPGQVYDTGVRIVDVARDASRGCTAAAMDDWEVK

SEQ ID NO: 189043 - protein, 71 aa, Triticum aestivum
  Clone ID: PAT_TA_83461.pep
HDEGHGQDDEEVVVEENVVITAYANSNYQAVNNSVLVAGSCAVDDPGVHVVVVEHVDEIRDYDEDIDGQEF

SEQ ID NO: 189044 - protein, 131 aa, Triticum aestivum
  unsure (1)..(131): unsure at all Xaa locations
  Clone ID: PAT_TA_83462.pep
TNWIILKISTKQFWGIATSLVAAASSVSRSQEPFWFVPQYNQPTWFIHHVLSNLCNTITGLKKRHSPLCRPASATTTAPTFVTTFGTNSTPSTATTASTSIILATSNASASRFNTDVPPSXSTGNTWWLPI

SEQ ID NO: 189045 - protein, 61 aa, Triticum aestivum
  Clone ID: PAT_TA_83463.pep
YSLPLSTYISGDPMPSHVAGGRFLKIRLHVAGFLMLSSMNNHISSFSGFTFSYKLLIMTKH

SEQ ID NO: 189046 - protein, 126 aa, Triticum aestivum
  unsure (1)..(126): unsure at all Xaa locations
  Clone ID: PAT_TA_83464.pep
QVGGERAAMARCLALVSLLLLGLASAASAADAPFVVAHKKVSLSRPKPGVERVAVSLDLYNQGXATAYDVSLNDDSWATQHLSFQLGEKSKTLEXLTWVQWYTTYFLENKTQSSRLTTIYFLFPCL

SEQ ID NO: 189047 - protein, 74 aa, Triticum aestivum
  Clone ID: PAT_TA_83465.pep
TPGGVRFYKVGLQRKELHIRTPSLPSTQRRVPSGHGGKPSILYLCGPSSSPCYIARTPGDPIIQDFLSSPRTCL

SEQ ID NO: 189048 - protein, 115 aa, Triticum aestivum
  unsure (1)..(115): unsure at all Xaa locations
  Clone ID: PAT_TA_83466.pep
FKREEAPPGRATEQNETRQPAQPSRARLDSNRIVPSFRFYLSLPRRRSRLQGRGNPSHLVSAARRVSRRRPSLPLTPPERSXSETVKETRWRIGIPEIPTPLLPVVKXNHLKSMG

SEQ ID NO: 189049 - protein, 96 aa, Triticum aestivum
  unsure (1)..(96): unsure at all Xaa locations
  Clone ID: PAT_TA_83467.pep
QVTNRXXISMAGPPXRIGSLCTGISDIGKTNQQASXHXDTLIVAARTSSQATIGLSKLLVGQSRSAPGGYRWLTGLTNTHEHWPVLLIKNPRANYS

SEQ ID NO: 189050 - protein, 149 aa, Triticum aestivum
  unsure (1)..(149): unsure at all Xaa locations
  Clone ID: PAT_TA_83468.pep
IKDTMMHHGAGRESIKAAGRSQQTMAQLKMMGRQRVSRRRGVHQRDHARHHRAPLPGNIIQGVNCCTPSIDDGSCPVNISKDPCTCXTDCFADQRGXHSPQDXAXRTWFLDPWFSXSFKWMTTAXSXKHNINKVATVTXKPAEXLQVXX

SEQ ID NO: 189051 - protein, 47 aa, Triticum aestivum
  Clone ID: PAT_TA_83469.pep
LDRSKKHALISRKAIHQNGTVHQDSHLKERNHSKASLNYTLMMTLIH

SEQ ID NO: 189052 - protein, 162 aa, Triticum aestivum
  unsure (1)..(162): unsure at all Xaa locations
  Clone ID: PAT_TA_83470.pep
ATVRRKGIPEKDGLESTYAVFTVEEPKKKSGAWIKTGGKNKKHHLLSSIVGEIKVARRKSRCHHTTDVHVHRELCWLVQILPSSEEQVIQMLSGRLALLSTHFLNKKQKLEHHLTEYQAKNQCQLAVVPPTGNFNPNTKXXXLNQCFAYSXRFKXQYTGTMP

SEQ ID NO: 189053 - protein, 133 aa, Triticum aestivum
  unsure (1)..(133): unsure at all Xaa locations
  Clone ID: PAT_TA_83471.pep
DVTTVIPYHVNLTKAGYRALVYNGDHDLDMTFVGTQEWIRSIGYPIVSDWRPWFANRQVAGFTRTYAHNLTFATVKGGGHTAPEYRPKECXGMLVRWTSRSKPTLMNVVTAELTNYLVSLPSNYSYVIIIIRV

SEQ ID NO: 189054 - protein, 115 aa, Triticum aestivum
  unsure (1)..(115): unsure at all Xaa locations
  Clone ID: PAT_TA_83472.pep
MAAQXGXMRLVSHPIXAHDGRLPRQYXXDGQGAKKDMSPPLEWYXLPDGARSLALXVQDIDPTQLXXTHXVVXNIPPATKGSXRGLXRRGGLQLRRQEGSTGHRLGPPHDHLPYK

SEQ ID NO: 189055 - protein, 113 aa, Triticum aestivum
  unsure (1)..(113): unsure at all Xaa locations
  Clone ID: PAT_TA_83473.pep
AKYWQQRYSLKEGIPSFLTNVAATILTTGKYLNVMRECGHNVQVSLSDNSKLMSFGSNHQYLECIKSAYDFASGELLTXWMKDKYDLIXGKLRSLKRYLXLDQGDFLXHFMGY

SEQ ID NO: 189056 - protein, 101 aa, Triticum aestivum
  unsure (1)..(101): unsure at all Xaa locations
  Clone ID: PAT_TA_83474.pep
ERXGGRYWEPLLRLPGLLNAFCLQXRSLSSVPXYMELVLTXPHITLFQLFPTLINSKLLLGFPXKXXXSKTVHFAPSSNXIXXLRSPXTIRMTLSGVRQYD

SEQ ID NO: 189057 - protein, 82 aa, Triticum aestivum
  Clone ID: PAT_TA_83475.pep
LCAHPAVLEVSVVARADERWGESPCAFVTLKDGAAADGSDEAALANDIMRFCRERMPGYWVPKSVIFGPLPKTATGKIKKHD

SEQ ID NO: 189058 - protein, 182 aa, Triticum aestivum
  unsure (1)..(182): unsure at all Xaa locations
  Clone ID: PAT_TA_83476.pep
LLSRKPSSDELKALLADSERSRLLRRLSEANQYNRFLKRQLQIKDDAVVKFKGELAVLELEMQALVGLAEEVANLXCSVRARKINGKYIXXSLLSKIRXVHDKIMXQVKSVDALKTQESCLLGLGMAXNXQXMGXFHDGTRQACPRISDYGNSRNELRLEGQILMGMECPRIPRWRGRPTSV

SEQ ID NO: 189059 - protein, 107 aa, Triticum aestivum
  unsure (1)..(107): unsure at all Xaa locations
  Clone ID: PAT_TA_83477.pep
EDYREPVRPQSAFQGVGRTLGGGPSPDESATPAPAPAAPAASRSAGIVVDDSQPFTSIQLRLADGTXRMVARFNMHHTVGDIXXFIDASRPXTAXRFNCNSFPPKNW

SEQ ID NO: 189060 - protein, 76 aa, Triticum aestivum
  Clone ID: PAT_TA_83478.pep
NLNHPQQCSKYSASGIYWLTYCSLRRNRYVFLLFVGQFCTGWIHKDSDYGAFGTYNNKHMKFASRCSDAVSLIINY

SEQ ID NO: 189061 - protein, 171 aa, Triticum aestivum
  unsure (1)..(171): unsure at all Xaa locations
  Clone ID: PAT_TA_83479.pep
YHAATPPPPADSRNARDDAEEKTRNPIKVSVPQAKPLPHPHARAKGTSNGASRAVRDGNKNGCHGARARDGLCGWAGCDVXXCCGAAAAAEEMXWAAAIQRRERGVFXSXAPPYRVHFVAMAPXXSPPPTTANAPRAGXLRRFASSLRXXVGPGGRSXGRXQGNALKSVTK

SEQ ID NO: 189062 - protein, 172 aa, Triticum aestivum
  unsure (1)..(172): unsure at all Xaa locations
  Clone ID: PAT_TA_83480.pep
MARAAAAQLVLFTLVAAMVLTATDAAISCGQVSSALSPCISYARGSGSSPPAACCSGCQDLAGAARXPLTTSGVQCIKMLLGGSMLEXRWIPPKCXVRSLRHYSSWDKSLINNGTRPRLYASIETIVRHTPHSDNACTKFSTIWRQLCPSCVIPRKGVFSDSCKSKKKLGGH

SEQ ID NO: 189063 - protein, 99 aa, Triticum aestivum
  unsure (1)..(99): unsure at all Xaa locations
  Clone ID: PAT_TA_83481.pep
HGGMPRXGENPRKVRXGRKSXRVGRYXXVSVXSRSLSGNLSFEAVFSQGKXAQAFTHVGGPFRDCXTSPSLVPCALETQDGIPIPECLGTSSTSGSSYP

SEQ ID NO: 189064 - protein, 73 aa, Triticum aestivum
  unsure (1)..(73): unsure at all Xaa locations
  Clone ID: PAT_TA_83482.pep
IIHLLGHGVKHKXFSASFXXXYXTGDPRNAPAPAPSWPDPTAAAPLQPIHNADCTATSVASVHPPPNPATTLP

SEQ ID NO: 189065 - protein, 111 aa, Triticum aestivum
  unsure (1)..(111): unsure at all Xaa locations
  Clone ID: PAT_TA_83483.pep
SEAKGRPSPPVVVFRPXXCPFCXRVKQLLAKVGGKYKVLELDVESDGVECSHSRLNGWPEXVPNVFVKGERIGGCDATMAMHXGGKLVPLLTEAGAIVTARATATTTTPSL

SEQ ID NO: 189066 - protein, 156 aa, Triticum aestivum
  unsure (1)..(156): unsure at all Xaa locations
  Clone ID: PAT_TA_83484.pep
TLFLEECIIADEGSEWLHELAVNNSVLVTLNFYMTELKVEPADLELLARNCKSLISLKMSDCDLSDLIGFLQTSKALQEXLGGAFFEVGEYTKYEKXXSHLAMLLGGPTFMGKNESRYFPYPRRLKTGPAYTSSQKRHLTLKPNLRVRGAGTNRPI

SEQ ID NO: 189067 - protein, 175 aa, Triticum aestivum
  unsure (1)..(175): unsure at all Xaa locations
  Clone ID: PAT_TA_83485.pep
EAPTPGSGWANTPGVSFNDAPTPRDNYANAPSPYVPSTPVGQPMTPNSASYLPGTPGXGQPMTPRQCWEWDMMSPDNRWVRVXXTWLLPDVLGNVXSRGDDGLGVGKEVPRDGXCRLHLGLPGNGDXGDVLPXQXQASXPXXXDKXKYISLGTEIKWSDRYETNIQINMGGKRGV

SEQ ID NO: 189068 - protein, 66 aa, Triticum aestivum
  Clone ID: PAT_TA_83486.pep
WNGPDRSLKVRLRCGLSNELNDVDEPSRCEYVAVLSTPALCVEEKLKELQNKLDAMSSKQPGHDEL

SEQ ID NO: 189069 - protein, 117 aa, Triticum aestivum
  unsure (1)..(117): unsure at all Xaa locations
  Clone ID: PAT_TA_83487.pep
QEALQWRMREPNLGAKLFLGGVGVQKTGEEIATALNNIDISSEYVLKLRHEIEDXCVEVFXTPADREKIXXCLSKLXEAMLHLRNLQSALGHVDPVVPPSSIPYTVPLSMMIRIWGK

SEQ ID NO: 189070 - protein, 64 aa, Triticum aestivum
  unsure (1)..(64): unsure at all Xaa locations
  Clone ID: PAT_TA_83488.pep
VGDXVDQHFAEXHXQVXGXRSRQQXRXLLEXPFGXXCLXVRGGRGYERESQREERDGXVGKGRR

SEQ ID NO: 189071 - protein, 111 aa, Triticum aestivum
  unsure (1)..(111): unsure at all Xaa locations
  Clone ID: PAT_TA_83489.pep
GCASCRLHEPPGRLCRGAVRAAIAPVWGTGFLIRIYGSTTDLVSAAGGTLCATNSAVRSRGSEESSWYLESQVTGQEQVPXDEAHGRMLWQFVRVXAVVSQSTLGCWTVVX

SEQ ID NO: 189072 - protein, 150 aa, Triticum aestivum
  unsure (1)..(150): unsure at all Xaa locations
  Clone ID: PAT_TA_83490.pep
PRXMXVXRRDGKAAGPVIXXKXSHGANFXXVXXXXQATFGELNTIXVXTTGLXPXRQRLFFRGKXKSDRXFLHTAGVXDGAKLLLLXKPAPANIXQXVEPVIMDESMMKACAAVAPVXVEVDKLLLXCVTXEXNVLRGRKLRIXNCCLER

SEQ ID NO: 189073 - protein, 150 aa, Triticum aestivum
  unsure (1)..(150): unsure at all Xaa locations
  Clone ID: PAT_TA_83491.pep
AACPPHTAAARNPKGQNPPKSYYTVHTRNGIRASGKAALISRPRLRALLPTSQLQKSSLDAASRAHTHRELLGLSFSVPPSRAQGFTMEAEAAAXGAXKGGEDATARXAGAEAVVAGAGXQAGISAVIPGWSPRSAHVAGXAILEXVWGV

SEQ ID NO: 189074 - protein, 72 aa, Triticum aestivum
  unsure (1)..(72): unsure at all Xaa locations
  Clone ID: PAT_TA_83492.pep
AQLPSGKMPSVYLYIPNIIGYFRIIINFIAFAVCYSNKALFAILYFISFVLDGVDGWLQGINQASTLXCVRH

SEQ ID NO: 189075 - protein, 144 aa, Triticum aestivum
  unsure (1)..(144): unsure at all Xaa locations
  Clone ID: PAT_TA_83493.pep
AGSIEGKVVEIGLTSTSLINPEKLPVIVPNSLFSSQMIVNRSRANWRASVTKIPIRIEDIEKVPSASEEIKTMLRSNQNVSFDSDVPYCYLSRLEIHMESSSLGCNLKNMXKDEWLSAQQEIFGXAXIIKSHGIELGNTCSAVV

SEQ ID NO: 189076 - protein, 121 aa, Triticum aestivum
  unsure (1)..(121): unsure at all Xaa locations
  Clone ID: PAT_TA_83494.pep
PXXSTSCXEXLQGQQFRTPQGGMFSTRDPXERMVSLLPAVREAQDGSVDHMFPWPGLPGVLGARRRGRMLPNLVKWLPSQLLKSCTFHCLFVAVFLVNVNTYYFGDSRHVFLRCMIVLVFL

SEQ ID NO: 189077 - protein, 141 aa, Triticum aestivum
  unsure (1)..(141): unsure at all Xaa locations
  Clone ID: PAT_TA_83495.pep
LPANFRKIMLTQIKKLVAAGKLTKVKASYKLAKAPAAPKKPKTKAPAKKKPAAKKKAPAKKPAAKSPAKKKAAAKPKAKAPAKTKAAAKPKAAAXPKAAAKTKXQPRQPRRREPKPAAKAKRPPXXGRPPRRTQGPQGKPG

SEQ ID NO: 189078 - protein, 48 aa, Triticum aestivum
  unsure (1)..(48): unsure at all Xaa locations
  Clone ID: PAT_TA_83496.pep
XPPXILIVMPPVXCNDMEQQVNQKGFQGCVFTCLLEMWEGVFKHFLYA

SEQ ID NO: 189079 - protein, 125 aa, Triticum aestivum
  unsure (1)..(125): unsure at all Xaa locations
  Clone ID: PAT_TA_83497.pep
MASAPTPPPLLPVTNPASGSSPAAAGGSDAPIATPAFRLFLSRISDSARRSLSDRRPWGRVLDRSAFSKPDSLSDATSRLRRNLAYFRVNYAAVGRLRAGGSLLAHPXSLLILLXLLAAWVLTLR

SEQ ID NO: 189080 - protein, 71 aa, Triticum aestivum
  unsure (1)..(71): unsure at all Xaa locations
  Clone ID: PAT_TA_83498.pep
MVVGIVIRLVVAFVLLVLVFSSSLHRQAGVGAIRLHDRRQHAQSGPEERNQLRPYMTMDYPHXHRRVPKHN

SEQ ID NO: 189081 - protein, 158 aa, Triticum aestivum
  unsure (1)..(158): unsure at all Xaa locations
  Clone ID: PAT_TA_83499.pep
GGGDDGLVLIQMVNFYPPCPQPELALGFAPHTDLCALTVLVANGVPGLQVSMDGLWYDVEHVPGALIVNVGDQIEIXLSNGRYRSVLHRATVSREKTRXSWPVFRGTAERVLRRAPPRLVAGEXLPNYXTRQDFENYRYCXINNYRSRRPNAAGYHAA

SEQ ID NO: 189082 - protein, 91 aa, Triticum aestivum
  unsure (1)..(91): unsure at all Xaa locations
  Clone ID: PAT_TA_83500.pep
VFFPTVFLLKKQKVMSCPLHSFLRWPSPNSKLARPTKRKGKNHKPTPASELQKKPLATHVNAVCGPLTDLPSPKNPPSTEXPQTFPRLLSG

SEQ ID NO: 189083 - protein, 103 aa, Triticum aestivum
  unsure (1)..(103): unsure at all Xaa locations
  Clone ID: PAT_TA_83501.pep
MSGGRRRGLVWSLPVARSDALGKLGPAFGIGAGCGVGLGFGLIGGAGIGAGFPGXLQLGFGAGAGCGIGIGFGXYGFGKGVAYDESGRYTSRDLPRLPEHCFP

SEQ ID NO: 189084 - protein, 59 aa, Triticum aestivum
  Clone ID: PAT_TA_83502.pep
FFFFGGKIGNCLSSIVQKDMHDAANMDKKQYKLAGDTHTHIQQNRAGVIDHREPAAPLP

SEQ ID NO: 189085 - protein, 120 aa, Triticum aestivum
  unsure (1)..(120): unsure at all Xaa locations
  Clone ID: PAT_TA_83503.pep
MEETAAAAPAEKASSYRYWVREATGDAAPLPVPRKLDPAANGNGNPPPLGSVWNXAGTWEEKNSTXWANSRIKDLLGSLGSLXFPTXNASVDEVXQCSXDAFXVTVRNKKRVDILQLTEI

SEQ ID NO: 189086 - protein, 125 aa, Triticum aestivum
  unsure (1)..(125): unsure at all Xaa locations
  Clone ID: PAT_TA_83504.pep
MADAGNEAEGLTLLGLHVSPFALRVRMALSLKGLSYEYIEQDLFHKGELLLSSNPXHKKVPVLIHHGXPSAIPRRPWXLDEAGPARRHHLPADPTXXHRXSGXLXDGXFSRWTGYEAGRRNEGDN

SEQ ID NO: 189087 - protein, 109 aa, Triticum aestivum
  unsure (1)..(109): unsure at all Xaa locations
  Clone ID: PAT_TA_83505.pep
GISTTRNLLADDAMVPISSPLTPPLGDSEETDKKGAVVKRLKVQAIKKDIKQSPKKVNLVAKLVRGMRVEDALLQLQVTVKRVPKRLPGGSICSXQCTHNHGLGPDNHC

SEQ ID NO: 189088 - protein, 109 aa, Triticum aestivum
  unsure (1)..(109): unsure at all Xaa locations
  Clone ID: PAT_TA_83506.pep
VIISIVFLXLVTLSRYLRTVXIGILXCFXPDHCXCLCVCXHFDLCSXGEIANLSAIQKGRLXMVXNSCVAXXYPLLVRWNHCGCCLSISSEHFXLGAFDPKKSHYLERE

SEQ ID NO: 189089 - protein, 141 aa, Triticum aestivum
  unsure (1)..(141): unsure at all Xaa locations
  Clone ID: PAT_TA_83507.pep
MARTKQTARKSTGGKAPRKQLATKAARKSAPATGGVKKPHRFRPGTVALREIRKYQKSTELLIRKXPFQRLVREIXQDFKXTDLRFQSSAVAALXEAXGYLGGLXEDTTLCIXANAHIMPXDIQLARRSXRPSRPFGLSLR

SEQ ID NO: 189090 - protein, 145 aa, Triticum aestivum
  unsure (1)..(145): unsure at all Xaa locations
  Clone ID: PAT_TA_83508.pep
PLALAAPLGPVELELITNXFYQLDQHRNLMEFDLLNXYSPEEAQLELMNTMLQLEQLTALDXHRQSAMAPASPPNIPDVDPPCRSPQLLASATHVDXMTTTXTXTGYHRSXTHXHGPCXAPHFQPAXATXXQLRTGXLXAGXVEG

SEQ ID NO: 189091 - protein, 91 aa, Triticum aestivum
  unsure (1)..(91): unsure at all Xaa locations
  Clone ID: PAT_TA_83509.pep
MTGRGGGGGRRLMLPPIKYIFELLREHATVSIWLYEQLSIRIEGKIRGFDEFMNLVIDEAVEVKQVTKTNEKETKXDLLGQIMLKGRQRLN

SEQ ID NO: 189092 - protein, 97 aa, Triticum aestivum
  unsure (1)..(97): unsure at all Xaa locations
  Clone ID: PAT_TA_83510.pep
MAPAPAAAXAGRKSHVTVLLLYVVCGLILLLLLASYSPRLQPHXHGRSXHRRLNLHPKSSLPSDXSSGXXRXAXXYXXXXNXAASFDPXIAELXRXL

SEQ ID NO: 189093 - protein, 37 aa, Triticum aestivum
  Clone ID: PAT_TA_83511.pep
HDDISVGSWMMGLNATYVDDDRLCCSSSRQEKICSNA

SEQ ID NO: 189094 - protein, 129 aa, Triticum aestivum
  Clone ID: PAT_TA_83512.pep
LCLCSLWSISFASVIAKCLRCDPVKKESLVIMPTFGIQLEQHFWSGRVHRKFVPIGKILRPVLNEHVTPVSCYWSLALLVREEYELMLVFKSLNPPVKMLVPIWESVMCIRRLQFSGAILHCLNPHEHA

SEQ ID NO: 189095 - protein, 80 aa, Triticum aestivum
  Clone ID: PAT_TA_83513.pep
QYAGQGLFGSGIPMTHAQVLGMFSGMNGKANGYVHRHPVAADSLKTAAQNGDVGKAAVNPVQGAGHDPKIANGNILLTQA

SEQ ID NO: 189096 - protein, 72 aa, Triticum aestivum
  Clone ID: PAT_TA_83514.pep
KVFAQKDNPRIPSVFWIWRSADFQERESYDMVGISYDNHPRLKRILMPESWIGWPLRKDYITPNFYEIQDAH

SEQ ID NO: 189097 - protein, 41 aa, Triticum aestivum
  unsure (1)..(41): unsure at all Xaa locations
  Clone ID: PAT_TA_83515.pep
MADQLTDEQIAEFKEAFSLXXKDXDXCIXXKELXXVMRXXG

SEQ ID NO: 189098 - protein, 134 aa, Triticum aestivum
  unsure (1)..(134): unsure at all Xaa locations
  Clone ID: PAT_TA_83516.pep
MAGKGGKGLLAAKTTAAKSTDKDKDRKKAPVSRSSRAGLQFPVGRIHRQLKSRASAHGRVGATAAVYSAAILEYLTAXVLELAGNASKDLKVKRITRXLQLAIRGDEELDTSSRAHRRGXVIPHSQVAINKTQG

SEQ ID NO: 189099 - protein, 106 aa, Triticum aestivum
  unsure (1)..(106): unsure at all Xaa locations
  Clone ID: PAT_TA_83517.pep
MDWPGSGPEGPGKAARTHAVTDSSSSHSDLHRRWSAGRYMNGGRPGSVLAQKLVGAPLPLITCDDCPKKACAACLQRQEHPGWVFIKCSTDGVCATLXSVVLPXLN

SEQ ID NO: 189100 - protein, 45 aa, Triticum aestivum
  Clone ID: PAT_TA_83518.pep
EYVYVHVHVTTWLEKACSYVNAIGGYVYAHAHNILYNLSTMYSGN

SEQ ID NO: 189101 - protein, 102 aa, Triticum aestivum
  unsure (1)..(102): unsure at all Xaa locations
  Clone ID: PAT_TA_83519.pep
MPSHADLDHQISQLRDCKFLPEVEVKTLCEKAKAILMXEWNVQPVRCPSLCXGDIHGXFYDLIXLXRIGGDXPNTNYSLMGDYVDRGYYPVETCLVNGLKYL

SEQ ID NO: 189102 - protein, 93 aa, Triticum aestivum
  unsure (1)..(93): unsure at all Xaa locations
  Clone ID: PAT_TA_83520.pep
XIPXXXFKPXPKPFPLXKKPLPIPIXKPIXXSVPLVXPIPIPVFEXIPKPFPMVKXPLPISIXXTYXXSHSQWVKCLNLFKFLXLFHXRFSFL

SEQ ID NO: 189103 - protein, 148 aa, Triticum aestivum
  unsure (1)..(148): unsure at all Xaa locations
  Clone ID: PAT_TA_83521.pep
MRGGDVTAAEAGSPRSPDLYDLSDDSDYAAAASDQTAMRTDPADRASEETARVDVVYEKERVTIHPSQYGSSRISGKLRLNLYTIKXLPLSDVRLIRKYTQRLDWTTIIVLHQGWLPSIQFTTWNPECFNETTSVDSKFVKLNSKVSP

SEQ ID NO: 189104 - protein, 109 aa, Triticum aestivum
  Clone ID: PAT_TA_83522.pep
HPGPDPEKVLPSIHRLVPACHSRASKAVVAAKLSQNPTPTADSNSRTSAPLLPNPSSSFYTCFCGSGREGTREAAPVTHSQSHAPPNFVLSPSRFRVQARAEPSRWVGR

SEQ ID NO: 189105 - protein, 110 aa, Triticum aestivum
  unsure (1)..(110): unsure at all Xaa locations
  Clone ID: PAT_TA_83523.pep
RVALVAVFAVLAALAVAEMASGAVTCGDVTSAVAPCMSYATGKASAPSGACCSGVRTLNAKASTPADRKAACNCLKNLAGSGISMGNAANIPXKCGVSVSFPXKHKNQLQ

SEQ ID NO: 189106 - protein, 187 aa, Triticum aestivum
  unsure (1)..(187): unsure at all Xaa locations
  Clone ID: PAT_TA_83524.pep
MAARRGPHVIKLHDPNPPLLGRAPGAAPAAVPASSRDEGLLAQHLRASAAHPAFALIEERLAARDQDIQELLVDNQRFAATHVALQQQLIAAQHELRAVSVAATKARAEREGEVRSLADKAAHMXAXAXASXAARAEIDKSRRQVSRRTTLNSSLRKNSQRSADDSSPHRGNQKLIRIDTQNYMICH

SEQ ID NO: 189107 - protein, 148 aa, Triticum aestivum
  unsure (1)..(148): unsure at all Xaa locations
  Clone ID: PAT_TA_83525.pep
QTMLFSATMTEEIDELVKLSLNKPVRLEADPSLKRPATLTEEVVRIRRARESNQEXVLLALCXKTFKRSVIIFXSGTKQSAHRLKIIFGSLXGMKAAELHGNLTXAXRLXALGTFXKXEVDFLXATDSLLVGLICWXQTVINFACPRD

SEQ ID NO: 189108 - protein, 103 aa, Triticum aestivum
  unsure (1)..(103): unsure at all Xaa locations
  Clone ID: PAT_TA_83526.pep
LRRANCPAAAGNGDGNLAPLDTATPTAFDNAYYTNLLAQRGLLHSDQQLFNGGATDGLVRTYASTPRRFKRXDFAGGMIXDGATSTRXTGTQGQFKXACSKAN

SEQ ID NO: 189109 - protein, 100 aa, Triticum aestivum
  unsure (1)..(100): unsure at all Xaa locations
  Clone ID: PAT_TA_83527.pep
LXXXSGWTLXRXXRXEXFDHTVLLQCXTTLSXARNHLXMVLADXSYPKSTLXSEXLGAPXDEFGETRVQVELQRFTFFGYQEQDAAVKGKVEERLKSVEX

SEQ ID NO: 189110 - protein, 86 aa, Triticum aestivum
  Clone ID: PAT_TA_83528.pep
IEKNAGEPGRSLTSTLSRKICRRRADDRLSDIPEKIEARGSKPVSEGPILVRGEPMITVDHPTTEHSDGGGTEQDAVGAKLLLKTS

SEQ ID NO: 189111 - protein, 67 aa, Triticum aestivum
  unsure (1)..(67): unsure at all Xaa locations
  Clone ID: PAT_TA_83529.pep
STXSXADSXXPQMXSXXVXGSLPGFXNLQAGRGGXAVWRQVGEVEGGDHDGRGRGGRGGEAAGEGRL

SEQ ID NO: 189112 - protein, 122 aa, Triticum aestivum
  unsure (1)..(122): unsure at all Xaa locations
  Clone ID: PAT_TA_83530.pep
XGXLDYLGNPXLXHAQSILAXXACHVVLXXAVEGYRXTGXPLGXIVDPLYPXGSFDPLXLSEDPNAFAXELXVXEIINGXLXMFSMCGFXVKXIVTGKGPLEXSLPXSXXXTNPLFPNSSRA

SEQ ID NO: 189113 - protein, 63 aa, Triticum aestivum
  unsure (1)..(63): unsure at all Xaa locations
  Clone ID: PAT_TA_83531.pep
FDLPQTSHVXNLDLPXTAXDYLHRXGRTXRXPFSXLELXCCVTTLITXEEHFVLRRFXNELKF

SEQ ID NO: 189114 - protein, 143 aa, Triticum aestivum
  unsure (1)..(143): unsure at all Xaa locations
  Clone ID: PAT_TA_83532.pep
MARTKQTARKSTGGKAPRKQLATKAARKSAPATGGVKKPHRFRPGTVALREIRKYQKXLSVIRXXPFQRLSREXAQDSKTDLRXXSSAVAALQGAAELTXWGLXRTPTLAPSTQEVTSSQINSPPIKGKGTSPLINVNLVVAV

SEQ ID NO: 189115 - protein, 43 aa, Triticum aestivum
  unsure (1)..(43): unsure at all Xaa locations
  Clone ID: PAT_TA_83533.pep
XIXNKXLXFXHXKIQXTKXTFXLLXFXXXXLPXSXTXHSHTQV

SEQ ID NO: 189116 - protein, 63 aa, Triticum aestivum
  Clone ID: PAT_TA_83534.pep
GETLALRTVGLVLATLLQCFDWDTVDGAEVDMTESGGLTMPRAVPLEAMCKPRAAMCDVLREL

SEQ ID NO: 189117 - protein, 127 aa, Triticum aestivum
  unsure (1)..(127): unsure at all Xaa locations
  Clone ID: PAT_TA_83535.pep
TXXGVEPPXCFEXARXXANRSRDRVPVYRSPPGLGAVYLTGEKSSPPARGATSVPCPQRGQVIDPMXDASKGGTASPCPSAEGEEEDATGXQEASPQEEEMTPYAREEEIKKGVFRYSQAGFISFAI

SEQ ID NO: 189118 - protein, 110 aa, Triticum aestivum
  unsure (1)..(110): unsure at all Xaa locations
  Clone ID: PAT_TA_83536.pep
MSWQTYVDEHLMCEVEGHHHLTSAAIIGHDGTVWAQSAAFPLFKPEEMANIMKDFDEPGFLAPTGLFLGPXKYMGHPGRPGAVIRGKKDLGGITVKKTGEAWWXRIYDDP

SEQ ID NO: 189119 - protein, 171 aa, Triticum aestivum
  unsure (1)..(171): unsure at all Xaa locations
  Clone ID: PAT_TA_83537.pep
PTKPSLTITSRRVVVVVISLASASTARSPIACWPALLAMDRSKSYAGGRMQIEPYYGGGGAEGRXGARADFRSYSYSAGGTGPSSYSVQPVRYGRPGXGEEEVKRSKSKRRWLADPDMDRXRRXAAYKAYGVEGXVXGPSARLKWVKDATRLVKVGIKTQGVCICHLPIEW

SEQ ID NO: 189120 - protein, 56 aa, Triticum aestivum
  unsure (1)..(56): unsure at all Xaa locations
  Clone ID: PAT_TA_83538.pep
SXGGYIWANIFFLNXCYFXXSXFLFHSGYRFEKLSRRCQLPASINSSLVPYSPNSL

SEQ ID NO: 189121 - protein, 86 aa, Triticum aestivum
  Clone ID: PAT_TA_83539.pep
AVFSWTMMLSSARFSFLFFYSTAWSMCILPKACVSHAPGAGAQRPSDGGNTGNKSVPLCVSFEGIKMVFRVVHCLLLMFPLGLRLV

SEQ ID NO: 189122 - protein, 107 aa, Triticum aestivum
  unsure (1)..(107): unsure at all Xaa locations
  Clone ID: PAT_TA_83540.pep
GKFMIIVDGKPVGNPQDNGEPMIQAQPGDPAAIFELRDGRLFSGEWALGRLNFEDRSMTPKRVLWRKREEVHDLXPVQVEDFGGPPELKFSXAGSGIHREQALCTYH

SEQ ID NO: 189123 - protein, 64 aa, Triticum aestivum
  unsure (1)..(64): unsure at all Xaa locations
  Clone ID: PAT_TA_83541.pep
LAYRPHKFSVFMQSNXTLCYSVLQAIRLSSSTPSTEAIRLNVILDFSKYLVESYWLSPQGFSLC

SEQ ID NO: 189124 - protein, 125 aa, Triticum aestivum
  unsure (1)..(125): unsure at all Xaa locations
  Clone ID: PAT_TA_83542.pep
MDEVTEAVNNLNISGVGAAGVAGAEGHKKNRIQVSNTKKPLFFYVNLAKRYMQLHNEVXCRPSGMAIATVVTVAKIXKNNXLLSXKITMTSTVDIKDETKXPPTKKPKIEICLXRRIMTDGTGKE

SEQ ID NO: 189125 - protein, 56 aa, Triticum aestivum
  Clone ID: PAT_TA_83543.pep
MDESRTRRTIIFSPKICNNVDLLVGNIIHIFPPWKEVKIQEEHVIICTYFSHHHRT

SEQ ID NO: 189126 - protein, 106 aa, Triticum aestivum
  unsure (1)..(106): unsure at all Xaa locations
  Clone ID: PAT_TA_83544.pep
VQTMHTIKEKRSEMSKWKACSPFPHGSTNGGSTQKKRHRCLQTVSGYTFSLFRWVLLSTTTPHCPNHTGGKKNRNQTKMQGASIVKNRARCLFPVGKLDTCXXGGG

SEQ ID NO: 189127 - protein, 96 aa, Triticum aestivum
  Clone ID: PAT_TA_83545.pep
DTDQLLDAVVSNANPGGKQISGDSASCKTSVTDIPSTSYCRLKEPKQSESSAPPLLIKNELAVSNFVKHPSFPEKAADGCLSQNNAIQKSQDTPLD

SEQ ID NO: 189128 - protein, 101 aa, Triticum aestivum
  unsure (1)..(101): unsure at all Xaa locations
  Clone ID: PAT_TA_83546.pep
QLIWXGFNXMMDICAAARXWFEEITHAHPXVSLGXMYYYYSGSSRFCPIKLVMILWIXVCVFLSFGLVTVIVLGPAPAGACGGGCSNSLGTVFARFLNWRL

SEQ ID NO: 189129 - protein, 130 aa, Triticum aestivum
  unsure (1)..(130): unsure at all Xaa locations
  Clone ID: PAT_TA_83547.pep
MADEPPPPALARKSAPAQPWSHVETMHLIDAYEERWTALRRGQLKAHQWEEVXDXVAARCAANPGVIAQRKTGTQCRHKXELRKRYRTEARPSLALAYFAAWFPTGGLAPTRPRYSPPRRDERRFRKRKN

SEQ ID NO: 189130 - protein, 153 aa, Triticum aestivum
  unsure (1)..(153): unsure at all Xaa locations
  Clone ID: PAT_TA_83548.pep
TASTCICERPCRTSWPPVKQSASIQSILCIPVMGGVLELGTTDTVPEAPDLVSRATAAFWEPQCPTYSEEPSSSPSGANETGEVAADDGTFAFXELDHNNGMDDIXAMTAAXGGHGQGGRLRLKRTEPCQTTNLGHITRXXRILHLCDKWPAR

SEQ ID NO: 189131 - protein, 136 aa, Triticum aestivum
  unsure (1)..(136): unsure at all Xaa locations
  Clone ID: PAT_TA_83549.pep
PSFRGRFVPAKATQRASPTLISAARRLLATALLDDPNNQFFALLSQSCIPLHPFPTLYNALLSDNAGPHSHHRSFIEIMDNMDNDTKLLHDRYYARXDDVMLPEVXYDQFRGWVAFFVLXEKXAIMVVXDMRLWKN

SEQ ID NO: 189132 - protein, 103 aa, Triticum aestivum
  unsure (1)..(103): unsure at all Xaa locations
  Clone ID: PAT_TA_83550.pep
MXIFVKTLTGKTITLEVESSDTIDNVKAKIQDKEGIPPDXQRLIFAGKQLXEDGRTLADYNIXKXSTLHLVLKLXRGXIIXPSLXALARKYNXDKCSPMLSRT

SEQ ID NO: 189133 - protein, 112 aa, Triticum aestivum
  Clone ID: PAT_TA_83551.pep
HPFAGGNFSVSMFKLVWRTAFVAVSTVLAILMPFFNAILGLLGALAFWPLTVYFPVEMYKRQSKVERFSKKWVVLQSLSFTCFAVTVAVTVASVQGITQSLNNYVPFKTNCE

SEQ ID NO: 189134 - protein, 112 aa, Triticum aestivum
  unsure (1)..(112): unsure at all Xaa locations
  Clone ID: PAT_TA_83552.pep
RXYLNSKQLNLXSSDVWXSAACRRQYAAAASAGAXSADLGFKATRRGRGSXRRAPEERSVRRRSERXPRRDGSRWAXATAAAVVXRGEWLTRRDRGGRGWRNQGRQVVSCSW

SEQ ID NO: 189135 - protein, 162 aa, Triticum aestivum
  unsure (1)..(162): unsure at all Xaa locations
  Clone ID: PAT_TA_83553.pep
WLVLHGHRDEARRVLERTVGDADRRLQEILTSVQEATKQAGSGGGDAPSSASVRREILLRPTPAVRRVMLAILGLQVFQQACGVAAMVLYAPRVFNHSGXLRRRARRNVSSPPKTWDLPLFSPAPPNLLTTPAEWRVAGPRLSYVGAAPRRWVTSAGSTVLM

SEQ ID NO: 189136 - protein, 57 aa, Triticum aestivum
  unsure (1)..(57): unsure at all Xaa locations
  Clone ID: PAT_TA_83554.pep
TFPXPCPPXXMNKGVINXLISLXKLXRXTYISIMIEXTCRPSPXRXHSHYTLXVMCQ

SEQ ID NO: 189137 - protein, 161 aa, Triticum aestivum
  unsure (1)..(161): unsure at all Xaa locations
  Clone ID: PAT_TA_83555.pep
RGTQKVSKVCISISAIVWIAALVCLIIAWPKSDWLWLIDVFNSIQVGMTAIKYIPQAIMNFRRKSTIGWXSVGNILLDLTGGVLNFCQMGVQSIDQHTLVNFXGNIGENLLSLXDGFFXXLFIIQHYVLYLSRRTRMVRHSERPPYRPRTTEELINVVMRH

SEQ ID NO: 189138 - protein, 158 aa, Triticum aestivum
  unsure (1)..(158): unsure at all Xaa locations
  Clone ID: PAT_TA_83556.pep
MSILWEKSAGWRWLVRRTRDSKPFFFTFAALCGVVPGVIGYGVMQLTGSRNEQLEAHLRSTARPETTMMGQVNRERLAEFLGELQRKEDTNDRYVAALRGETLTKEXYERIQPLPAANAQANQETAGASAEEERPRQMSHQQTASINFYCWTYASSDM

SEQ ID NO: 189139 - protein, 148 aa, Triticum aestivum
  unsure (1)..(148): unsure at all Xaa locations
  Clone ID: PAT_TA_83557.pep
LDARXXSXAGELNRPXQRQLQQHFPXVDRPLVATRTFAQRPNPGGGSRNAAAITQNGPALHRLGLXYPDRTSEPARMPEVSDGRGRXRRPRMNRGGLQEPRRRSTASGSADIPDQGLHPEARALVGARRRRRDQRKPQHLAWAAVAAE

SEQ ID NO: 189140 - protein, 114 aa, Triticum aestivum
  unsure (1)..(114): unsure at all Xaa locations
  Clone ID: PAT_TA_83558.pep
MPAAMAAAAAQRLLAASTKIIGVGRNYIAHAKELGNPVPKEPVLFLKPTSSFLHAGVATAAVEIPEPLESLHHEVELAVVISRRGRDVPEASAMDFVGGYXLALDMTARDFSRC

SEQ ID NO: 189141 - protein, 80 aa, Triticum aestivum
  unsure (1)..(80): unsure at all Xaa locations
  Clone ID: PAT_TA_83559.pep
MIIYCDNTSAISFAKEPRSHKKTKHIKRHFNSLCDYVKEGDIEICKVHMDLNVTDPXTKPLPRAKHDQHQDSMGVRFVTM

SEQ ID NO: 189142 - protein, 43 aa, Triticum aestivum
  Clone ID: PAT_TA_83560.pep
PKGRAPVYHTGYDAVTLPRGTHYFICAMPGHCSAGMKLAVTVY

SEQ ID NO: 189143 - protein, 121 aa, Triticum aestivum
  unsure (1)..(121): unsure at all Xaa locations
  Clone ID: PAT_TA_83561.pep
RXNRXVSFMRXPPXRPRXXTXXPXPXSSQXXSXXLEDXGDHRVGLGEGVXHAGQXVAXLLQHPREHXXGAERQVXEXVEAAXRSQXXXPXQPXXRDAPQRRDADDAEXPRAHFXQXXXAGL

SEQ ID NO: 189144 - protein, 187 aa, Triticum aestivum
  unsure (1)..(187): unsure at all Xaa locations
  Clone ID: PAT_TA_83562.pep
XGGKLHLGYMLIREKQKELQEQRNKRRPGKAEDDRRSREHSKDRNGRSSRDREPERRDRVESRDGRRDYERDRDRRHDRDRRHDRDRDRDYDRSXRGHDSRRRERSRSKGAQAPRRDTKCYTMPDRFRILGGVCSKIWLSLCSYLLKTGLLDLIAWSVIINASGINEVLQRLKSAIQKPPYPGSSTK

SEQ ID NO: 189145 - protein, 66 aa, Triticum aestivum
  Clone ID: PAT_TA_83563.pep
TPDVNKLNLSSRSGTGSIGASNNKAPWSSNNYFSQRSWYVTHDRYAFVNGVSRLAAAATTLRRRAT

SEQ ID NO: 189146 - protein, 147 aa, Triticum aestivum
  unsure (1)..(147): unsure at all Xaa locations
  Clone ID: PAT_TA_83564.pep
MSGRGKGGKGLGKGGAKRHRKVLRDNIQGITKPAIRXLARRGGVKRISGLIYXETRXVLKIFLENVIRDAVTYTEXHPAAKTVTAMDVVYALXRQGRNALRLRRASLRCFDALSVLSWRSTFVCTFKFHFPLGYIAINPRPKKEKKK

SEQ ID NO: 189147 - protein, 60 aa, Triticum aestivum
  unsure (1)..(60): unsure at all Xaa locations
  Clone ID: PAT_TA_83565.pep
MTTKDSTLILEVDLQCEKCYKKIQKVLCKLQSKEKINKIDYXNTXNKVTVXGAFPKKAFQ

SEQ ID NO: 189148 - protein, 132 aa, Triticum aestivum
  unsure (1)..(132): unsure at all Xaa locations
  Clone ID: PAT_TA_83566.pep
HPNTKHQSKCSSRLSSPPPSSASLPPPLQRSAAAPRPAPPSPATLPSPRPSASSLCAPPAPSTSHTSAPLKNXFLLGLPADKQNATCSGKSDGSAVFRLSXGELYLXNTGKXSSALTLIALEWGXVFFSXHC

SEQ ID NO: 189149 - protein, 64 aa, Triticum aestivum
  unsure (1)..(64): unsure at all Xaa locations
  Clone ID: PAT_TA_83567.pep
FRGGDEDDGAHLPSPLSGNGKWNELFWAVHPSGRQILDNXDKVLQLEPEKLGXSRHVXREYRNM

SEQ ID NO: 189150 - protein, 73 aa, Triticum aestivum
  Clone ID: PAT_TA_83568.pep
RRRGGEATNQRQRGCTTRRHRRRTCPTTSTARGGTRRRAASTDASSLRCAASAATRPASAASTASAAAATSRG

SEQ ID NO: 189151 - protein, 196 aa, Triticum aestivum
  unsure (1)..(196): unsure at all Xaa locations
  Clone ID: PAT_TA_83569.pep
MAAAAALLLLLCAASLASAAADDGLTTFKVYFHDVVAGTNPTAVRIAQAASSNTSSTNFGAVVAIDDPLTTGPTRAAGTEVGRAQGTYTFADQQTFGLLMVMNFVFTAGEHNGSTLSSLGRNEVLNDVREMXIVGGSXXFRMARGTSAHISATPGQRNTRQVKANYCYDPAAIRPVVIGALALTESTSQQFIWQII

SEQ ID NO: 189152 - protein, 63 aa, Triticum aestivum
  Clone ID: PAT_TA_83570.pep
YDKSRIIGKGGHGTVYKGIVKGNVPIAIKRCALIDERQKKEFGQEMLILSQINHKNIVKLEGC

SEQ ID NO: 189153 - protein, 59 aa, Triticum aestivum
  Clone ID: PAT_TA_83571.pep
SSPSETYYIHLNYVSYFYEGIILLLINNHSGIKGTESKRDSALRPWINQFKEFTPNKFL

SEQ ID NO: 189154 - protein, 87 aa, Triticum aestivum
  Clone ID: PAT_TA_83572.pep
TIHPILVIESSDTRRTSSSLLDAWYGWFMCAAAFFRSCSCLFWMSTQAAACCCFCCSASGCWEDEHCPIALSLSLSLFLTFSLCFAL

SEQ ID NO: 189155 - protein, 122 aa, Triticum aestivum
  unsure (1)..(122): unsure at all Xaa locations
  Clone ID: PAT_TA_83573.pep
QLRIXCSHATVLQCRGYCCSTSPGISSNSVLYLILIAYSPQTPLTFRQNMDTGNIPALVSNIVLRPKVICTPGTLHXXWHSLPKNVAINHISQTKPQNAAKQISWTNFLITQQRIKVTVSIS

SEQ ID NO: 189156 - protein, 81 aa, Triticum aestivum
  Clone ID: PAT_TA_83574.pep
FFFFALIYCYLSRTRTEEKQQNDLIHLQNLHSSIHPRIPFRLWNLYSSIHPHVTYYLPTLHSSINPHVPLHLQNQIVYHRQ

SEQ ID NO: 189157 - protein, 143 aa, Triticum aestivum
  Clone ID: PAT_TA_83575.pep
MGKQKIVLKLPLDDKRKRRKAFKAAVGMNGVTSATMEGDKITVVGDGVDPITLTTILRRSLGYAELLSVSSGDDKKKGDGYGYGSAGGMMYGGGGYVAKGKRARQRRKARWGLRGITGIRRLLPPTTHPTRALPQIPRKASHQ

SEQ ID NO: 189158 - protein, 115 aa, Triticum aestivum
  unsure (1)..(115): unsure at all Xaa locations
  Clone ID: PAT_TA_83576.pep
RSVANRYCVCXSGRXPCECLXATXTXSRRRLTRXVSWARLRXDTKAVGPPSRGVRRDPADXVASKSSRPIEPVDGYPPRSQFLSRTLCDHPDLYLSLLFVRLIIYCFFNYCVYVS

SEQ ID NO: 189159 - protein, 130 aa, Triticum aestivum
  unsure (1)..(130): unsure at all Xaa locations
  Clone ID: PAT_TA_83577.pep
GAVARIKQFAEETGEENLPGETHQPPAQWPDKGAIQINNLTASYGDGGGEAIKALDAISLEIRGGEKVGICGRTGSGKSSIFLALLRLLESTSGSTVIDGIXXPSVPXRNIRWRXNXLTQDNFVFPXTVQ

SEQ ID NO: 189160 - protein, 88 aa, Triticum aestivum
  unsure (1)..(88): unsure at all Xaa locations
  Clone ID: PAT_TA_83578.pep
MAAAILGMVRRGQDCKTLGGLTDCFLRALISELEFLTAGLQPPQSCQTEILMEGXKLXLHDPVRLFGVPKLPRGHRIVPCSEEFRKLQ

SEQ ID NO: 189161 - protein, 153 aa, Triticum aestivum
  unsure (1)..(153): unsure at all Xaa locations
  Clone ID: PAT_TA_83579.pep
STTISRSSPVGITPAGLQSGHHALDEHIHSLGKMNVQNKGRMDCGFQESTAFHPHSLPDFNDRLRNGISYNCSIPPIGVKSNARAAEAMDVRHIYKGGCGHLNNQSSAHTEAXGFQRTGNCLSMVNKLXWSNSNNLHKQPSSPKIWPNMGQLQ

SEQ ID NO: 189162 - protein, 99 aa, Triticum aestivum
  Clone ID: PAT_TA_83580.pep
PSKAARMFSGTQDKCATCGKTAYPLEKVTVEEKSYHKSCFKCSHGGCAITPSNYAALEGILYCKHHFSQLFKEKGSYNHLIKCASVKRAAEAQPRTTGL

SEQ ID NO: 189163 - protein, 136 aa, Triticum aestivum
  unsure (1)..(136): unsure at all Xaa locations
  Clone ID: PAT_TA_83581.pep
MGTGRRGGGGGGVFHRLLALSSLLLLASGEVVFEERFEDGWETRWVESDWKRSEGKAGRFKHTAGRYSADPDDKGIQTTIDARHFAISAKFPEFSNKNRTLVXQYSIKFDKDIECGGGYISXFRLCQQEKISGDTP

SEQ ID NO: 189164 - protein, 76 aa, Triticum aestivum
  unsure (1)..(76): unsure at all Xaa locations
  Clone ID: PAT_TA_83582.pep
VLWQYFHVTSPKGSSMHLAPAIRHXTMSRLQALVTCXAFGCFSLKVQALRSNHMCLLXXIXGPXADPLKXSGRHFL

SEQ ID NO: 189165 - protein, 46 aa, Triticum aestivum
  unsure (1)..(46): unsure at all Xaa locations
  Clone ID: PAT_TA_83583.pep
EFDNAGAMMSVDETLMCSFQILKPARKVLGGSTNXNKSGFKSSRGW

SEQ ID NO: 189166 - protein, 141 aa, Triticum aestivum
  unsure (1)..(141): unsure at all Xaa locations
  Clone ID: PAT_TA_83584.pep
QINNSXLRXNGPATPKLXGRRRLGXFXNSSQHXPRRXNXVVPALDLGLEIPGTNLLFRWHVTSLCYSGAMKPHGGGGPAVSGSMDGWTRRRRCRGGRGRQSVRPDDRRWRRVFGRLGILGYAEVHHGTQAPRHGGNLPPVR

SEQ ID NO: 189167 - protein, 160 aa, Triticum aestivum
  unsure (1)..(160): unsure at all Xaa locations
  Clone ID: PAT_TA_83585.pep
MAPSNIVVQSSSTPPVAGGDEEFAPSVWGDFFVTYATPVSQASEQRMSERAELLKAQVRQAFDAASMDVAGLITYVDTLERLGLDNHFRDLIGAALERIGAXELPXHXGGLQXVXLRFXLSGKXGIXYFALKKTRGFCPTSQPKGPTNVNGPRWPQHFQG

SEQ ID NO: 189168 - protein, 127 aa, Triticum aestivum
  unsure (1)..(127): unsure at all Xaa locations
  Clone ID: PAT_TA_83586.pep
MASRQGVAASMFATALLLGVFASIPQSAXAIGVCYGMSXNNLPAASXVVSMYXANGIXXMRLYXPDHAXLQGVGGXASTWRXRPNDVLXNIAXXXPRRXWVXXNIKAYRRVXRYWQQVPACKTAAML

SEQ ID NO: 189169 - protein, 127 aa, Triticum aestivum
  Clone ID: PAT_TA_83587.pep
MPSVEVEVQVGGAGGWRPKQQQKHRHHHHPLEIRQVWADNVDREFKLIRAAIERFPYVSMDTEFPGVIHHPPPAVHHSTLTAPQRYALLKSNVDALHLIKVGLGPGAVPWAPARARLQINSAASTRA

SEQ ID NO: 189170 - protein, 87 aa, Triticum aestivum
  unsure (1)..(87): unsure at all Xaa locations
  Clone ID: PAT_TA_83588.pep
MSVPGQCSSQPQFITSVGRSNRSNGPGTPLIESIDVDQIVIPEKNSWKNLFSYIGPGFLVSIAYIDPGNFETDLXAGAQYKYEVPAA

SEQ ID NO: 189171 - protein, 54 aa, Triticum aestivum
  unsure (1)..(54): unsure at all Xaa locations
  Clone ID: PAT_TA_83589.pep
CCRRAXEAVAEPXXRGHRRATGXXPRKXXRAQGXSRGXAAXAVVPEEHXGGEXG

SEQ ID NO: 189172 - protein, 133 aa, Triticum aestivum
  unsure (1)..(133): unsure at all Xaa locations
  Clone ID: PAT_TA_83590.pep
ELLSDPDPPPATLLLSYVFVSPLSVKMASSDGQTEAAAPSVPKNPAMASCRKKKTDDATFLEDLKDHIXEFIHASMDEHKTCFKKTIQKILGCRCCIRGSEGTGVKMLAIKTMSRIIHVGIPAPFLTRFVPFE

SEQ ID NO: 189173 - protein, 102 aa, Triticum aestivum
  unsure (1)..(102): unsure at all Xaa locations
  Clone ID: PAT_TA_83591.pep
TFVLVYTVFSATDPKRSARDSHVPVLAPLPIGFAVFMVHLATIPITGTGINPARSLGAAVIYNKDKAWDDQWIFWVGPLIGAAIAAAYHQYVLRANATXLGS

SEQ ID NO: 189174 - protein, 40 aa, Triticum aestivum
  Clone ID: PAT_TA_83592.pep
RRFCQLPIMLSFSSHLLFSFEALCQTQEYIYTWSSRLLSC

SEQ ID NO: 189175 - protein, 144 aa, Triticum aestivum
  unsure (1)..(144): unsure at all Xaa locations
  Clone ID: PAT_TA_83593.pep
SLMXXXTSXXRRLHXNAFEPYXXPFCPDQXVRGTYHVARAFXHPSXXLLLLPAXGDXXXYGDGVVRXGMGSSPXXLXVAIAAAGTYHYHXHCCCCAXFHXCREPPAGKAAQQXRRGXTSRTMXTTTVPPYAIDRSKWKWNEAEV

SEQ ID NO: 189176 - protein, 88 aa, Triticum aestivum
  unsure (1)..(88): unsure at all Xaa locations
  Clone ID: PAT_TA_83594.pep
LDGSHGLRAGDASFKFLPYQLSMVGXGPTMVVTGDGELRFDENDQLQQVSVHRSPPARXHPXRRPXAXTRLQQPTCASSHTADTQSKG

SEQ ID NO: 189177 - protein, 112 aa, Triticum aestivum
  Clone ID: PAT_TA_83595.pep
LCSSLLAIAQGPKTAARTMKPSCAALVPGLLLLATLAVAAGAGAASSSSPPSSSLGKHPAELVLLGRKGRELGQLSSSSSGYRYYQHQSKQMQQPEEAAATEVKQPEEKEEE

SEQ ID NO: 189178 - protein, 125 aa, Triticum aestivum
  unsure (1)..(125): unsure at all Xaa locations
  Clone ID: PAT_TA_83596.pep
LLSYRTVDGRNLALXSLAAAALCXCCIADSVMFQCMXIKSNMSGHTFLXKFDSXAQWXGYPQLXNSLPXLGXFCVEXLXLHLVXXLHIXXXXKNPGGAGTNWXKXXFXXPRAXLKXNGKPXYNYX

SEQ ID NO: 189179 - protein, 80 aa, Triticum aestivum
  unsure (1)..(80): unsure at all Xaa locations
  Clone ID: PAT_TA_83597.pep
GRPPNDSRSPPAGHRPPPARLRYCTFVARSTVVLAXVRRFHGDFTTIAAQWLQKLPASNKFTYNCDGHTFSYLIEKGFSE

SEQ ID NO: 189180 - protein, 99 aa, Triticum aestivum
  unsure (1)..(99): unsure at all Xaa locations
  Clone ID: PAT_TA_83598.pep
PVGRIHRQLKQRTQANGRVGATAAVYSAAILEYLTAEVLELAGNASKDLXVKRITPRHLQLAIRGDEELDTLIKGTIAXGGVIPHIHKSLINNPPRSED

SEQ ID NO: 189181 - protein, 43 aa, Triticum aestivum
  unsure (1)..(43): unsure at all Xaa locations
  Clone ID: PAT_TA_83599.pep
MXLSXEKTSXGRXYXVKDLSQXDFSRLXXELADVEMPGXMAXR

SEQ ID NO: 189182 - protein, 59 aa, Triticum aestivum
  Clone ID: PAT_TA_83600.pep
RYSIAYFVEPSHDCVVECLPTCKSESNPPKFPPITCSAYLSQRYKDTHADLKSYDDSKA

SEQ ID NO: 189183 - protein, 108 aa, Triticum aestivum
  unsure (1)..(108): unsure at all Xaa locations
  Clone ID: PAT_TA_83601.pep
RDXFXQTFRFQNXSSLIYRAVXWXRTGRAALVGPRRXSSVHDGLCCSASRPNLDTLDDVQLSSGLLYVVLAASGAAAAGDTVDEAEELVLNLSSEVGHCCRSTTGASS

SEQ ID NO: 189184 - protein, 92 aa, Triticum aestivum
  unsure (1)..(92): unsure at all Xaa locations
  Clone ID: PAT_TA_83602.pep
MXLSXXKTSSGREYKVKDLXQAAFXXLXIQLAEVEMPRLXKCRAEXGXSKHFXGXMIXGLXKXTSXLXSXDDTXMXHXXHVXRXTCXHNHAN

SEQ ID NO: 189185 - protein, 135 aa, Triticum aestivum
  unsure (1)..(135): unsure at all Xaa locations
  Clone ID: PAT_TA_83603.pep
EIRSKMKADGTFQQKREQATQQGIHESYYRDMTVMFGKWEFDPMXLPEPPCPVHLWQGXXDXLVPVVLXREXAGKIGWINYHELPGTGHFLSSVPGLGDNVLRTLFSDKQTNTIPQDVSTGLSFQHGGGGGAINL

SEQ ID NO: 189186 - protein, 126 aa, Triticum aestivum
  unsure (1)..(126): unsure at all Xaa locations
  Clone ID: PAT_TA_83604.pep
FXNXDIXWTVDXPXNXXPFQLSXGIDXLPNXSCGPADLVFILTLLYSAFXHWXNFGFLSFLQLSSLVAPXQGLSSLVIPHRGRVAYEDPXIEXVLEPVEGLCSRDDRHLGSESPGRPADSVGRLAG

SEQ ID NO: 189187 - protein, 145 aa, Triticum aestivum
  unsure (1)..(145): unsure at all Xaa locations
  Clone ID: PAT_TA_83605.pep
MPMSSTAQMASLAVLIISLVFAALASDAAAGVRVELTRVHADPSVTASQFVRGALRRDMHRHNARKLALAASSGATVSAPTQNSPNAGEYXMALAIGTPPLPYXAIADTGSDXIWTXARPXLPVLRXPKPLYNRPQQVRRAPNNS

SEQ ID NO: 189188 - protein, 123 aa, Triticum aestivum
  unsure (1)..(123): unsure at all Xaa locations
  Clone ID: PAT_TA_83606.pep
PVLKVAAKVIGEVQALIXFPLLPCLILSILYMFWFSATLHLFXSGQVVRNDCNTDCCSYDLKLGKVNCDNCCGYSIHXTPHISIAILFHLFGCYWATQFXLACSSTVVAGXVXSYXWALVKYT

SEQ ID NO: 189189 - protein, 132 aa, Triticum aestivum
  unsure (1)..(132): unsure at all Xaa locations
  Clone ID: PAT_TA_83607.pep
VEELSKHHNLRQLELYYYATETPGNEKQIKFPADGLQTVKQLCIRCTSPSVTFEPRVLPKVQALVLRFEKGRADDTIGVSGLEHLSSLKHLVLEFEQHDAGAXATVTAVRMAAEGLHLDHQYITLKVDGKNY

SEQ ID NO: 189190 - protein, 130 aa, Triticum aestivum
  Clone ID: PAT_TA_83608.pep
ATPAREVRVRPWRTSRAARWSSTPPATPRRSSPRRAPQPRGATSTRSPPAPAAAFSPYAPRRLPILRPAPRIIAARFWNWAQLLDVYDHLYPGKNEESGQELPKWFTGLVVPNCLRGYGPETALGTIAPM

SEQ ID NO: 189191 - protein, 70 aa, Triticum aestivum
  Clone ID: PAT_TA_83609.pep
SEVEGFGTIKNSESLCIFLLEKAQVALVPGDAFGDDKCIRISYAASLTTLQTAMSKLKEAVALLKPCVAA

SEQ ID NO: 189192 - protein, 153 aa, Triticum aestivum
  unsure (1)..(153): unsure at all Xaa locations
  Clone ID: PAT_TA_83610.pep
XCLLTMXMYSSXIXFFXXMLFVCFKRFLTHRILAPRRAERNXYLSKLSRAQLCPRHSTNRPPFCFLRAIQKRSKPSSSKPEQIISVEIMCASCIGAPLVPEMHASGHQNPVPFARRPQHGCSSRVEVTSEPPNRAAAEAGSRCSGCPAACTGT

SEQ ID NO: 189193 - protein, 133 aa, Triticum aestivum
  unsure (1)..(133): unsure at all Xaa locations
  Clone ID: PAT_TA_83611.pep
PSLRILSPSTLSPPNPTAGAGDSLEIRRGFGAPLGVSRRISGDRDSRLKVLRAHHDEVWFIQFSNNGKYLASASNDKSAIIWEVDEDGELLLRHTLSGIKINDDGCMEPDDXSVLTCGQEXTDLGGSGSVVMF

SEQ ID NO: 189194 - protein, 130 aa, Triticum aestivum
  unsure (1)..(130): unsure at all Xaa locations
  Clone ID: PAT_TA_83612.pep
MTFSFPPEHRGEASEFQCVWFRFRILARISPEVEPKQGRCVAFPCGWXGRLSRELHWTFVLAVAAVYGLXACQGVGNAIGGVAAGYYWKDVQRVQPSVAQXYQGVTDAPWIVKPIWGLLTDVVPVAGFRR

SEQ ID NO: 189195 - protein, 78 aa, Triticum aestivum
  unsure (1)..(78): unsure at all Xaa locations
  Clone ID: PAT_TA_83613.pep
VGGGKXACKXXTCGRVEAEEKVGKXGAXAEQINNPQSXCGSCGLGDAFXCGTCXYRGXPPFKPGEKVSLXGXXLAXDI

SEQ ID NO: 189196 - protein, 92 aa, Triticum aestivum
  Clone ID: PAT_TA_83614.pep
GFRLAYINVYDDMVDLIQHPEKLGLENVSEGCCATGKVEMGFMCNDKSPLTCDDADKYFFWDSFHPTEKINRFFAKGTTAASLSLLTGAPVY

SEQ ID NO: 189197 - protein, 147 aa, Triticum aestivum
  unsure (1)..(147): unsure at all Xaa locations
  Clone ID: PAT_TA_83615.pep
AYYLAILCHLNTPTDNSCTYRASAHSPLIMCFAKDFKISFDLLKIPSSLLLLKFSLACIMVNPISFVILLASLVFIILSPLIQYVEDARIPRSNHRIHPSGSDVIWDMSWFXTNQCLGSFGLLSXMNLSFSXKTMLRSLGWKHKIXA

SEQ ID NO: 189198 - protein, 30 aa, Triticum aestivum
  Clone ID: PAT_TA_83616.pep
DIPGVRFKVVKVSGVSLLALFKEKKEKPRS

SEQ ID NO: 189199 - protein, 109 aa, Triticum aestivum
  unsure (1)..(109): unsure at all Xaa locations
  Clone ID: PAT_TA_83617.pep
RGRRSLMEGKPNPGVDXYLLFDPRAXRSGSGGQFKXPFREAIVFMIGGGNYIEYRSLMELAECXQPPSXKHVIYGATEIVNGVEFIEQLAELGQKAGLGLGGGNNPPLQ

SEQ ID NO: 189200 - protein, 162 aa, Triticum aestivum
  unsure (1)..(162): unsure at all Xaa locations
  Clone ID: PAT_TA_83618.pep
QDGTPVDMVFNPLGVPSRMNVGQIFESSLGLAGDLLKKHYRIAPFDERYEQEASRKLVFSELYEASKXTKNPWVFXPEYPGKSRIFDGRTGXPFEQPVLIGXSYILKLIHQVDEKXHGRSXXPYPLVTXQXVKGRXSKGXTIGXRNLGFKRFXVAXIXXDLL

SEQ ID NO: 189201 - protein, 144 aa, Triticum aestivum
  unsure (1)..(144): unsure at all Xaa locations
  Clone ID: PAT_TA_83619.pep
MAELVGPRVYSCCTCRNHVCLHDDVISKAFQGRNGRAFLFSHAMNVVXGAXEDRHLKTGLHTVADIYCNDCRXVLGWNMXXTYEXDQKYXGRKSYXRIKDVKGNWYPNCNHKILVKMNGIVLLDVGSGTFPWMNAKGPNLIHTL

SEQ ID NO: 189202 - protein, 55 aa, Triticum aestivum
  Clone ID: PAT_TA_83620.pep
NLLNNNPARDVLFFRTEIIHTLGHRLFHYSYSHLLDRQEHDAMQTQSPAISRFKV

SEQ ID NO: 189203 - protein, 97 aa, Triticum aestivum
  Clone ID: PAT_TA_83621.pep
IANVNPQFLCRLYSAAERQNRCGARTCRPGHLESWAGPDRMAAPRLPPRRAAALAAQARRRGRARAAVQLSARAAGVYVREPSRLTAKASVTVRWAV

SEQ ID NO: 189204 - protein, 140 aa, Triticum aestivum
  unsure (1)..(140): unsure at all Xaa locations
  Clone ID: PAT_TA_83622.pep
MSRTLVQPVGQKRLTNVAVVRLRKHGQRFEIACFPNKVLSWRSRVEKDIDEVLQSHTVYSNVSKGILANSKELAKAFGTDDLTQICIXILGERGIQVSGKEKEAQLSSSSANPTIAWRRHQPTAALITYTLMTNNSRQPN

SEQ ID NO: 189205 - protein, 192 aa, Triticum aestivum
  unsure (1)..(192): unsure at all Xaa locations
  Clone ID: PAT_TA_83623.pep
MSLSWWWTRSVGAVRERKDELAGVPEHSFQSVALVVGSTGIVGASLVDILPRSDTPGGPWKVYALSRRPPPPWSLPSSSSLTHIHVDLTDFAAVAEALTPLTDITHVFYSPGPRAPLXRRTRRQSAMLRKSSPSSPKLPRLAXXSLKTAQAYWDVQLIKSPDRPNEDCALTANLIDKGVSPGIPGRLNTPTS

SEQ ID NO: 189206 - protein, 160 aa, Triticum aestivum
  unsure (1)..(160): unsure at all Xaa locations
  Clone ID: PAT_TA_83624.pep
VNDAPSLKKADTGIAVEGASDAARSAADIVFLAPGLGAIIDALKTSRQIFHRMYAYVVYRIALSLHMEFFLGLWIAILNKSLNIELVVFIAIFADIATLAIAYDNAPFSQTPVKWNSPSXGVXRSPRVAWLVGNWIALHKANRRGNVKTRKSPSIPNEGN

SEQ ID NO: 189207 - protein, 56 aa, Triticum aestivum
  Clone ID: PAT_TA_83625.pep
SRKVSFPSESLMRPSHVGLGRHHRPSSSSPLLASSAPQLRLCSSGFWKNTVMLTFM

SEQ ID NO: 189208 - protein, 84 aa, Triticum aestivum
  unsure (1)..(84): unsure at all Xaa locations
  Clone ID: PAT_TA_83626.pep
FNDLLAGVLDXCHPVRXQXDCDXLXGCQLLPILPNRRRHXXSRPLPNRXXXGGQVVGEGLGWRGGGGGGAGAQRXRAEGGGEGX

SEQ ID NO: 189209 - protein, 188 aa, Triticum aestivum
  unsure (1)..(188): unsure at all Xaa locations
  Clone ID: PAT_TA_83627.pep
KYLSLRSEVDEEKVSKLQSCVDYGTCSCRDMFPLESLPCSSSSRATKQLIISQXPKILCIHFLRASVGLDGEPIKHQGHISFPLLLNLSPFTGGAXSAGPLAMNAQRDGQQALHLYRQLNIRLMLTCPFIITTQLQGQVIRPAASGHTGLEEAHHLRKNPTRSANCSLGTGLIKSNSRSPAFKNYPRK

SEQ ID NO: 189210 - protein, 56 aa, Triticum aestivum
  unsure (1)..(56): unsure at all Xaa locations
  Clone ID: PAT_TA_83628.pep
PVPGAWCTGKXRWFSDPCSXWSNVNIXRPGPQAEKFRTYXNXIMEESKSSNNSCXQ

SEQ ID NO: 189211 - protein, 119 aa, Triticum aestivum
  unsure (1)..(119): unsure at all Xaa locations
  Clone ID: PAT_TA_83629.pep
SRPAASXASTAANGXHXRRRGDHRRRPXRXXQXAXPRSAPAEDXEXEGEVQLLXXRXGGDPGGRRPRXXXVPXRRXRALLPHPRGXLRSGXRTXCRLKGTXLXPXGEXXTCLGGFSLGL

SEQ ID NO: 189212 - protein, 131 aa, Triticum aestivum
  unsure (1)..(131): unsure at all Xaa locations
  Clone ID: PAT_TA_83630.pep
MAAACISHRFRHSKLPVLVLALATVVAAARAQLSPPTFYASSCPAALVTINAGVXGLPCCWTAHXGASLLRXLHFHDCFVQGCDASVLLDDNGIXGEXKXXGPNAGSLKGFGSSTHQSLLEAPGRVSPVAP

SEQ ID NO: 189213 - protein, 154 aa, Triticum aestivum
  unsure (1)..(154): unsure at all Xaa locations
  Clone ID: PAT_TA_83631.pep
GFSNSAPSPPPRHRHYECFATSQPAHSTSRHLPLHRGSSKPWPWRKAASFLSSLLRRRRRGAGGDCEIYFIYPINPAGSCRVTSAHHSTGFPVGFXMGGGXTQKGDIHPXGGTQACSGPSGXPPGAFPENXNQARHNWYXTPGWHLKXXNNGTH

SEQ ID NO: 189214 - protein, 56 aa, Triticum aestivum
  unsure (1)..(56): unsure at all Xaa locations
  Clone ID: PAT_TA_83632.pep
HRXEAXRXGAXYXXGDQHXGVSSIXLIMRRXSPVFLLLLSXXXAXXHRIXSSXTSQ

SEQ ID NO: 189215 - protein, 160 aa, Triticum aestivum
  unsure (1)..(160): unsure at all Xaa locations
  Clone ID: PAT_TA_83633.pep
GPVFRAENSNTHRHLCEFVGLDAEMEIKEHYFEVCDIIDGLFVSIFKHLSENCKKELESINRQYPFEPLKYLDKTLKLTYEEGIQMLKEAGTEIEPMGDLNTEAEKKLGRLVXENYDTXFFILYRYPLAVXPFHTMPCYDNQRTQSFDVSIQXRRYIWTQ

SEQ ID NO: 189216 - protein, 113 aa, Triticum aestivum
  unsure (1)..(113): unsure at all Xaa locations
  Clone ID: PAT_TA_83634.pep
LPSKPTAAAPTPPTPPRPRPYRAVPETQRPDPFLHLPSHRNRKPPAPALGGRPGSGDHFVAARREGVXVSARHLDEKGSGGGGCXRRTGTPSRCSKLTSXTPTPWASEFPRGL

SEQ ID NO: 189217 - protein, 147 aa, Triticum aestivum
  unsure (1)..(147): unsure at all Xaa locations
  Clone ID: PAT_TA_83635.pep
EAGDXMSXXXVAXLGSRPGFAAXGNAQXSSSGXPSYRRRGGHRRRGTPSPPGGXTGSXTQGPAILLGSSYLPSHPIYSCMYRHRSIDPRRWIILIIYSPFLDLNTFYLFILKKEQTFFCSTKQCSVCYYQFNTTISLSIKKKKKKTR

SEQ ID NO: 189218 - protein, 129 aa, Triticum aestivum
  unsure (1)..(129): unsure at all Xaa locations
  Clone ID: PAT_TA_83636.pep
MATVAMDISKPTPVASGDEAAAAAKGRSGGGGEGLRQYYLQHIHDLQLQIRHKTHNLNRLEAQRNDLNSRVRMLREXLXLLXEPGSYVGXVVKAWGNQRFWXKVNPEGKXXVDINXPLIXXXTPXTXPS

SEQ ID NO: 189219 - protein, 61 aa, Triticum aestivum
  Clone ID: PAT_TA_83637.pep
SKPQIAVISNDADGGLTWQRSHITIYSFILQVVVYMNQRHMHVIIQYKKFSPSSSHSSFIN

SEQ ID NO: 189220 - protein, 67 aa, Triticum aestivum
  Clone ID: PAT_TA_83638.pep
WPHWNRKFGANWALRRFDQLSPCHLGVQHALNSFTNLVKGRFCEIRPIASMASSHYVEEGNRLSYVW

SEQ ID NO: 189221 - protein, 102 aa, Triticum aestivum
  unsure (1)..(102): unsure at all Xaa locations
  Clone ID: PAT_TA_83639.pep
FLVRGGMRTNSILVPCVWXSAICVDLSXXFVXPMSLCTTQSFGSXSINIIQYPNNVINPWTXAEVCTVSFRTLAPGRXNRDRPSPSFALFFIFSLSYLPNEY

SEQ ID NO: 189222 - protein, 91 aa, Triticum aestivum
  Clone ID: PAT_TA_83640.pep
EKRYMYGDTYVLSILVSINLDLHYIQLLSMWGSSTMTSRLCKTKGFPITDKEGVTAALFRLALVLVVILGGLRTCRLTIFHVSCSPYCHVC

SEQ ID NO: 189223 - protein, 138 aa, Triticum aestivum
  unsure (1)..(138): unsure at all Xaa locations
  Clone ID: PAT_TA_83641.pep
AAGPSPPGGCFGCCAKPTPIIAVDEPSKRLRIQGRSVRKASLSEDFWSTSAHEMENSGIQSQRSMSSXKHVGSVQAIKHTAXSSSNPNXFMNQXLCSGNKTXQHGLXAKNASSNNLGGPVPIRLDLYPAWRLRENLRN

SEQ ID NO: 189224 - protein, 98 aa, Triticum aestivum
  Clone ID: PAT_TA_83642.pep
MASLTVSTKTAAAGGNKQREGAEVITGAEACFAHSKQMLQALGFPGGVMPLRGLEECGWVRETGFVWMRQKAPTTLLPRHGTGCATTRSHAYRTAVNA

SEQ ID NO: 189225 - protein, 147 aa, Triticum aestivum
  unsure (1)..(147): unsure at all Xaa locations
  Clone ID: PAT_TA_83643.pep
PRSRRLSLSSRRFTSTRGASCSGASPSRKAALAWSRCXGSARRTAXWWRSSASSXTQACAAXRLRGWXPXRCARCRCSXWSPNMPRKXXASXPSCTGSAXCXXGEMEDGQLGKLLPGCRHFSTFECTTLVXVXSNCPCAGRXYPASV

SEQ ID NO: 189226 - protein, 112 aa, Triticum aestivum
  unsure (1)..(112): unsure at all Xaa locations
  Clone ID: PAT_TA_83644.pep
MDSTGTGAGGKGKKGAAGRKVGGPRKKSVSRSVKAGLQFPVGRIGRYLKKGRYAQRVGTGAPVYLAAVLEYLAAXVWXLAGNAAXDNKKTRIIRAKCFWRFRXDEDLGTLGG

SEQ ID NO: 189227 - protein, 56 aa, Triticum aestivum
  unsure (1)..(56): unsure at all Xaa locations
  Clone ID: PAT_TA_83645.pep
LPPHTPPPHLLPLSLPAAVVPAXXLWSFXGRXLXRHRRHLRLTRRASXLPLXIRXP

SEQ ID NO: 189228 - protein, 70 aa, Triticum aestivum
  unsure (1)..(70): unsure at all Xaa locations
  Clone ID: PAT_TA_83646.pep
NTRIAWGPCIMFTIRSLLHAHMPPHNSVQVLVEPVAHVAQSSSAPVTAAASSXLYLTPIHALRQEKPWXK

SEQ ID NO: 189229 - protein, 117 aa, Triticum aestivum
  unsure (1)..(117): unsure at all Xaa locations
  Clone ID: PAT_TA_83647.pep
MAATRRLSCFLLAVLLAGVAAATAFDEAAAAGFGLGHXARFARKHGRAAAEMPQPEPQPKTKPEPHMQPLPQPEPKPKPMPHPEPKXPEPQPXPNPEXQPMPKXQPXXXPEHCLHGT

SEQ ID NO: 189230 - protein, 198 aa, Triticum aestivum
  unsure (1)..(198): unsure at all Xaa locations
  Clone ID: PAT_TA_83648.pep
IFPGAQPAPHRSFSEEVAALNRYFGGLKSGGNAYVIGDPARPGQKWHVFYATEYPEQPMVNLEMCMTGXLDKKKACVFFKTNADGNTTCAKEMTKLSGISGNIPRDGICXFDFXPCGYSMKCIQWSCILHIHVTPXDGSTXRNYXVMGXDAXLXXXDLSKXLRCFGPKISVPXXFXGVASGMGKDXXKAXLVDKTLKG

SEQ ID NO: 189231 - protein, 98 aa, Triticum aestivum
  unsure (1)..(98): unsure at all Xaa locations
  Clone ID: PAT_TA_83649.pep
ALLDXILEXTSFRFKVEITCFKDHFKXPAEQRKRLNFRXDTKRCCHLNVSSTIYLKFLIANPGYRSVLSSTSLPSAPLLLTLPLVLVLPHLRFRHVLA

SEQ ID NO: 189232 - protein, 119 aa, Triticum aestivum
  unsure (1)..(119): unsure at all Xaa locations
  Clone ID: PAT_TA_83650.pep
MTDRARASQSPCFLDRSHLXXIPRSLVLSQPGRQFXTLLLTQDXXSPKVNELRHRQXPAPRKVLCMGVAXVGNLAMEEKQXQQNXQMSVNFLVSLLKKNWQNVRCLYVKSTMGKPYRVF

SEQ ID NO: 189233 - protein, 96 aa, Triticum aestivum
  Clone ID: PAT_TA_83651.pep
FFFFNILPGTVYKRTHKYGVYITDVYPQNYWGGVILDTMKNKCYRLQDPSALDLLTDLILCTHTYVFFFHSQPSDQNLRYKVHNYACFNNMVPAKD

SEQ ID NO: 189234 - protein, 77 aa, Triticum aestivum
  Clone ID: PAT_TA_83652.pep
TDGYFTSCMEALLGLILGKNHECVIHAFFCSACYSETHFQKYLFPNSKGFLQAHITINCFGISLHRLSGDRAGSRRC

SEQ ID NO: 189235 - protein, 104 aa, Triticum aestivum
  unsure (1)..(104): unsure at all Xaa locations
  Clone ID: PAT_TA_83653.pep
ETIRHFSLLPAGGGGILAHTVARVASSIKIKGDNSGDGIESXXXKXXRLIVDGDLITAADALEQGLHGTEAEEIATEWVKQXRKRAIAEQTLLSFRVAPPTTSP

SEQ ID NO: 189236 - protein, 165 aa, Triticum aestivum
  unsure (1)..(165): unsure at all Xaa locations
  Clone ID: PAT_TA_83654.pep
AHGLESSGHRFLWAVRSPPEEPDTDLGKLLPEGFLDRNRDRGMVVKDWVPQAEVVRHEAVRAFVTHCGWNSTLRGXIMSGLPMICWRCTRSKGQQGFMVEEXRXRLDCAGYENSSKADRSQGDGAEEGSSPGKVPVGEKALGLLRKRLLNGSPILWNLTRHRKRP

SEQ ID NO: 189237 - protein, 125 aa, Triticum aestivum
  unsure (1)..(125): unsure at all Xaa locations
  Clone ID: PAT_TA_83655.pep
MSGRGKGGKGLGKGGAKRHRKVLRDNIQGITKPAIRRLARRGGVKRISGLIYEETPRRAQDLLGELIRDXVTYTEHVARXKTVTAMDSSTRLTPSRTSTVPAVACRPRSPSLRSVFCIPFVWGIS

SEQ ID NO: 189238 - protein, 149 aa, Triticum aestivum
  unsure (1)..(149): unsure at all Xaa locations
  Clone ID: PAT_TA_83656.pep
MAPKAEKKPAAKKPAEEEPAAEKTTAGKKPKAEKRVPAGKSAGKEGGEGKRGKKKGKKSVETYKIYIFKVLKQVHPDIGISSKAMSIMNXFINDIFEXLAGXAAXLARYNKXPTITPAKFRLLRLXSPXPNKPLLRDKASQFTLLPPFP

SEQ ID NO: 189239 - protein, 78 aa, Triticum aestivum
  Clone ID: PAT_TA_83657.pep
KHPPIGRCRTRNRNLPPGCFHRARARARHTPQTAVTHTPGHAARHTTNNVPSPCSLPGSIVPRQKILRARAVFFPTYS

SEQ ID NO: 189240 - protein, 93 aa, Triticum aestivum
  unsure (1)..(93): unsure at all Xaa locations
  Clone ID: PAT_TA_83658.pep
LRCPRRGLXLIRFXXSSPLSXSPQXQIEPXEAVXVIRSKXGAWXPDSXAVXSPSPVFXSRRDXPXWXSXHXXLXAPXEDXMPAXLAAFXTLRX

SEQ ID NO: 189241 - protein, 124 aa, Triticum aestivum
  Clone ID: PAT_TA_83659.pep
EYHGDTYHLISKNCNHFTDDLSTRLTGKSIPGWVNRLARLGAFCNCLLPEGLRLESTETKHLGDCRFSDGSNTTSNDNSDEDELEDKHLLPTTSVGEDTVKGISEFGKPLIPPKMVSILMTGHK

SEQ ID NO: 189242 - protein, 70 aa, Triticum aestivum
  unsure (1)..(70): unsure at all Xaa locations
  Clone ID: PAT_TA_83660.pep
VXTRSVTATLASALAPAPFXFFPSFLATFXGFPRQALNXGLPLGFRFSALRHLXXKKLDXGDXSXTGXXP

SEQ ID NO: 189243 - protein, 161 aa, Triticum aestivum
  unsure (1)..(161): unsure at all Xaa locations
  Clone ID: PAT_TA_83661.pep
MASPPYATSPSGMSPPYPSPAQIPNKKRPSTLDGSAPPHKRRKPSQTSVSTSSAAHPLRQTSFPPEARSPFPRSPSVDAQSQFXRXRNEQNSKGTPKKKRGRKGKNAKADDAREQTPXLSEDGACCPTGLEGGYIRYKVKWPGGFKTKKTGGSTSFRVSTT

SEQ ID NO: 189244 - protein, 127 aa, Triticum aestivum
  unsure (1)..(127): unsure at all Xaa locations
  Clone ID: PAT_TA_83662.pep
EAXXXLXTXAXLVXAVMELELLXXGFHXIXSRAALDMGVXKXXFLXYXNAXSLLVAAXVXYFLNKKHRPPFTLHLXMDFFLLAAXGVTFTXGLXILGLYYLSPTYSLSSRTHSCITFSWXLVXVISG

SEQ ID NO: 189245 - protein, 152 aa, Triticum aestivum
  unsure (1)..(152): unsure at all Xaa locations
  Clone ID: PAT_TA_83663.pep
SGPCAERGSRILSPSPPLRRYFPSRRDQPSWISRHKALRAPGEDTMPAVLAAFATLRAAAAIASGDSSFPCSHRLKHRFSNSNLIVVIVINFAFPPSRKLSVGXNFAFGLXRCAPFXATLVCGSPXSNWXRDXLKXEEXXAYTKDXXFLEIG

SEQ ID NO: 189246 - protein, 80 aa, Triticum aestivum
  Clone ID: PAT_TA_83664.pep
HDSLMYYNKPRVPFHPILPDAHGTHNSYRHHNDNDATTYLAHFLGQPYKGTFSPDATMLTGPKPLFPVRGDTSEGSSLAH

SEQ ID NO: 189247 - protein, 83 aa, Triticum aestivum
  unsure (1)..(83): unsure at all Xaa locations
  Clone ID: PAT_TA_83665.pep
RVCSQCSHXIAXVLPQWGSRCNLPXCRXXLKRXTPGTLDAHDXGSXRHATVTRENIRRLFMYVEKLPLVAPDNIFYAYDSHVK

SEQ ID NO: 189248 - protein, 97 aa, Triticum aestivum
  unsure (1)..(97): unsure at all Xaa locations
  Clone ID: PAT_TA_83666.pep
QLVTFXESNSTTXLELLHEHIMLHHRMQQLIPWQRCCCYNDLQREAAAGAVLAEANTSNQGQEPHEVRLFDVPTRIGRTSAANAAPPRRRARAGRST

SEQ ID NO: 189249 - protein, 114 aa, Triticum aestivum
  unsure (1)..(114): unsure at all Xaa locations
  Clone ID: PAT_TA_83667.pep
LFLVSILRRPPFSRARRPPPPGARKSWEVFFGDEHPPGHISAMGDYTIQISTKLIDQLARDDEKVKRKARKPKPKKKPTVQPHEEPLEFPREPKTTSLATAPGWLCSLPLCFCX

SEQ ID NO: 189250 - protein, 68 aa, Triticum aestivum
  Clone ID: PAT_TA_83668.pep
IYFLLFIPSIVALRAAIMSDLNKQNLPASNRPTVHQSTDPVPGAHDQITQDLENKIYILQTDAFIVRS

SEQ ID NO: 189251 - protein, 84 aa, Triticum aestivum
  unsure (1)..(84): unsure at all Xaa locations
  Clone ID: PAT_TA_83669.pep
DTPLPFLRSPRLPQNPTRNRRHGRRRQAPPPGRRHPDGFLRRRRAPVRPRXXRSSXPSPPSSGRXRDXHQHRLPTXHXSHXXPP

SEQ ID NO: 189252 - protein, 107 aa, Triticum aestivum
  unsure (1)..(107): unsure at all Xaa locations
  Clone ID: PAT_TA_83670.pep
XLFVXAXXXXRXLXLIGLELXXRFLGAKLAXFLXLXNHLQAIXLXXLRSRRXAWEQKSAKACXASIALGPLXFXKCFFNPSSHVGKLEMGSRYSAPPAAATPSPYAP

SEQ ID NO: 189253 - protein, 94 aa, Triticum aestivum
  unsure (1)..(94): unsure at all Xaa locations
  Clone ID: PAT_TA_83671.pep
MAAATVSVPRIKLGSQGLEVSAXGLGCMGMSAFYGPPXPEPDMXKLIQQAVAAXGXTSLXTSXXYGPQTNXXLLGKGLQGGLKGKVQLALPSLP

SEQ ID NO: 189254 - protein, 79 aa, Triticum aestivum
  unsure (1)..(79): unsure at all Xaa locations
  Clone ID: PAT_TA_83672.pep
MSCNCGSSCGCGSSCKCXKKYPDLQETXPPRRPPSLLGVAPXXXAXPEFVQAAGVRAAAGSAVGNWKLRTLLADQLDQW

SEQ ID NO: 189255 - protein, 61 aa, Triticum aestivum
  unsure (1)..(61): unsure at all Xaa locations
  Clone ID: PAT_TA_83673.pep
MVKLAFGSVGDSFSATSIKAYVAEFIATLXLFVFAGVGSAIAXGKLDKWRPLDPAGLLAXP

SEQ ID NO: 189256 - protein, 142 aa, Triticum aestivum
  unsure (1)..(142): unsure at all Xaa locations
  Clone ID: PAT_TA_83674.pep
EYDVLLLIGLGIGATPLISIVKDVLNHTQHGGSVSGTEPEGSGKAKKRPFMTKRAYFYWVTREEGSFEWFRXVMNXVGXERTRMGVIELHNNCXIVYKEGMHVLHSIVMLQDSNNAKKGVDILXGTNVKTHFARPIGRLQHA

SEQ ID NO: 189257 - protein, 42 aa, Triticum aestivum
  Clone ID: PAT_TA_83675.pep
FFFFMEASKDMPLHCIRLEKKDNPQDPTHIGKENENTKNTIH

SEQ ID NO: 189258 - protein, 126 aa, Triticum aestivum
  unsure (1)..(126): unsure at all Xaa locations
  Clone ID: PAT_TA_83676.pep
PTDVFRVFYADRLVWRLVVKAAGAPGHGSRMLDGAAVDNLMDCVETIAAFRDAQFRMVKSGEKGPGEVVSVNPVYMKAGIPSPTGFVMNMQPSEAEVGFDLRLPPTEDIEQXKRRVXXEWAPSHKN

SEQ ID NO: 189259 - protein, 108 aa, Triticum aestivum
  unsure (1)..(108): unsure at all Xaa locations
  Clone ID: PAT_TA_83677.pep
KCGNETFLHSQAHSCIGACLCMCKINTYSENCIFGHERPLCFPSWNWAFLXDLNVSKELSTLLQLRLXXCLVHLCSEAKFKDXGMXTXXLVRKQPXPLXKHXIKXKEK

SEQ ID NO: 189260 - protein, 140 aa, Triticum aestivum
  unsure (1)..(140): unsure at all Xaa locations
  Clone ID: PAT_TA_83678.pep
TNLVEGSRPNLIPILQLDRCSERRERKEQWRRGLWHRWQRTWPGSAGGAEEVGAPALPHGAQLPPPPLLPGNHSPNPPLFASLLISICLPARGRDWLVLSLPRSVRXPRQFETMQVVPXGITXRHTDXNHNATXGKSLIK

SEQ ID NO: 189261 - protein, 109 aa, Triticum aestivum
  Clone ID: PAT_TA_83679.pep
FFFFKECHCRSFSNCLNQTEEKHRLVLLYKRRDIERDCCKRWLLVAVFAEDASARSSDACTAAGTSSSTKEHGRRNSDGHRWALGLLKQQPEQCPVKGSDRSWTATCRG

SEQ ID NO: 189262 - protein, 43 aa, Triticum aestivum
  unsure (1)..(43): unsure at all Xaa locations
  Clone ID: PAT_TA_83680.pep
LCYLVPISRCTLRSVEFRILSIPRSFDHIVFPPXKQDCSXKGG

SEQ ID NO: 189263 - protein, 160 aa, Triticum aestivum
  unsure (1)..(160): unsure at all Xaa locations
  Clone ID: PAT_TA_83681.pep
MEAAGGEQHETRRRAGAGLALLGVVYSSLLLNAIFVAHHFLSPSRLLLRDDGCGCGLTWSLQAAREAEAVAAXECSGPRAGVPSXGVAGEDGRPGCECNTASXGPDCSXRTPNCTADARQRNPLFPEPYWRXHPAAXAVVFSGVERMTTHTGGSIVDWQG

SEQ ID NO: 189264 - protein, 72 aa, Triticum aestivum
  Clone ID: PAT_TA_83682.pep
EIQRVHQKTLKPKSYFQVSAIPTYGLSQILQVSCHRCNKAIKIASKSVRSFSVRENSALYKLRWQRIKAIDA

SEQ ID NO: 189265 - protein, 132 aa, Triticum aestivum
  unsure (1)..(132): unsure at all Xaa locations
  Clone ID: PAT_TA_83683.pep
ARQAGAPPLKGAVLIHPWFWGSEAVGEEPRDPAARAMGVGLWLFACPETNGLDDPRMNPLAPAAPGLHTLACERVMVCAAEGDFLXWRGRAYAEAVAAAKGGDLGEAAGVNCWRHGRRHSSSPQTDCYKVRR

SEQ ID NO: 189266 - protein, 87 aa, Triticum aestivum
  unsure (1)..(87): unsure at all Xaa locations
  Clone ID: PAT_TA_83684.pep
STLLILHRLSSSRPILRFNHRPRRTPPPSAPSSSLSTCTSLARPLLAAAMGRGKFKGKPTGRRNFSTLEEIAAGTSGRPRTFMXTGN

SEQ ID NO: 189267 - protein, 78 aa, Triticum aestivum
  Clone ID: PAT_TA_83685.pep
TALTAITQLTHHGMVFVPVGYTFGAKLFGMDQVQGGSPYGAGTFAADGSRWPSEVELEHAFHQGKYFAGIAKKLKGSA

SEQ ID NO: 189268 - protein, 72 aa, Triticum aestivum
  Clone ID: PAT_TA_83686.pep
PNQFPSNRFAKGYKQSVCKNVSRCIMMHRTAEAFSLWPCLPVELRQSQLDPIRFTRGFTGVLEGLTLTGRVP

SEQ ID NO: 189269 - protein, 168 aa, Triticum aestivum
  unsure (1)..(168): unsure at all Xaa locations
  Clone ID: PAT_TA_83687.pep
PPSPSLLAGILSDLAEIGGSFRGGFSRSSPAPDHPAPDALESQQAASSPSPRPPPPAAADQIADDVVGAARALAARPEAWXDFPVLALXEGSVISGIQRDHMDPIEKLVQDLASLRGXLCPSTWMKTIEDYLRLSHKHINIRRCKFVIHMIRSNSVKNVKQQLEGFQK

SEQ ID NO: 189270 - protein, 170 aa, Triticum aestivum
  unsure (1)..(170): unsure at all Xaa locations
  Clone ID: PAT_TA_83688.pep
XKYPXLFQMXFVLNSXPKFSDNLLFKISLIEALHVYFQRAVPDLKPMPRCGGQQALVWRCRATAVDCHHLHDHRINTALCDSHQVYQGCSLSACEKSATRSAQMARCRRIQTRRRRGLARRAAAPERMEAVEADVRGCRQRSRRAMEEAEAARRRRRTGSSLSRPVAAGT

SEQ ID NO: 189271 - protein, 77 aa, Triticum aestivum
  unsure (1)..(77): unsure at all Xaa locations
  Clone ID: PAT_TA_83689.pep
RHNDGVDPFLHETIDXTASVSSQXXNXXLLIGNGXCTSSXSAHXFIIPASPXSXXGARLRSKFLTVXRPDXDSIPDA

SEQ ID NO: 189272 - protein, 133 aa, Triticum aestivum
  unsure (1)..(133): unsure at all Xaa locations
  Clone ID: PAT_TA_83690.pep
TYPGMLSDSVFATVDRQSKTRKAIAVPMKILIEEEFSNDVNSRHISPGAVGRLMGLDSLPSSGIHNKHRHTKSHAPKTSPSSFHGRTGLHDIPHRRSVDTINVFEGMGSTKTNMHRSPRSKIGSTTSRXRQGC

SEQ ID NO: 189273 - protein, 67 aa, Triticum aestivum
  Clone ID: PAT_TA_83691.pep
KQKQANPDQSEHLYSRNVDFLAHIAESCKIVSSSYGTFKKKAREQGWIMSESLLNPGKARLCAAKPQ

SEQ ID NO: 189274 - protein, 77 aa, Triticum aestivum
  unsure (1)..(77): unsure at all Xaa locations
  Clone ID: PAT_TA_83692.pep
CTMXGYWGSSEGMXVDRKMPIHERSVXSVNAVDYPSDDAQLRYRIPKEYQSIMXHXRECISNCLXLRYVLEILHDAS

SEQ ID NO: 189275 - protein, 146 aa, Triticum aestivum
  unsure (1)..(146): unsure at all Xaa locations
  Clone ID: PAT_TA_83693.pep
GPQXLPSGKFIPGNXNSYDKCRRXFDLGDADYLRYHGMQEFDQAMQHLEQKYEFMTSDHQYISRKHXEDKVIVFEKGXLVFVFNFHCNNSXFDYRXGCRKPGVYKXVXDXDAGLLGGLXRFXXAXEXXTXDXSHDNRQNQSPFIPM

SEQ ID NO: 189276 - protein, 77 aa, Triticum aestivum
  unsure (1)..(77): unsure at all Xaa locations
  Clone ID: PAT_TA_83694.pep
PVASRAEPSERRGVGARIGLPVLSVHSARRADDMRSLLRPYREGXTLREXGADDGAAAGVFLAWKEQPVVWTSAWRP

SEQ ID NO: 189277 - protein, 113 aa, Triticum aestivum
  unsure (1)..(113): unsure at all Xaa locations
  Clone ID: PAT_TA_83695.pep
MASSPTPKKVLVPIANGTEPMEAVITIDVLRRAGADVAVASVEPGATSVAASWGIKLTADALLXXLADDEFDLISLPGGMPGSSTFGXCKVLEKMVKKHXXEGXLYAAICAEQ

SEQ ID NO: 189278 - protein, 97 aa, Triticum aestivum
  Clone ID: PAT_TA_83696.pep
IDGGGGRAPSAQWRTAAKRKAAEEATRAAANGADAPAAAETGLGAGASAAEATERTTAARTATTARAFDPIPAIGGGGVVAAGLEGCPETNDSGERR

SEQ ID NO: 189279 - protein, 136 aa, Triticum aestivum
  unsure (1)..(136): unsure at all Xaa locations
  Clone ID: PAT_TA_83697.pep
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNXSDTGCFGFGNQEHIDLGIKYDPSTGNYGMDFYVVWNNW

SEQ ID NO: 189280 - protein, 172 aa, Triticum aestivum
  unsure (1)..(172): unsure at all Xaa locations
  Clone ID: PAT_TA_83698.pep
MAEETDTRPASASSRGRPAPEDDDREEGEITDIACAPSPPATHPLEHSWTFWFDNPQSKSKQAAWGSSIRPIHTFSTVEEFWGLYNNINHPSKLIVGAXFHCFKNKIEPKWEXPICANGGKWTSXWKXKSDTFGCNSAGIMVNIHVMKLCVVEQERCIKMCNCQVDRNMKTP

SEQ ID NO: 189281 - protein, 128 aa, Triticum aestivum
  unsure (1)..(128): unsure at all Xaa locations
  Clone ID: PAT_TA_83699.pep
VPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHXNRPSRRXTWKRNQTLSLRR

SEQ ID NO: 189282 - protein, 69 aa, Triticum aestivum
  unsure (1)..(69): unsure at all Xaa locations
  Clone ID: PAT_TA_83700.pep
MXTXIXKXKKFVSXGVFYAELXDMLTXXLXXDXXSGVEVXVTPMXKVIIIRXTRTQXVLGXKGRRIXEL

SEQ ID NO: 189283 - protein, 188 aa, Triticum aestivum
  unsure (1)..(188): unsure at all Xaa locations
  Clone ID: PAT_TA_83701.pep
PPPATSQGAVFNVVDFGAKGDGVTDDTKAFEGAWAAACKKGACTVLVPPELEFLVGPISFSGPYCKSNIVFQLEGTILAPTSAKSWGSGLLQWLEFTKLNGMVIQXNGIINGRGQQWWTYSDTEDEDDDDTYDVEFERMPQIKPTALRFMEFKLYGLHMSTAQMSKFARDDVMTQTSLRSKRITENQD

SEQ ID NO: 189284 - protein, 192 aa, Triticum aestivum
  unsure (1)..(192): unsure at all Xaa locations
  Clone ID: PAT_TA_83702.pep
KKELIFAVAGILLLFFLLFCCVFIFWRKDKKESSPPKKGAKDVTTKTVGKTGTGAGKGTDTGGDGGGKLVHFDGPLSFTADDLLCATAEILGKSTYGTVYKATMEDGSYVAVKRLREKIPRAEGFEPEVNALGXLRHPTLALKAYYLGPKARTLVFDXCQRNLLFSISXRXQPVTGARINPMVCPGTLNDQM

SEQ ID NO: 189285 - protein, 53 aa, Triticum aestivum
  unsure (1)..(53): unsure at all Xaa locations
  Clone ID: PAT_TA_83703.pep
TSIXXMEHVAXXCISVEKRIDKXPYCYTXAGFXHLXKKNXLXGYKVANASNPK

SEQ ID NO: 189286 - protein, 109 aa, Triticum aestivum
  unsure (1)..(109): unsure at all Xaa locations
  Clone ID: PAT_TA_83704.pep
MFRNNYDNDSVTFSPQGRIFQXEYAAEAVKQGSVVVGIASKTHAVLCAVKRXAXELSSYQXKKLFTVDEHAGIXIAGLTSDARVLXNFMKXEVSXTRLNYGRAFPPILG

SEQ ID NO: 189287 - protein, 75 aa, Triticum aestivum
  unsure (1)..(75): unsure at all Xaa locations
  Clone ID: PAT_TA_83705.pep
LYEVHQIMXRNVQEVLVXEKLDQVSEMSSRLTSDTRIYADKAKDLNRQALIRKYAPVAIVIGVVLMLFWLKNKIW

SEQ ID NO: 189288 - protein, 150 aa, Triticum aestivum
  unsure (1)..(150): unsure at all Xaa locations
  Clone ID: PAT_TA_83706.pep
TSSALTWFFWLLAANPRCERRAHEEAASCCGDGGDVKGMHYLHAAITEAMRLYPPVPFNGRVAVRDDVLPSGAALRAGWYANYSAYAMGRMEKLWGKDCLEFVPERWLSEGGEFVPVDXARFPVFNAGPRVCLRXEMRTSEDVAAACSGG

SEQ ID NO: 189289 - protein, 63 aa, Triticum aestivum
  unsure (1)..(63): unsure at all Xaa locations
  Clone ID: PAT_TA_83707.pep
MEWCASKGNIPYFETSAKEDYNVDNAFLTVAKLALEHERDQDIYFQSVADPVPETEQRSXCAC

SEQ ID NO: 189290 - protein, 152 aa, Triticum aestivum
  unsure (1)..(152): unsure at all Xaa locations
  Clone ID: PAT_TA_83708.pep
GNLGWALMXXENYTXAEGAYRRALLIGPDNNKMCNLGICLMKQGRVLKAKDVLKQVRPAGVDGLRGADSHLKAYERXQEMLRDLETNSSAAPRADQLDTNWLYDALLLGXSXXIWXPQPASTFAATPVRDHPQPWPGARHFIKRPTRTPSEI

SEQ ID NO: 189291 - protein, 39 aa, Triticum aestivum
  Clone ID: PAT_TA_83709.pep
LEEDSFRPVLHHYDGPKFRLELSIAETLSLLDLCEKEGI

SEQ ID NO: 189292 - protein, 39 aa, Triticum aestivum
  Clone ID: PAT_TA_83710.pep
FFFFVEGCLLSGPKMLHQFPNLMNHPEVQEQLFLKEQST

SEQ ID NO: 189293 - protein, 67 aa, Triticum aestivum
  unsure (1)..(67): unsure at all Xaa locations
  Clone ID: PAT_TA_83711.pep
RTXTQTRVMPQLCCWWSYPVNCSXIRLECSGTLAEHPCTGSAWGDASSFFLCFLPLFSPLCFPLVHS

SEQ ID NO: 189294 - protein, 130 aa, Triticum aestivum
  unsure (1)..(130): unsure at all Xaa locations
  Clone ID: PAT_TA_83712.pep
DRVFYQTFGAMPGEQLRKAYACYLSTSSGPVIGTLYLSTARLAFCSDSPLCYQGPAGQPHECMYYKVVLPLSQVTSVNPSSSMRNRAERYIQIKDQWITTILVHGFVNXDKASKISTSPAHRNLPTTLLI

SEQ ID NO: 189295 - protein, 51 aa, Triticum aestivum
  unsure (1)..(51): unsure at all Xaa locations
  Clone ID: PAT_TA_83713.pep
IEHVYMXHFGSIYFCNILQQSNNLLSXAEIPXLRQNFCSHHYILNWXXRIL

SEQ ID NO: 189296 - protein, 102 aa, Triticum aestivum
  unsure (1)..(102): unsure at all Xaa locations
  Clone ID: PAT_TA_83714.pep
MALXXXLGGLLKKAXSSNLSVXQAIRFMSSXLFVGGISYQTXDHXLXDXFAKYGQVIEXXIIIDRESGXSRGLXFVTYXSSEEASAAITALDXKTSMDGHTC

SEQ ID NO: 189297 - protein, 137 aa, Triticum aestivum
  unsure (1)..(137): unsure at all Xaa locations
  Clone ID: PAT_TA_83715.pep
YISGNVSAAPPSCCXQLGKVVQSDPQCLCVALSADXASLGLTVNRTRALGLPDACKVTTPDVSSCKGXAXAAGGAPXXTPAGQTAPATGSKTTPATSSVPGAAXSXPGSAXRLVAGFXVXAGVLSPRDKLASVRLCA

SEQ ID NO: 189298 - protein, 50 aa, Triticum aestivum
  Clone ID: PAT_TA_83716.pep
LKPNSSKHALSGTVKTFKDSKKTRQSAIQTKYDLKTTLTYTKNQKQITPC

SEQ ID NO: 189299 - protein, 99 aa, Triticum aestivum
  Clone ID: PAT_TA_83717.pep
AAIISSIYNVLSSLWTTKLGTRWDMIRATTYTRLLLCKGRDGPTGVVLRLHLGAALHGPTGVHTIQRKAGTDVPQIHHALRATVLKRFPLSTASVPLWC

SEQ ID NO: 189300 - protein, 135 aa, Triticum aestivum
  unsure (1)..(135): unsure at all Xaa locations
  Clone ID: PAT_TA_83718.pep
SAAGAARVTASDDDHMAAKQPVVAAAASGHQNGGKXEADHPAGEGAVHRRAVDAAPEAPHXKLRIRXRPATGPPPTLGSTPGDWLXALKQVIQEALAGAYTRSRCPRRRPFLLNFVALNNGILGSSQLFRLTGVH

SEQ ID NO: 189301 - protein, 135 aa, Triticum aestivum
  unsure (1)..(135): unsure at all Xaa locations
  Clone ID: PAT_TA_83719.pep
RWEFANEEFLRGQRHLLKNIRRRKPPHSSPNQQSLGSYLEVGHFGYEEEIDQLKRDKQXLMAEVVKLRQEHQNTSSVLQAMEEKLQDTXSKKQQQMMAFXARVMQNPDSCVSCLPAGEMRKGLPGSISEXRKRRI

SEQ ID NO: 189302 - protein, 175 aa, Triticum aestivum
  unsure (1)..(175): unsure at all Xaa locations
  Clone ID: PAT_TA_83720.pep
FFFFFFFFFSSKSNQNHMISSTHLSARHLFTLFFPLMFMDPDSQGPQLPLLPRLLYIRANTCKLGMSCCSVFYTDLXSSLTMGGAPXGSMLWXWLLVXXWTCSPGTSPXHPXPQSSLNMGSSRXRPLELMADLXDNADRRILRGGLXASPXECTRXXKREPPDAXEKXPXARARX

SEQ ID NO: 189303 - protein, 162 aa, Triticum aestivum
  unsure (1)..(162): unsure at all Xaa locations
  Clone ID: PAT_TA_83721.pep
VKXYXLRFSQSSSEXXLGXARXWAACLXKQTEXGWTXSXXXGGRKWAXLDSRTXPPGRSIXQAXFDXXGGSSEKSNGVACDGAGSRVGPRQAEEKKKRGEEAXSRPPCAATESRTAAGAAGTSAPAPLEGLVAMGWVSGWEVSRWRNASLGFCGVYFDDEQV

SEQ ID NO: 189304 - protein, 123 aa, Triticum aestivum
  unsure (1)..(123): unsure at all Xaa locations
  Clone ID: PAT_TA_83722.pep
LLAATTEFACCLASTSRLQLHLLLDRIGRARHVDHHPHQRRLPAGRRRCGWPRGQEAGARDGDERRCKTVEVRPPAGHPTRXASPXPLRWCTNSPPKTXRRPSXTKTTNCLLHSLSTRFICCC

SEQ ID NO: 189305 - protein, 122 aa, Triticum aestivum
  unsure (1)..(122): unsure at all Xaa locations
  Clone ID: PAT_TA_83723.pep
SAPVVGWPPVRSFRRNLAHHHHGSSSKQPTEPQNSEASRKEKPACKKNPLVKINMDGIPIGRKVDLAAYDSYEXLSLGRQRXFHGFFXAQKGILQLLGKYSLNVGWGRYTWSYERQRRNRCW

SEQ ID NO: 189306 - protein, 140 aa, Triticum aestivum
  unsure (1)..(140): unsure at all Xaa locations
  Clone ID: PAT_TA_83724.pep
MASETETFAFQAEINQLLSLIINTFYSNKEIFLKGVISNSSDALGQIQVWRVWTDKTKLGCTXRVFIHIVPRQGQQHADNIXTGIGMTNSTLVNNLGYISPSSTKDSMEXXAGAECPMIXIWXSFXSXYLFQKVVLTTNT

SEQ ID NO: 189307 - protein, 177 aa, Triticum aestivum
  unsure (1)..(177): unsure at all Xaa locations
  Clone ID: PAT_TA_83725.pep
EFVKLAELYYAGSHGMDIKGPAKGSRHTKAKGGGVLFQPASQFLPMIEQVHDSLVEKTKCIPGAKVENNKFCVSVHFXRCVDEKSWVTLADMVNPVLKGLPELXLTQGXMVFXAPHHQMGQXKPWILLXSXGYPXCTDXCRVIXDDRXRPFKCPQPGRRGTSQHPRNSLLKTPITSV

SEQ ID NO: 189308 - protein, 136 aa, Triticum aestivum
  unsure (1)..(136): unsure at all Xaa locations
  Clone ID: PAT_TA_83726.pep
PVPTSRDLSLQPXRPARHTAASSSSLLPRFSESLSAAPSPPRYFCCSSTTLPAAILLQARLLSESLLLLLFYFPLPRCFLLLXHXQIQSCCYXSSFAHCPSPSSHSXGXLLSLNSRRAFXLSXSXSLLNSVVMXNV

SEQ ID NO: 189309 - protein, 184 aa, Triticum aestivum
  unsure (1)..(184): unsure at all Xaa locations
  Clone ID: PAT_TA_83727.pep
SACLSTVGLVTSSAPLRSPPLPNGRSLHGSSSWLQGAGDRWKLRQPRPRRQGRLAEXGRARLGVRQEPGRXSAPGLXCRTFIWXRRXPDNYWTPTPKPALXARRRGPQAGPGGPPGPRRGXARSTVWTKVXSXPPXLXNPXXLYXRXLXTXXSPQXRXGNXMKXLXLAGGPAKHELXQRGLKFG

SEQ ID NO: 189310 - protein, 152 aa, Triticum aestivum
  unsure (1)..(152): unsure at all Xaa locations
  Clone ID: PAT_TA_83728.pep
SACSSPSPRPSARPRSSSPHSAAARRLPGFPPSSSPPPTWQDATGVSVLWLHGLGDSRPCQRAHPQLFSAPXSGRQVAFPPSPRPVHATRFVIXLVXIXXFXXRGSPQDERGSXAXXKCXHDNKELXMNQPXKLFXGHSRGXXNTXFSLTKN

SEQ ID NO: 189311 - protein, 73 aa, Triticum aestivum
  Clone ID: PAT_TA_83729.pep
ELVDKKGGPEDMYEFAGEANIVIACMTLTSETIGIVDHKFVSSMKKVHACFCHTGSPCYQICGLISLTPSFWF

SEQ ID NO: 189312 - protein, 75 aa, Triticum aestivum
  unsure (1)..(75): unsure at all Xaa locations
  Clone ID: PAT_TA_83730.pep
RLYLYSLHVHIPYRLNGSARPSPVQKCQLTADCAHSFCTPMGRVLAWEHAVCCTTVTELGQLRVWDTPLHVXKKK

SEQ ID NO: 189313 - protein, 84 aa, Triticum aestivum
  Clone ID: PAT_TA_83731.pep
VCDVTRQAAMKHVDRGLLRQDHHMFALLTSLTAITAPSPRYHYMYPEPSGGSCVNMRWNKCVGISCFLVVHGPCCVRSVKWTWY

SEQ ID NO: 189314 - protein, 128 aa, Triticum aestivum
  unsure (1)..(128): unsure at all Xaa locations
  Clone ID: PAT_TA_83732.pep
TQTGTIPVPSLLLISSXSAVLSFPGFARXSYYQTPXXARCCXPXXPXFSIFLSXTXRRPXXAPHVPLXPSSSAPIXVSLXXCKLTRXMXNAHXPETFGXRKXHLXFHTNXKAXYXCXVNPRTSXIWXX

SEQ ID NO: 189315 - protein, 170 aa, Triticum aestivum
  unsure (1)..(170): unsure at all Xaa locations
  Clone ID: PAT_TA_83733.pep
FELEETEDEKKAREAEEKEYESLAKALKNVLGDKVEKVVVSHKLGTSPCAIRTGQFGWSANMERIMKAQALRDTSMSSYMSSKKTFEISPKSPIVQGAQEEVETDGENDRTVXSIVQLLFETXLLVSGFTLXEPAGSARRXHKXVSSGSNGGSPLLRCTGRRGETEVLMG

SEQ ID NO: 189316 - protein, 137 aa, Triticum aestivum
  unsure (1)..(137): unsure at all Xaa locations
  Clone ID: PAT_TA_83734.pep
KNGAALYRRGGDTAGEEIDGEGSNLPGGGCNDGEFWIDXPSGERGRXVCRGSIDSAELYXHVKPAMGGTCTDVAMWVFCPFNGPXARLKLGPXXLPPGQDRADFXDWGALXFRXKNSTXTHGVXYXQHXGGTGWLRI

SEQ ID NO: 189317 - protein, 139 aa, Triticum aestivum
  unsure (1)..(139): unsure at all Xaa locations
  Clone ID: PAT_TA_83735.pep
MLKGVTPELSCPIVLFTYYNPILKRGVGNFMSTIKQAGIHGLVVPDLPLEETALLRSEAIXMHNIELXVLLTTPTRPTVRMKGNCTXFRXFLLPCDAVRVTGARSKCNLRXVKHLPXGDXKKXTNKPVLXVPVLPTPNI

SEQ ID NO: 189318 - protein, 109 aa, Triticum aestivum
  unsure (1)..(109): unsure at all Xaa locations
  Clone ID: PAT_TA_83736.pep
AFLSNYHTSAAARVVFNGRRYDLPAWSISVLPDCKAAVFNTATVSEPSAPARMSPAGGFSXWQSVQRGHQSLDGRAFTKGRLVXHFNITLDXSDYXXDTTXVDINPNFL

SEQ ID NO: 189319 - protein, 120 aa, Triticum aestivum
  unsure (1)..(120): unsure at all Xaa locations
  Clone ID: PAT_TA_83737.pep
ARARGHVAVVACLRSLVELMRATGRPRVAAAGGAAGRARIVLAHPFRAALQATALRIEDLEEQRGGAVLVEVDGEGALXTANRATSPQPRVMKILPEETTSTLSXRRGIYQHAAXXPRGG

SEQ ID NO: 189320 - protein, 164 aa, Triticum aestivum
  unsure (1)..(164): unsure at all Xaa locations
  Clone ID: PAT_TA_83738.pep
MSAQDYYSGGGGGYGQQQQQGGGYGQQQGYGQQQQGYPQQQQYSQGSNYGSNQPSYDNRDQSYGQHQGGQYGSGPGXYPDGAGGPGGPGGRXPDGERGLGATLSGGGAXGWAAHTVVRLLXXLTNAAAGSIGANSSDTKNTREDKNTPRRRLINGDTTLGQLTK

SEQ ID NO: 189321 - protein, 108 aa, Triticum aestivum
  unsure (1)..(108): unsure at all Xaa locations
  Clone ID: PAT_TA_83739.pep
NENPELISFTSSTPANGVLEQCIHSDVPEAVPIMTCEDLEQTMLAQVSNSSSTQINATKEQLTVMDEPVAMQKVTVDNHASQHLLSLLQKGTDNKGAPSLXFQERTTG

SEQ ID NO: 189322 - protein, 103 aa, Triticum aestivum
  unsure (1)..(103): unsure at all Xaa locations
  Clone ID: PAT_TA_83740.pep
TGHQLYKLVQLLAAPIISISSCNLISIALHCISRGRSMAREMEKAKKAASSPKSSTISTGSQEPGDGMEEDRLPLIRKTLLLPRHXXRKHEQQNFXKEEHFSQ

SEQ ID NO: 189323 - protein, 73 aa, Triticum aestivum
  unsure (1)..(73): unsure at all Xaa locations
  Clone ID: PAT_TA_83741.pep
PIXHISRSTXAPSRGXXRSDGXRRGVXXWXCGLGXQXRVGFLHDXLHXAXXGQDHXGRXAXEXLHXRIKVAER

SEQ ID NO: 189324 - protein, 67 aa, Triticum aestivum
  Clone ID: PAT_TA_83742.pep
MELEVGAPSPARYLVGAAIMMAGVVLPLAYMIFRSKRSPSSASAAGPSSFSKQTLGTKGSSDSGASG

SEQ ID NO: 189325 - protein, 74 aa, Triticum aestivum
  unsure (1)..(74): unsure at all Xaa locations
  Clone ID: PAT_TA_83743.pep
CVPVSLIAARDYNHLKIILGTWESQXQVNNRYRQDEAHGGCCGDSVESPKPSSPSQLWVSGHCLLIMLLFTNFV

SEQ ID NO: 189326 - protein, 157 aa, Triticum aestivum
  unsure (1)..(157): unsure at all Xaa locations
  Clone ID: PAT_TA_83744.pep
DAGPGVARSLLVLEVVAFSSFLFSSLVAQGLKLALNLINSKDPHDAARAHIDARVLRLGMLASAVGSVVGCVFLMTSMVMVVQVRLGTLSCPTDRAAAKAAAGLXGLVTTALAFYVGTSSKLHHDPFQLRLIQTTTLLACKGNSWFRFKKLKETASL

SEQ ID NO: 189327 - protein, 138 aa, Triticum aestivum
  unsure (1)..(138): unsure at all Xaa locations
  Clone ID: PAT_TA_83745.pep
MAPKAEKKPAAKKPAEEEPAAEKATAGKKPKAEKRLPAGKSAGKEXGRXXRGKEEGKESVETYKIYIFKVLKXVHPGHWHLRPRHSIMNPFINDIFQKLXAEAAXLAPYNKEPTFTSANSNSFASPSRGNSGQNLIYS

SEQ ID NO: 189328 - protein, 119 aa, Triticum aestivum
  unsure (1)..(119): unsure at all Xaa locations
  Clone ID: PAT_TA_83746.pep
CREVSFTFSXIXPLVHVDIXKGYSGSWYLXSIQQFKLSGTFNQTFIYCDILSLTTHGITFPLSYCCPTRILCFFSEEIVHPSVNNREKSIHNPMFSFCRLLDVVKKRDHCLILHFSYPE

SEQ ID NO: 189329 - protein, 109 aa, Triticum aestivum
  unsure (1)..(109): unsure at all Xaa locations
  Clone ID: PAT_TA_83747.pep
FXXXLRSAXCCRAAELXVXVDRVXLLLLMXLRXHLXXPXIXLLPKXQXIRISFPPASHCCSDSGSSPRKKNQIFAHATDRRETDKGGEKQMQIGRERKDERGEERERVC

SEQ ID NO: 189330 - protein, 54 aa, Triticum aestivum
  Clone ID: PAT_TA_83748.pep
DYTKQNGDYKRGEQYQWPNTARSDYTNMTQAITARTTTADRRLAPPENNILAST

SEQ ID NO: 189331 - protein, 175 aa, Triticum aestivum
  unsure (1)..(175): unsure at all Xaa locations
  Clone ID: PAT_TA_83749.pep
LPSGMLKVFLGFLLLAVGLSAVGMYMARHAVAAAAPALFRPCLSGSSAGGGTXRGLERWTRPPARVEHAMTDQELLWRASFXPRVRRIPFRAFPKWLHFLTPSPLPLXPLXWEQFFXGHEGRYPSNCTLPSXHPXXLLXSVFYRXQFPIRFKMGQIFDANPTSNLCWNNNGCLCL

SEQ ID NO: 189332 - protein, 75 aa, Triticum aestivum
  Clone ID: PAT_TA_83750.pep
MPSHKTFRIKKKLAKKMRQNRPIPYWIRMRTDNTIRYNAKRRHWRPHQTPVLSGGRNAGLMTLGGIGSARLGTPV

SEQ ID NO: 189333 - protein, 88 aa, Triticum aestivum
  unsure (1)..(88): unsure at all Xaa locations
  Clone ID: PAT_TA_83751.pep
PRXGRGRGRPRPTATTVSPRPPRRRSLGPLPPVATTTAARTERRARTRSSTSSGGRPRPPGASASRTRRKSSRATRDGPGTTGAGERR

SEQ ID NO: 189334 - protein, 162 aa, Triticum aestivum
  unsure (1)..(162): unsure at all Xaa locations
  Clone ID: PAT_TA_83752.pep
AVLAVQLARLVGLKVALVVDNAKHGVRISENPVLRPDLLVDSHDPERAVAVLRANTRGKLRFGIDTRGKDTAEVLLXALGPADLHRNAASVTSPPNTPPADLXVPAHLVGMSGSPXRDINRHDTLQAVHEYRWAKCNRWRGMSTVCTPKNNDLRRLKTEQGR

SEQ ID NO: 189335 - protein, 124 aa, Triticum aestivum
  unsure (1)..(124): unsure at all Xaa locations
  Clone ID: PAT_TA_83753.pep
MXIFXXXLTGXTITLXVXSXDTIXNVXAXIQXKEXIPPDXQRXIFAGKQLVDGRTLADYNIXKESTLHLLLMLRGGIIDPPCMRXLALYNQDXMICPXCYARXHPXAVNCXKKXXGHSNXLXGQ

SEQ ID NO: 189336 - protein, 150 aa, Triticum aestivum
  unsure (1)..(150): unsure at all Xaa locations
  Clone ID: PAT_TA_83754.pep
MAPPLLLFFLLLPLLTXLADGHXHLSSYGSSALSDWRPAXASYYAADPEDXIXGACGFGDLGKHXYXMATVXGLSXALFERXAECCGCYXVKXXKTXICSPXTPXSSRNQLRRPXYXXADXGGXXTPQHNSLXSIFEKXARADMSYASLK

SEQ ID NO: 189337 - protein, 122 aa, Triticum aestivum
  Clone ID: PAT_TA_83755.pep
LREELKISISENVIPAYRAFTGRYGSLVDSGRNSGKYIKYTPEDLENHLSDLFEGSLGSANHSKEKMTILMDGDLGYRYAFGYEGHHIHPNSISECCLNCPYPQCYFKNTPLCFANPIYVLY

SEQ ID NO: 189338 - protein, 39 aa, Triticum aestivum
  Clone ID: PAT_TA_83756.pep
LAHLVAAKWPGAGTGGSGDPLEDYCKTDPNAVECKVFDE

SEQ ID NO: 189339 - protein, 90 aa, Triticum aestivum
  unsure (1)..(90): unsure at all Xaa locations
  Clone ID: PAT_TA_83757.pep
SPSGRHTNNNPQSLHPPXDSLLFSTINKRVEKKIQAIMWTASPXPXPXXISSFVRSSFGVVEINRSFLRLLAARESRSLTEEPGHLARRL

SEQ ID NO: 189340 - protein, 64 aa, Triticum aestivum
  Clone ID: PAT_TA_83758.pep
RRCSPRPTIPVDRAVIMRRPCHPFFLFSFCVCNYLRGVMDFGSFSFLCGVELTLSGFFCFAFCE

SEQ ID NO: 189341 - protein, 77 aa, Triticum aestivum
  unsure (1)..(77): unsure at all Xaa locations
  Clone ID: PAT_TA_83759.pep
HLXNISCXSLLXDCLXIXQQGEXLSKXQXHVEQLVSFFLXLDQIXVCKGELWPLGXLAXPXVEXXLXXIXFXVKSQF

SEQ ID NO: 189342 - protein, 159 aa, Triticum aestivum
  unsure (1)..(159): unsure at all Xaa locations
  Clone ID: PAT_TA_83760.pep
DFCSLPIPPRLGGFGGXVILPLAHTFDPEEFLEVIKVXNAGNYQDALLHRDLFLLQMYNGVDENMAGTCSELIFAPIDASFNDDSPLLPSGLSYHPDXPPLDTXNPKCTLDLASXLXSGNSXQAGTXRXRXPWNXXPLLPGSKAXXPXFQFAFKTSAGS

SEQ ID NO: 189343 - protein, 161 aa, Triticum aestivum
  unsure (1)..(161): unsure at all Xaa locations
  Clone ID: PAT_TA_83761.pep
DLKRGYVASNSKDDPAKEAASFTSQVIIMNHPGQIGNGYAPVLDCHTSHIAVKFAELXTKIDRRSGKELGEGPKFSKNGDAGXVKMVPTNPWGVXNFSXYPPPWSICCPXDMKQXVAVXXXXKSXXEEDPTGTKVTKXLPKKKTVRVLCLLLGTPWNLTLC

SEQ ID NO: 189344 - protein, 89 aa, Triticum aestivum
  unsure (1)..(89): unsure at all Xaa locations
  Clone ID: PAT_TA_83762.pep
CTPQILPCSAMRLSCQRTCPISMELYFFLFNTPCATQICLKSXXKKTPKGGAXYXFXLKXPISRSXRXFKLLXXNLGYHLPLENPFXXG

SEQ ID NO: 189345 - protein, 136 aa, Triticum aestivum
  unsure (1)..(136): unsure at all Xaa locations
  Clone ID: PAT_TA_83763.pep
MLRMGRASATAGVLRFVRAFALCVATACLLLAAGMPSPVAAQDPSXLSLQYYSKTFPNVEXLVRTEMEFAVRARHAQRRAHVRLHFHDCFXQGCDGPCCSDDTXPXFGEKQAEQNLXSXERFILVDKFKENLNPXP

SEQ ID NO: 189346 - protein, 91 aa, Triticum aestivum
  Clone ID: PAT_TA_83764.pep
RHSYGSCRVVIFIGHASRGTYYKEHDLITSQFIIHHNSGHITSHDQSLQKQVRRLLIVVASFTWLQLGSSKNVFLPTNHHNVILSTSIYPS

SEQ ID NO: 189347 - protein, 60 aa, Triticum aestivum
  Clone ID: PAT_TA_83765.pep
SCSVRHVLLPVNTSDRHRRCWVATLLLSSSCHGSPMKQLHGSIDGPRRRSIAAPVKLQRP

SEQ ID NO: 189348 - protein, 106 aa, Triticum aestivum
  Clone ID: PAT_TA_83766.pep
VTARNEQVDLLKPDTTVIFRNAKIDMFKGTMRLVVDKWGRIEVTQPADFKVNQDNNMSLVEYDWVDVGRKRSDQETNGCGIYLVMEAVALVPIYYCPGPLAIGTLF

SEQ ID NO: 189349 - protein, 142 aa, Triticum aestivum
  unsure (1)..(142): unsure at all Xaa locations
  Clone ID: PAT_TA_83767.pep
GQCAIIMFDVTSRLTYKNVPTWHRDLCRVCENIPIVLCGNKVDVKNRQVKAKQVTFHRKKNLQYYEXSAKSNYNFXEPFLYLSKELXGDSNITSSXAVAXXPXEVTFDLACNNTRADXXLQRTPLPDDDTFDSIKKVMILSV

SEQ ID NO: 189350 - protein, 148 aa, Triticum aestivum
  unsure (1)..(148): unsure at all Xaa locations
  Clone ID: PAT_TA_83768.pep
RSCGHPVPAALRSACVLLPVPREAVLDTRCLRRAHPPGCGSVGSRAPAAFASVPPSAYGRRHRGHLAGAFGSGCWSTLKGRRRLWRHAPKNRSARTNERPPRXTLRAXSRAGRLXRLLLVDSAIIXSFSKITIISIXHXTVNCNVNYH

SEQ ID NO: 189351 - protein, 64 aa, Triticum aestivum
  unsure (1)..(64): unsure at all Xaa locations
  Clone ID: PAT_TA_83769.pep
PRXVSAASPLPQCRRLNCVQTTQVMSVRSSSAHINDMRLSRWLLRRHPSVPCRPPLLYKMLRRP

SEQ ID NO: 189352 - protein, 125 aa, Triticum aestivum
  unsure (1)..(125): unsure at all Xaa locations
  Clone ID: PAT_TA_83770.pep
LSSASPVPSRPRRPTEDDLTRSWEYSFASVLPLAPTVTAASSTHHSRLPSREIAGGGARSWRKRTGSRWGPRDPRVRSSVPRNFKLLEELERGEKGLVMDCDYGWMMLMTYMRPWTRLHWPPQYX

SEQ ID NO: 189353 - protein, 136 aa, Triticum aestivum
  unsure (1)..(136): unsure at all Xaa locations
  Clone ID: PAT_TA_83771.pep
KNKPKPPIIVTRDSPNALHSHVLEVAAGADVVDCVAEYARRRGRGVCVLSGGGAVVNVALRQPGASPPGSMVATLRGRFEILSLTGTVLPPPAPPGASGXTVFLSGGQGQSSAGALVGPLVAAXPSPDGASRTRVR

SEQ ID NO: 189354 - protein, 58 aa, Triticum aestivum
  Clone ID: PAT_TA_83772.pep
SSASPSRPRNHLHAPPATSSTIVILCVFSVMCCVLENFSKSYSVINFNLINSVAQKKK

SEQ ID NO: 189355 - protein, 173 aa, Triticum aestivum
  unsure (1)..(173): unsure at all Xaa locations
  Clone ID: PAT_TA_83773.pep
AQRTSSPRQAPKSTNSSPLSDLDAHRCGRCRRRLMVCCGHGCAGQRAFAAAAAKGAGRWTTPRSRRSAPKGYLFNRARRLPGGTRKXGRFGECPATLLLPSPSSSLRVXLXREPDLTIRDVGHXKPPTPPNSKXPRCRTKRLFGSQASXSXSXIXPINAHXGLNXDXYDDTLT

SEQ ID NO: 189356 - protein, 50 aa, Triticum aestivum
  Clone ID: PAT_TA_83774.pep
PVGYGIKKLQIMMTIVDDLVSVDTLIEDYLCAEPVNEYVQSCDIVAFNKI

SEQ ID NO: 189357 - protein, 90 aa, Triticum aestivum
  unsure (1)..(90): unsure at all Xaa locations
  Clone ID: PAT_TA_83775.pep
ATHGHGRKAILPXMAQPLNLDGDLDACXPLLLVFHPLMNPHSPMQXTTXMLFHVISXFGIILXYXPKSRFHFSFAYXVFLVTXXFHKITX

SEQ ID NO: 189358 - protein, 105 aa, Triticum aestivum
  unsure (1)..(105): unsure at all Xaa locations
  Clone ID: PAT_TA_83776.pep
PKPEPKPEPKPEPKPEPKPEPKPEPRPEPEPKPEPKPEPKPKPEPEPQPKPEPKPDPKPEPKPEPKPEPQPKPEPKPEPKPQXPEPKPEPKPKPDPPHIPPAAIN

SEQ ID NO: 189359 - protein, 166 aa, Triticum aestivum
  unsure (1)..(166): unsure at all Xaa locations
  Clone ID: PAT_TA_83777.pep
NNDDRGDVXEIDTWVASSGKNGMRRDWIIRDRNTKNMIARATSNWVMMNRETRRLSKIPDEVRQEVLPFYLDRSIIAAATGGGRKIEKLTDXXVDHIRSXLXPTWSDMDVNHHVNNVKYIGWIXXSVPLXLLDDTEHRHRGSASVLSVLTSELSPGPSTLFQTRNR

SEQ ID NO: 189360 - protein, 62 aa, Triticum aestivum
  Clone ID: PAT_TA_83778.pep
SVKVKLSTALACRGATMFWTPHSGSAGHGEASEKEHGEVRHGKEHAVASSGEVRILYLGYMV

SEQ ID NO: 189361 - protein, 102 aa, Triticum aestivum
  Clone ID: PAT_TA_83779.pep
MRGEGKAEAVVEAWKSMNHSFQLGEWRVSSEEVRRLPMLVLWSGSWSDMWIDEGKKVAAALPDAKFIYHSGGRWPQVDAFEEISGVITEFVTSAEEAGSSKW

SEQ ID NO: 189362 - protein, 158 aa, Triticum aestivum
  unsure (1)..(158): unsure at all Xaa locations
  Clone ID: PAT_TA_83780.pep
MGGVRSYFFIIAAAVVAVVLALLPAGATGAGLKVGFYSKTCPSAESLVQQAVAAAFKNNSGIAAGLIRLHFHDCFVRGCDGSVLIDSTANNTAEKDAVPNNPSLRGFXVIDAAKXGVXAPCPKTCLRRIWRXRRGTHXLAGTTXLQVXPGXPRGVKDR

SEQ ID NO: 189363 - protein, 60 aa, Triticum aestivum
  unsure (1)..(60): unsure at all Xaa locations
  Clone ID: PAT_TA_83781.pep
FVXFFETFCTIYIYNTGCINTVKSVYIFPHDCHNFEGHNGGGYQEKLLCYTTQDRMQEPR

SEQ ID NO: 189364 - protein, 199 aa, Triticum aestivum
  unsure (1)..(199): unsure at all Xaa locations
  Clone ID: PAT_TA_83782.pep
KGGDTLSHDESKPRRSSSTAAQTSPKRSPRHEQPLSYNRLHTEERAIRRAGYNYQVASKINTQEIIRRFEEKLAQLMEEREIKLMRKDMVPKAQLMPAFDKPFHPQRSTXPLTVPKEPSFLRLKCCIRGEFHRHFCYNGANNKASSRIIHIHASESITHVLPNYTGTSQCRHTVTSFPRVQLQIRYQHPACLQFLQKYL

SEQ ID NO: 189365 - protein, 88 aa, Triticum aestivum
  Clone ID: PAT_TA_83783.pep
SFLRSKPPKNNRQEEKKNAMYLHPTPTKENKTSNGNKESNTNPTIANYYLAVSICPPPIPLLLFFTSPGSSWLPACLCSMYNTLLSCF

SEQ ID NO: 189366 - protein, 102 aa, Triticum aestivum
  unsure (1)..(102): unsure at all Xaa locations
  Clone ID: PAT_TA_83784.pep
TPRRFSPPGRPTPRDGPPRRLRTGAPPTPLLTPPPDGSLVIPAPRHAAGRELRQPATALSPQATLPRRPPDASSCSLTVSLLPPLYSSVCFSVNIXVNICMG

SEQ ID NO: 189367 - protein, 129 aa, Triticum aestivum
  unsure (1)..(129): unsure at all Xaa locations
  Clone ID: PAT_TA_83785.pep
RPEFXCVAPGEALSXNWETRSWPSCPVLFPPGGVDEARPGGVVELLSPDHVARSEAADHGGVGIRRARVSGRRGVLAGAAAAALGWRQGLGRVVEVDALGHGGGGRVRVWGWGWNRSEWNVGEDGREGK

SEQ ID NO: 189368 - protein, 163 aa, Triticum aestivum
  unsure (1)..(163): unsure at all Xaa locations
  Clone ID: PAT_TA_83786.pep
LHQXLGGAVGSCQRLQYAYDEVSTRASHLEILXRSQMEQIDQLEQXNTETVEKHRLLEEEKLSANKENIKLQKHVQDLEVQLQLARXQKLKVTEAESKCKEERYEASVEALRAEICHLEQLVXQFSXGRVSLLEGTLMQVKGHAESVCKWADNWMNIIRLCSH

SEQ ID NO: 189369 - protein, 130 aa, Triticum aestivum
  unsure (1)..(130): unsure at all Xaa locations
  Clone ID: PAT_TA_83787.pep
ITTDGFNPYGLMAAIYSCWPVYVIPLNLPPGVCMQRHHMFLTLIIPGPNYPGKHMSVYMEPLVDDLFVAWKNGVRTYDAVSKKHFNMHIWYHTSLHDLPAXAYLWXWCVKGXLALPNVLTSFGWQRVKRP

SEQ ID NO: 189370 - protein, 86 aa, Triticum aestivum
  unsure (1)..(86): unsure at all Xaa locations
  Clone ID: PAT_TA_83788.pep
VGLWLSRSDPIGWVLAPPLRGLISVPRLLGSXGRGRRRRRLDLRWRATRTTRXSACAXARARSKPGTARAPSKFIQGKRLDPRCHR

SEQ ID NO: 189371 - protein, 43 aa, Triticum aestivum
  Clone ID: PAT_TA_83789.pep
CFSCRNLVSLSDIEPIKFRSFFVFAMRLARHEDAHISLWAVTM

SEQ ID NO: 189372 - protein, 87 aa, Triticum aestivum
  Clone ID: PAT_TA_83790.pep
MGRDGGGGVAGGMSDSVLRKVLLSYFYVAVWIFLSFSVIVYNKYILDPKMYNWPFPISLTMVHMGFCSSLAVALVRVSASSTPKSPQ

SEQ ID NO: 189373 - protein, 77 aa, Triticum aestivum
  unsure (1)..(77): unsure at all Xaa locations
  Clone ID: PAT_TA_83791.pep
PVXXLRSQKXNGXNFPKQNHXPNGKQHICHSLKKPIPLVLXANXLKXTVYNXXILXXIRRQPWXGXTWAHXXHXLKP

SEQ ID NO: 189374 - protein, 98 aa, Triticum aestivum
  unsure (1)..(98): unsure at all Xaa locations
  Clone ID: PAT_TA_83792.pep
FLHFKSSIFLLSIIQAKVEQLFTVQNLSYRCALSFSSIRVVGKAPLDGKIYHHPLATHENLGVGHDIAMHATHESSNYYAGFTVTXLIWMNSTWATTY

SEQ ID NO: 189375 - protein, 117 aa, Triticum aestivum
  unsure (1)..(117): unsure at all Xaa locations
  Clone ID: PAT_TA_83793.pep
VTGGCNPVSVVSEFDGFPLVHPVIGTGTPGEGPSYXXHPPIGSFSRMPHIXXXFPVXGMXTFTIASAXHRLSXQTSPVHFXRXVTKWFTKEGVLVEGLFWKDVEKLIDDYNSERKSK

SEQ ID NO: 189376 - protein, 134 aa, Triticum aestivum
  Clone ID: PAT_TA_83794.pep
MARVAAVLVALLALFAVAATAQAPAASPKRAPAPAPPKMAPLPPPPTRAPMASPPSPPTMSPASAPSADAPATSPAGAGFGDRWPGGSLRSDPGAAPVTEKTHRICSAITCRHRRCGTAAVVFNPEWFEDCNCT

SEQ ID NO: 189377 - protein, 125 aa, Triticum aestivum
  unsure (1)..(125): unsure at all Xaa locations
  Clone ID: PAT_TA_83795.pep
MKTILASETMDIPEGVTVTVAAKLVTVEGPRGKLTRNFKHLNLDFQLQEAGRKLKVDAWFGTRRTMAAIRTAISHVQNLIKGVTXGYRYKMXFVYPTSHQRSITNNNTAIEIRTPPGEEKWHLYG

SEQ ID NO: 189378 - protein, 119 aa, Triticum aestivum
  unsure (1)..(119): unsure at all Xaa locations
  Clone ID: PAT_TA_83796.pep
XXTPGGGSEVTQLXFAXXFKHXPGGXNXTPWNXHXGNPFXLAPPXNXGSEGXAXTFRHLXGXXKVPGAFPXTXREKGLRGFGAXDXCSPGFPVXIXGFEFXLRTVRXELFKGAGLXHXA

SEQ ID NO: 189379 - protein, 63 aa, Triticum aestivum
  Clone ID: PAT_TA_83797.pep
RKNKIWARFTVEANRNVTRMEIFLSLMRMLEPSCGAGENSNNNIKMPLGIVQYPIIPATGHLR

SEQ ID NO: 189380 - protein, 99 aa, Triticum aestivum
  unsure (1)..(99): unsure at all Xaa locations
  Clone ID: PAT_TA_83798.pep
PALPEETPQELVFIVQSCWVEDPAMRPSFSQIIRMLETFIMTIHPPPLSEPNEGEESEETRSSLSSRSSSGSSLVSRATSKLSVVRHLFVSKKTXNGXA

SEQ ID NO: 189381 - protein, 88 aa, Triticum aestivum
  unsure (1)..(88): unsure at all Xaa locations
  Clone ID: PAT_TA_83799.pep
MSTQNKRLKDVEVSFPIVYGTISFWLGKKASEYNSHKWTVYVRSANNEDLSVIVKARGVSTSTRFPRTPTRFLEQTAFQLSXSGWGXX

SEQ ID NO: 189382 - protein, 119 aa, Triticum aestivum
  unsure (1)..(119): unsure at all Xaa locations
  Clone ID: PAT_TA_83800.pep
MDPDSVSKAFVQHYYHTFDSNRAALVGLYQDGSMLTFEGEKFGGPAAIAGKLGXLPFXNCQHKXXTVXCNPPGPKAGSXLVSGNITTGPGEQPSSFKNVQXXATGGNFNFKXKXRLNYG

SEQ ID NO: 189383 - protein, 132 aa, Triticum aestivum
  unsure (1)..(132): unsure at all Xaa locations
  Clone ID: PAT_TA_83801.pep
MLSLSRAIGRRLFSSAEAASTAAVRTAQNPLEEFFEVERSTEEGKPPPHYGRSWXKASELRLKSWXDDLQEIVGMFLLKEKNMLMTQRQMLHLXDMRSPXPERXSKVKXMCPDXHFXTEKAIPAPFESGMNR

SEQ ID NO: 189384 - protein, 190 aa, Triticum aestivum
  unsure (1)..(190): unsure at all Xaa locations
  Clone ID: PAT_TA_83802.pep
SCRAGVGSAIAYGQLTNGGALDPAGLVAIAIAHALALFVGVSVAANISGGHLNPAVTFGLAVGGHITILTGVFYWVAQLLGATVACLLLGFVTNGKASRPRRRGHXQLEGXVXXSHHFALSHRVANAADPRRLARNIAPIXIGLXXXPNLAXGPXXGVNNPPSLARRAGNSRKWVTGRPSSGPALKGLWG

SEQ ID NO: 189385 - protein, 142 aa, Triticum aestivum
  unsure (1)..(142): unsure at all Xaa locations
  Clone ID: PAT_TA_83803.pep
RXFDTYVXSLFDXNQXPGPVXXRNFXIFNTDLTPKYDLXLXRQGPHSGSXXXSPXPSPSVRRXQVGCMXQXGAXATXLXQNNINYXCXYXDCTPIQELXXFLDPXHIHSXLSVRSTSIKNASRYDTRPPAATPMTQFSGILP

SEQ ID NO: 189386 - protein, 108 aa, Triticum aestivum
  unsure (1)..(108): unsure at all Xaa locations
  Clone ID: PAT_TA_83804.pep
XXPPCRSSTXHXHARXRSHPLPPPPPPKPRPNLASSANLLLGSXXXGIWHRRTXWXTSRAXPXSPPSXNLAXEAKXFXRXSSSQPXYXHHLXXLRXXRCYKQXSPTAV

SEQ ID NO: 189387 - protein, 95 aa, Triticum aestivum
  Clone ID: PAT_TA_83805.pep
SELFVPSCKRQGGREVCVLRSSIDPDKPAPSYNTSNCWFSCISALQPYYLYHPFCVAMAGLSLGTSLGVPPSAPKQRHSFMTFLPPIPTSTASTR

SEQ ID NO: 189388 - protein, 82 aa, Triticum aestivum
  unsure (1)..(82): unsure at all Xaa locations
  Clone ID: PAT_TA_83806.pep
ATRNLNAMNKLSTKKPWSLSFSFGRALQASTLKAWAGKVENLEKAXAAFLARCKANSEATLGTYKGDAAADTEXLHVKDYKY

SEQ ID NO: 189389 - protein, 83 aa, Triticum aestivum
  Clone ID: PAT_TA_83807.pep
DVSLLKRVVDERLSLSKLQPSAMSSLSSSLHSSHHKSWTSSDRTTEANGSLDKHTLAEPASPARKDLNGDECTVQVSDGNDTG

SEQ ID NO: 189390 - protein, 152 aa, Triticum aestivum
  unsure (1)..(152): unsure at all Xaa locations
  Clone ID: PAT_TA_83808.pep
TXEPXGSDLDPXCXXLNLWPHFPGHKSGGCXGTGGPVGAPPAATLLATVVTHGTGCSTLRCYCGRRSRQWRAAVFIRSWPKRCADSITGTSRLGSSAVLVAADGDTAEGAERRPGSEGPLEPVADARWLVGGRDRRGRRLLACCLHLHHAQN

SEQ ID NO: 189391 - protein, 110 aa, Triticum aestivum
  unsure (1)..(110): unsure at all Xaa locations
  Clone ID: PAT_TA_83809.pep
MKIQCDACEGAAATVVCCADEAALCARCDVEXHAANKLASKHQXRLPLXALSAKLPRCDSAKEKAGSSSAWKDRALXCQDCDEPSXFPGKLSGNXQRYLATDRVGSLGFA

SEQ ID NO: 189392 - protein, 148 aa, Triticum aestivum
  unsure (1)..(148): unsure at all Xaa locations
  Clone ID: PAT_TA_83810.pep
GKLNAVTDLGLVGDVFRDPARLAKLPGNAAIGHVRYSTAGASSRRNVQPFLAAYRFGQLAVAHNXNLVNYQALRKQTRXAKGSIFNTXFGHXVILXLISXSXLSRPLLXRXXXAXKRLPXAXSLFXMXAXXFCXXXSXGFGXLXLXXN

SEQ ID NO: 189393 - protein, 122 aa, Triticum aestivum
  unsure (1)..(122): unsure at all Xaa locations
  Clone ID: PAT_TA_83811.pep
KISHEKEVIAAADEVVGSIDKEELAKYLSLNSDPEDEEAQKFKKKIEETRDQLADALYQKCLALAEIESLKSDESIEVSAKDIFEENYXELIKWVDVKSAKYGTSTVLREKRCGRPGTALKI

SEQ ID NO: 189394 - protein, 105 aa, Triticum aestivum
  unsure (1)..(105): unsure at all Xaa locations
  Clone ID: PAT_TA_83812.pep
SEPERXSPRRRSXRTPPPPPRPTQTQTPSRSSAGPSXRXSPRHAPRRCPPXXMPRLLRPGRRRRRAGRARRWTAGTSTAERGAYWWGRQQGLLGWFLRTPVLRPA

SEQ ID NO: 189395 - protein, 165 aa, Triticum aestivum
  unsure (1)..(165): unsure at all Xaa locations
  Clone ID: PAT_TA_83813.pep
SQVIIMNHPGQIGNGYAPVLDCHTSHIAVKFAELITKIDRRSGKELEKEPKFLKNGDAGMVKMIPTXPXVVEXFSAYLPLGRLLSRXDMRQTVAVGIIKSVGEEDPTGAQGDQRRLPKKNDAIAPAFTIPIFHHILFGDSCNLTLNLHVHFNHLLGLLFTFAIIL

SEQ ID NO: 189396 - protein, 126 aa, Triticum aestivum
  unsure (1)..(126): unsure at all Xaa locations
  Clone ID: PAT_TA_83814.pep
FTRALPEVSNLRKLYASKEGTGRIKVLVLNESSMPMELGGKKINTTRRICSSDKRSMILLPSKGTQDQDDLPTTRPQAGNAKDXFQEEIDAFXRXPKALGNWVPTPTQXYFHQFDYNPKIPIXMMW

SEQ ID NO: 189397 - protein, 62 aa, Triticum aestivum
  Clone ID: PAT_TA_83815.pep
DREKEELVLFGRNSDWLRGGGFGFFLVEVDDILGAGCQFAGLVAVYNSLISARKDWGFWSCC

SEQ ID NO: 189398 - protein, 80 aa, Triticum aestivum
  unsure (1)..(80): unsure at all Xaa locations
  Clone ID: PAT_TA_83816.pep
PPCRPRRGGSPPPPPCRRSRPPRPRSCLRRPTRSPARSSPHPLPVPXWAAPAPPLFTGRPLNPNPPATVLPCPXGSSTPP

SEQ ID NO: 189399 - protein, 123 aa, Triticum aestivum
  unsure (1)..(123): unsure at all Xaa locations
  Clone ID: PAT_TA_83817.pep
EPEWWKFGDSKTYFRHAXGSLFILXKNLAXRYININSASLQSXSHDDISXXQWMMGTECNLTXDDDXXACSFQTKRNPFQCLPEALLLAVAVHPDEILHTFHFVLLPNPEKLLPKLPPILGLP

SEQ ID NO: 189400 - protein, 201 aa, Triticum aestivum
  unsure (1)..(201): unsure at all Xaa locations
  Clone ID: PAT_TA_83818.pep
PWRIXXLFLRXVXNYALTILDQXLXXIPYYPFLXSLGSRKKYHXLXXPLVTCXXXAXXFXSASIXAICERSPFXXGXDXRVTSXXKXDAWEEILNWEAVKLEMDEVWKSAASGVSKAPRPAXGGEANLGFKATRRAGGSRRRAPEERSVRRRSERPPRRDGSRWAAATAAAVVGRGEWLTRRDRGGRGWRNQGRQVVSCSW

SEQ ID NO: 189401 - protein, 211 aa, Triticum aestivum
  unsure (1)..(211): unsure at all Xaa locations
  Clone ID: PAT_TA_83819.pep
QLKPCAKLSLSCHQSSWLPLRQVCWYSSLLPSPLRRTPRTTRSATPSGWSSGVGLRHLGRAARPSLLGDNLMFQLQRRCTRWWRLXPXDYGACSGNNPSNPYSDQTQDCAQXAPDAQFICGTPANCGKDNSXYVPAERNNNXGYPARGNPSKKQXSVXPKGXXLXAKTTHSXNGSSXXAVHGXCWPGPRSXRLKRFXLNFREVLPFNNTXG

SEQ ID NO: 189402 - protein, 94 aa, Triticum aestivum
  Clone ID: PAT_TA_83820.pep
DGEPAKPAAAPAAKPAPAEKPAPAAADVAKQIPAGIPGSRANNYYPCRWPRTRATSLTDRPFKPKVMLLPGGGPPLGYLFRKLMFNDAALMNER

SEQ ID NO: 189403 - protein, 157 aa, Triticum aestivum
  unsure (1)..(157): unsure at all Xaa locations
  Clone ID: PAT_TA_83821.pep
RSESSVFPFHRLEKGEKPRSEGTAARVLAAAAIPSPYRSPRSLTRIEPSLGFRIVLPPTPIPPPSLRRARAGSYQTLXRQIRCDFPXWSLLXPPXRTAPXSGSRVXVXCXAPLGWXGPVDGIGNQRSQLXKGLRNISXKXTLXRLXXXGKLVXQHVL

SEQ ID NO: 189404 - protein, 109 aa, Triticum aestivum
  unsure (1)..(109): unsure at all Xaa locations
  Clone ID: PAT_TA_83822.pep
MAMIDEPLYPIAVLIDELKNEDIQLRLNSIRRLSTIARAXLGEERTMXELIPFXLSENNDDEDXVLXAMAEELGVFHSLIWVVXEHVXFCSQPLEXXFSXXGTXXRXXH

SEQ ID NO: 189405 - protein, 68 aa, Triticum aestivum
  unsure (1)..(68): unsure at all Xaa locations
  Clone ID: PAT_TA_83823.pep
LLXNLXLXMCFXWKIKXXWMXXFVVXXXSXMASTVXDPINFPANLGVPDVLXLGLTWRYSQKEPLTGT

SEQ ID NO: 189406 - protein, 97 aa, Triticum aestivum
  unsure (1)..(97): unsure at all Xaa locations
  Clone ID: PAT_TA_83824.pep
CNGADSQDVHYTPHEGRAQGEGAQETGRCTKYNLELRTYSQAPKSNILHLHIAPEHVQVSFIIACXKIIAQKRAPIHVAVCLIGMXNFVXMLISFPG

SEQ ID NO: 189407 - protein, 90 aa, Triticum aestivum
  unsure (1)..(90): unsure at all Xaa locations
  Clone ID: PAT_TA_83825.pep
KCWVWRAPXDTVNHGKXKXWWEKRNNFISCLXTAYDIPTLESVWNPILFLGWENIPPPXFYPXFLLXLXXHLQSLLPPXKXSFTWSFYSI

SEQ ID NO: 189408 - protein, 94 aa, Triticum aestivum
  unsure (1)..(94): unsure at all Xaa locations
  Clone ID: PAT_TA_83826.pep
WXXPXPAYXXRRXPDXXXEXEXXKREHMXRTSETEMRXIIXANPRXRXSXGRRXTGTTXRGQPITPXXSAPHYQXXPASXISXSLLSQPLLPLA

SEQ ID NO: 189409 - protein, 84 aa, Triticum aestivum
  unsure (1)..(84): unsure at all Xaa locations
  Clone ID: PAT_TA_83827.pep
QHPHAPAPPSPTPRPVPRIIDTTPFPTTFVQADTASFKQVVXRLNRLRHAGRRPTSPXKSTPTTTAAGQRTRLQTTTPVRATSK

SEQ ID NO: 189410 - protein, 142 aa, Triticum aestivum
  unsure (1)..(142): unsure at all Xaa locations
  Clone ID: PAT_TA_83828.pep
DQSPGTRASIPIVQVDPSFEGLDGGAGSLVKWNPVANVDGKDIWTFLRTMDVPVNTLHAQGLRVHRGASRAPRPSCPGQHEREAVXGWERTPKXKECGLQXGXTXDKDAQAAAPKSAQRNGPXGRXXIFXTPPLVPSTRTGI

SEQ ID NO: 189411 - protein, 87 aa, Triticum aestivum
  unsure (1)..(87): unsure at all Xaa locations
  Clone ID: PAT_TA_83829.pep
VRPLKDLIEFPRFFSYSLEHRIEPRHKVLVANRINMKLRYMLPXSDEEFAQEGARGRXRGERDSEAGVDYSGRHVRPETPKRQWKWR

SEQ ID NO: 189412 - protein, 113 aa, Triticum aestivum
  unsure (1)..(113): unsure at all Xaa locations
  Clone ID: PAT_TA_83830.pep
CTGXTXSXPXHTXAXFXPVAIPXDVGLGHXEXKSSTPMHSPTLYRXRNAPPAGXRXITTAAPQMGQVAGGHAAPPHAGADSAAVETARSARTAAARSRRAMAYVLNATEGRRP

SEQ ID NO: 189413 - protein, 60 aa, Triticum aestivum
  unsure (1)..(60): unsure at all Xaa locations
  Clone ID: PAT_TA_83831.pep
DESPVQICSLAQRFPELKTLRSCDLSPASWISVAWYPIYRIPXTGPTLRDLDACFLTYIP

SEQ ID NO: 189414 - protein, 65 aa, Triticum aestivum
  unsure (1)..(65): unsure at all Xaa locations
  Clone ID: PAT_TA_83832.pep
WSSWRESVILSCCYLCVCPYISILLSYLIKIRPRYIHXLPTXNPRXEGXLFSTCFTTSMGWFGFV

SEQ ID NO: 189415 - protein, 181 aa, Triticum aestivum
  unsure (1)..(181): unsure at all Xaa locations
  Clone ID: PAT_TA_83833.pep
CGXXFRXTYXPPFXWVFXMVXPXLXMGHLAGSRLSPXLGXCRYRRXRLVXRSWVXLGXSGTWGKFPLRFXXGTXKVGVIXLWGCIGVEYAIRGHPDLLEGWXFMGXXSIMRXGSRTSPLFWXRGEYRCCWVCLVFLXFXKTXSFPXTFTFXVXKGYHPCQXPLLEVWGCRQESYACPSSMV

SEQ ID NO: 189416 - protein, 101 aa, Triticum aestivum
  unsure (1)..(101): unsure at all Xaa locations
  Clone ID: PAT_TA_83834.pep
MTNGFLFREYIGAQFTGVQFSDVPINSKLAFNFILAFAIXDYTPVNQHPTPAPTNGVSTLSGDXGNLSPGXVAAXKXAHPNVAVXMAGSGGDSVQGIVKPS

SEQ ID NO: 189417 - protein, 122 aa, Triticum aestivum
  unsure (1)..(122): unsure at all Xaa locations
  Clone ID: PAT_TA_83835.pep
XRQKPVHTXSLFVXRDIHXDAVVWGKISMIDAXKMLLANXLXDADNQFFVLLSXDSCVPXQSFXYVVXYLDGEQTSISIDCFQXPWSTIGNGRIPLGNLPXNSXEKXSKXGAQWFAIXPRKL

SEQ ID NO: 189418 - protein, 128 aa, Triticum aestivum
  unsure (1)..(128): unsure at all Xaa locations
  Clone ID: PAT_TA_83836.pep
XSLXWIVIXXTHSSRRNLGGVQRSRRQGTQRXXXGGPVXGRRVPRRGRVKDPRRXXXXDPRGGERCRXSGLGGSXKIXXCXRRRXXARKAPGEAXRXLMSMGNPGYLELEPAREQRQPTDDGAGHCGL

SEQ ID NO: 189419 - protein, 63 aa, Triticum aestivum
  Clone ID: PAT_TA_83837.pep
MGLLDSLYRVVMRRNAVYVTFVVAGAFAGERVVDYGVHKIWEMNNLGKRYEDIPVLGQRPAEE

SEQ ID NO: 189420 - protein, 114 aa, Triticum aestivum
  unsure (1)..(114): unsure at all Xaa locations
  Clone ID: PAT_TA_83838.pep
NSKPTDSSPHKARQTRIVFVVVVAKRHTSGGVGGHVQRAHLPTRLPPHRLPPRHLQLRPVALLFLPLTTSPPIXPSPCSSLQPSSDQPXKRHRFEXPPFLATVMPRKAPAXXTR

SEQ ID NO: 189421 - protein, 87 aa, Triticum aestivum
  unsure (1)..(87): unsure at all Xaa locations
  Clone ID: PAT_TA_83839.pep
CPGWIXLSNATXDASSNPWXRDQIRRVNRPSGNAVVDGKRLVFGAGSTQLINALVHALSPDANAAAASPPARVVATAPYYPVRHLGR

SEQ ID NO: 189422 - protein, 115 aa, Triticum aestivum
  unsure (1)..(115): unsure at all Xaa locations
  Clone ID: PAT_TA_83840.pep
LAYPRRRVHPDMVGRMERQTASSSASCSSSSSSSSVCGGKKRPDILNMIRNAACLNSSSTDTGKGRSKLSTNKLHMDPPGGRXSGMAWKIHVEIQYXXTIXXXXQLXAXRXKXXY

SEQ ID NO: 189423 - protein, 96 aa, Triticum aestivum
  Clone ID: PAT_TA_83841.pep
AAGAPRHHVPAFPPQLLHGCRGFRRRRLFLSTPLHLHVLDPAATSAGRAVPPHHECRAPKHPVIPRPGAMESRRPYRQEVRHPGHRQEARRPPPLR

SEQ ID NO: 189424 - protein, 63 aa, Triticum aestivum
  Clone ID: PAT_TA_83842.pep
SSGPHPLSLSYSKVNFYVASVAGPVNRVTNWPAPQICLGVRVRRRLKTSWHICLGVRKHLKKV

SEQ ID NO: 189425 - protein, 77 aa, Triticum aestivum
  unsure (1)..(77): unsure at all Xaa locations
  Clone ID: PAT_TA_83843.pep
KNKRVLMESIHKSKAEKAREKTLSDQFEAKRAKSKASRERKXXGREERLAQXGPREPAAAPVSATAPFAAAPKKAKN

SEQ ID NO: 189426 - protein, 54 aa, Triticum aestivum
  Clone ID: PAT_TA_83844.pep
AGIVNVSEIRRVASISLLHLESFGHAHSILSLASMTGPKLVCEKHPRLSSQLLS

SEQ ID NO: 189427 - protein, 125 aa, Triticum aestivum
  unsure (1)..(125): unsure at all Xaa locations
  Clone ID: PAT_TA_83845.pep
AGAVNGLGSRGAAGRGESAQAGAGSRPIDAFFSFFLPFFPPFAARKDLSWATSFKNLTYFFSYPLQSNQQGKKSHLSTGLLCLFFSVXTPLMLRGDHXKTDCXLNSCRXAPISSSSXPXXADRLN

SEQ ID NO: 189428 - protein, 80 aa, Triticum aestivum
  unsure (1)..(80): unsure at all Xaa locations
  Clone ID: PAT_TA_83846.pep
NLGYCQAGSNVPYDDSMNLRNVLWLAPLPSKETKAWLAPGVLVVLXDAHPDGIIYQEMIRDYVQDXVRTVYEDDLGGEHS

SEQ ID NO: 189429 - protein, 76 aa, Triticum aestivum
  unsure (1)..(76): unsure at all Xaa locations
  Clone ID: PAT_TA_83847.pep
PKLQXNSPSGITALIVITVPKFLLKVKQGEGWQRTSCLNLQVAVEVTKMAVCRMSCINSILFLVTCVPVHQGHHIR

SEQ ID NO: 189430 - protein, 108 aa, Triticum aestivum
  unsure (1)..(108): unsure at all Xaa locations
  Clone ID: PAT_TA_83848.pep
ENKMQWMELKAAESPTVLSPNPPKRRNLSAAGSGDKAHQPPTRSAFAGSSRARILPKYLQPCSAGRSDVAPMNQCQERLXNSKTDAKDYPTRISGRRKRCVXKPVSIG

SEQ ID NO: 189431 - protein, 151 aa, Triticum aestivum
  unsure (1)..(151): unsure at all Xaa locations
  Clone ID: PAT_TA_83849.pep
IXVLINXRSWXVHQEYQLRQKFPGXQSISCXRLGDKTSVCCWAYQTSVCVGXIXTLYAAXGIKRFLHHXMXKCDKVSGVPHLEKYHVAVSCLSSLAWRXFACLAVMSNAGVKIPSPATVLGGVWSASLRFDCLLGGVMKFARRLLWALSCC

SEQ ID NO: 189432 - protein, 78 aa, Triticum aestivum
  unsure (1)..(78): unsure at all Xaa locations
  Clone ID: PAT_TA_83850.pep
FFFLKGNIXGNGTIIFIFTLIYYIIYIYYIYIYNKEIGFRPVRRHQFYRNVPFFLCVQPAVPRLKSSEPVWAREKKKK

SEQ ID NO: 189433 - protein, 152 aa, Triticum aestivum
  unsure (1)..(152): unsure at all Xaa locations
  Clone ID: PAT_TA_83851.pep
SNPTVWLTEWAPEPRDVYWDNLSIPFVSLTVRRLIIAVAFFFLNFFYVFPIAFVQSLANLEGIEKAAPFLKPLIEEHTIKSFIQGFLPGXIALKIFLILLPSILMFKSKVEGLTSISSLERSXASKYIFHILNVFLXTLCRIALKKYIIISK

SEQ ID NO: 189434 - protein, 118 aa, Triticum aestivum
  unsure (1)..(118): unsure at all Xaa locations
  Clone ID: PAT_TA_83852.pep
GEGSSREHAALEPRHLGGLAIITRSFARIHETNLKKQGMLPLTFTDPADYDKIRPDDKVXDVLCTQLXAVGXPFPFVVHPPDGXHFRIPXXXTFNEPXXXXKTSAPETMASTKTKEDD

SEQ ID NO: 189435 - protein, 144 aa, Triticum aestivum
  unsure (1)..(144): unsure at all Xaa locations
  Clone ID: PAT_TA_83853.pep
MEHDVHHQHQQAMELPPGFRFHPTDEELITHYLAKERAPDARFAPARPXAKANSTKXQPWELPSRANXGQKXLXLLLXKDRKLPXGXKTNRATNSDXWKGNGKGKEIFKNKGXLRNKKXPSXKXEGPKGRKNGWYIPKGTKKTL

SEQ ID NO: 189436 - protein, 97 aa, Triticum aestivum
  unsure (1)..(97): unsure at all Xaa locations
  Clone ID: PAT_TA_83854.pep
IFILQXTMPRFAKNSRSPXQXFXSPXQRKLPXQGLTPKEPEPGLTASLXPQAKSHLILTXNDPXQIXAXKAXKTESKSEPEIRLYYXSRSXASXXXI

SEQ ID NO: 189437 - protein, 206 aa, Triticum aestivum
  unsure (1)..(206): unsure at all Xaa locations
  Clone ID: PAT_TA_83855.pep
ARAGXGRFGGLSDLAGRRETETEGGVDRCSGGRCLXGTQXEVQGVHQRRCTRWTTLPPTASSSHRPCFXXPTLQSTLXTDKLSLPSQGCPYWQTHFXTTVSKEPGXYNKLSHPXPPAKLPPEIWPLTDQFTNQLQDFXXEHNICTXWXRXPLKVHPKXLHXSXNPNGVXINSTITWGTHENIPTSXRNSHYIPLXLYXKTXXXLXH

SEQ ID NO: 189438 - protein, 158 aa, Triticum aestivum
  Clone ID: PAT_TA_83856.pep
MATAIYLSSPAAPSSCARQRRQTTRATASATDRPREVVSPKRRLPLRKVPGDYGPPVLGAIRDRFEYFYGPGGRDGFFTPACARTAPPWCGQHPPGPFVAREPRVVALLDAASSRCLNSLVTRTGTHPSTTGVRCLYTASQHGVLSLTGTSIPDLMKV

SEQ ID NO: 189439 - protein, 183 aa, Triticum aestivum
  unsure (1)..(183): unsure at all Xaa locations
  Clone ID: PAT_TA_83857.pep
AKDVCRLFNLEPDKVIMFVENRPFNDQRYFLDDEKLKSLGWAERTPWEEGLKKTMEWYVANSDYWGDVSGALLPHPRTLMMPGCKGSEEIKGILSRFNNIQTKVGSTSDNAPXXACLXFXIYGRTXXXGDFWENMLXEXIPYEYGNXFSSKLKLKSAYGSHGVISGTSTALTTTVNVILSHRR

SEQ ID NO: 189440 - protein, 75 aa, Triticum aestivum
  unsure (1)..(75): unsure at all Xaa locations
  Clone ID: PAT_TA_83858.pep
MSEGTANCVDILIAIILPPLGVFLKVRGAARFWXXLLLTFLXYTPGIIYAIYAIHQRTPTHPPDDIHSLYRVSYA

SEQ ID NO: 189441 - protein, 151 aa, Triticum aestivum
  unsure (1)..(151): unsure at all Xaa locations
  Clone ID: PAT_TA_83859.pep
QNFKPGYTMPPKKTPVVETAVTISEHEDMQHLEPPEGLVDGADYTRCSYAASSMRHMXAGRWRSRSTIVTLRHGIXVASXRRLKQADTALHLLHNVLYFXLLVPAAVYLVHANDWRPPKWAXALPXHCRXGTKKNHQLYDYSLSQEETTYY

SEQ ID NO: 189442 - protein, 184 aa, Triticum aestivum
  unsure (1)..(184): unsure at all Xaa locations
  Clone ID: PAT_TA_83860.pep
QSIGATMVRKDGAGRRCWWRRPXPXARGRNSKEGPTTTPCPTGGEDFSKTTFKGTSPXXPDXPPTXSGTTFXTVPXRAATFXLXNPTGATKRRRPAPNLRSRFGLXTASKPLPXDSPACSLXXISXAARXXWXIGAXXTFQRKPKDLHKQKAGNSXHMXXQSSSSKXLTPNXGXGQIDXXXLNL

SEQ ID NO: 189443 - protein, 110 aa, Triticum aestivum
  unsure (1)..(110): unsure at all Xaa locations
  Clone ID: PAT_TA_83861.pep
VYIVLLTCAQIETGQNRSKIVDPKFIIPSGLAFLPPKPICLSYPFSPEGLFQSSPRIFVERPLVQPGRLPGXGAXGGRRXTXNGVAAHHHTXERVEETHGERRRLRVGVR

SEQ ID NO: 189444 - protein, 122 aa, Triticum aestivum
  unsure (1)..(122): unsure at all Xaa locations
  Clone ID: PAT_TA_83862.pep
ACSGNSPLFGRSCHQVPLVALAVNLRRXPFIFSGLPGGXRLLSXDXLLEVRSFFDXLLCCXDLXSSGFFLASXFPFALLAPCAGAAXVAXXAIACSXVXXXKESXXENWGAAIELASASGTR

SEQ ID NO: 189445 - protein, 130 aa, Triticum aestivum
  unsure (1)..(130): unsure at all Xaa locations
  Clone ID: PAT_TA_83863.pep
ILRGVLRVNQKIEVRPGIVMKDENGNIKCTPIYSRIVSLLXASKNDSNLLSPGGLLGVGNNXMDQLLTPXLIXWXGXSLGEXGPLPDVMLDLXIHFLPYPRSCWXFKTKGXEKXGKXPNSTKGXISPCLT

SEQ ID NO: 189446 - protein, 123 aa, Triticum aestivum
  unsure (1)..(123): unsure at all Xaa locations
  Clone ID: PAT_TA_83864.pep
STVLQLLLSLQALVLNEKPYFNEAGYDKFVGKADGEKNSITYNENAFLLSCKSMMYVLRKPPKAFXRLGQGHFTXGAPHILGSCXVIFGAISFGHHDKHTQEDGNKMPNRFNAWNFCPTLTAF

SEQ ID NO: 189447 - protein, 57 aa, Triticum aestivum
  unsure (1)..(57): unsure at all Xaa locations
  Clone ID: PAT_TA_83865.pep
MMEEIMQSVVTLTEDQYGNYVIQHVLQHGKPXERSTIITQLAGQIVKMSQQNLLQCC

SEQ ID NO: 189448 - protein, 42 aa, Triticum aestivum
  Clone ID: PAT_TA_83866.pep
FFFLGVTETLRMIQSTYKEQRTISIGASGKNARTYIYLYRAY

SEQ ID NO: 189449 - protein, 53 aa, Triticum aestivum
  Clone ID: PAT_TA_83867.pep
IIYYDPRNSCTLAGLGNVQVTRFAHTDRSCPTSLNKGLNKIETKPSMIQRHQL

SEQ ID NO: 189450 - protein, 139 aa, Triticum aestivum
  unsure (1)..(139): unsure at all Xaa locations
  Clone ID: PAT_TA_83868.pep
EWLRGAVLWLPRMTTRRIRRSKLLQMFFFXYSQLLWFALGEDVRLLIXSYILMKNFQGMALLXKGPXTXCCSXVSNWGTSPXGTXRXSDYXYNRPMNRRFDXPPLWKRICXXSFXKTFPXKTTPXNKNXKFFTSXSSXR

SEQ ID NO: 189451 - protein, 110 aa, Triticum aestivum
  unsure (1)..(110): unsure at all Xaa locations
  Clone ID: PAT_TA_83869.pep
XXTNLFPFISIIPFLLVFAXKXFPPYLAPXXLXXAPXGKXAKFXXLPQXLXNELXQFXDPKSGTHLXXXXMVQTSGXMATKRTRNVXQXRXPGVYKPVKXSVLSNWEGXX

SEQ ID NO: 189452 - protein, 60 aa, Triticum aestivum
  unsure (1)..(60): unsure at all Xaa locations
  Clone ID: PAT_TA_83870.pep
PPGLRLAAAVGMPFXSPXSARDLFRSNSPAGRRQARLRSESSQTGLISKNEMTRGSAGDD

SEQ ID NO: 189453 - protein, 96 aa, Triticum aestivum
  unsure (1)..(96): unsure at all Xaa locations
  Clone ID: PAT_TA_83871.pep
PPFXXSSRFSTXXLCXVXGXFXXGXIXXRXSVQFPRXQLRPPGGSQXXVGQXXGPXSGARCRGXGTQRRXALNGRRXDGAVLNVRRGSVRGAVTWR

SEQ ID NO: 189454 - protein, 119 aa, Triticum aestivum
  unsure (1)..(119): unsure at all Xaa locations
  Clone ID: PAT_TA_83872.pep
XATATXVMAVRGSFPSGGILGGIVRLFVLXSGXGDCXSXXWVXQVFPVTSVKXRQXGGNRXHIGEWXXGPPXXFFCXFXWPNFSTGGQNNXQKHLGVLADQSKATDTPRICGIRPSGXT

SEQ ID NO: 189455 - protein, 119 aa, Triticum aestivum
  unsure (1)..(119): unsure at all Xaa locations
  Clone ID: PAT_TA_83873.pep
PVINAGSLAKQKSPVRPETSTSKDAVFSSSTFLGRSSGSSRRPAVSSSRELSTEAEQTRSRTTDASPGAFPEVWXSTVGPARCLIPPDGXLPPSXXXHHLTPKNYDPTIKGMQGLTXMG

SEQ ID NO: 189456 - protein, 124 aa, Triticum aestivum
  unsure (1)..(124): unsure at all Xaa locations
  Clone ID: PAT_TA_83874.pep
MQIFVKTLTGKTITLEVESSDTIDNVKAKIQDKEGIPPDQQRLIFXAGKQSEDGPHPPPDYNIQEGXTXHLVSASRGGAQRSXEETYTNPKKFSTSTKXXLSXLHFYKGDDPTGKYPLRXGXPK

SEQ ID NO: 189457 - protein, 58 aa, Triticum aestivum
  unsure (1)..(58): unsure at all Xaa locations
  Clone ID: PAT_TA_83875.pep
MHELHRAPPNIVNRFXGLAYGRTSTIKCWLYLXFNMFNGHTTSSAPLLGMSWCLMWXP

SEQ ID NO: 189458 - protein, 124 aa, Triticum aestivum
  Clone ID: PAT_TA_83876.pep
MGHSNVWNSHPKNYGPGSRVCRVCANPHGLIRKYGLMCCRQCFRSNAKDIGFIKYRLKRHCAAVETPYIKRNPSLRSLIYRFTFCSKLTMCTRLVKFLMVLCAWANYQKLNFSLHDVLSFKKKK

SEQ ID NO: 189459 - protein, 134 aa, Triticum aestivum
  unsure (1)..(134): unsure at all Xaa locations
  Clone ID: PAT_TA_83877.pep
SGPIFSVDERNFSVXTPRSRQYFVILFIRGLWLNSIICFFHLPKLFSKXFLDQGCXNTTGCMXICEGGIKKGKNCCEYXXKKGGAPYHFPLXEPIXXHGVFKTXTXNLXLPTNPCKNPFATGYTRAHVXSKXXT

SEQ ID NO: 189460 - protein, 129 aa, Triticum aestivum
  unsure (1)..(129): unsure at all Xaa locations
  Clone ID: PAT_TA_83878.pep
VCXTXSXSVVSVXSDREITXPECRXLIIYLSXAXLVPWVVCHVRSASRLLRXRTERXGXLKYYWTVGEECVPRLFXRCIHVSQGLXRNVGRWRLYMQVSKSSCCGFQDLVTRPKMPNIHQPKNAQIKDE

SEQ ID NO: 189461 - protein, 142 aa, Triticum aestivum
  unsure (1)..(142): unsure at all Xaa locations
  Clone ID: PAT_TA_83879.pep
MAATAVSVDEKLDKLRAEVAKLSQISENEKAGFISLXVSRYLSWGRRSKFEWEQXXDPRPDEVMGALTIPSTSPPXSXPKETKELAGQXLCAPTXXGGSXTTXGCTXPXSXIXIPHGXNSLTLMXIXIXPPGXKXGLPLETL

SEQ ID NO: 189462 - protein, 135 aa, Triticum aestivum
  unsure (1)..(135): unsure at all Xaa locations
  Clone ID: PAT_TA_83880.pep
PPSSLRFSRRPWRGIQAAPSSSIAGHGKPSSNDNNRYCSTCTSSNANNPVMPKSTLYRLPKPIKSCVVMICLCLISQHIRVVNXKIGGXGFLQSLTLXGSNXQXYGWPIQTMXRLTTYFAXIXKIWSFRNAKKPL

SEQ ID NO: 189463 - protein, 129 aa, Triticum aestivum
  unsure (1)..(129): unsure at all Xaa locations
  Clone ID: PAT_TA_83881.pep
WKPAMDSLLLATDAPMAGDGEPSAAVAVALATPAEEGSPPASLVGEGEPSSAVAVALATPVEERFSPCFAGWGKVNLPWLWHSFGTRFKERFSPCFAYPLAAAVXRCPVSGRCXXQLQWQSYQGXNXTL

SEQ ID NO: 189464 - protein, 137 aa, Triticum aestivum
  unsure (1)..(137): unsure at all Xaa locations
  Clone ID: PAT_TA_83882.pep
MVKAVAVLAGTDVKGTIFFSQXRGNGPTTVTGKYLWPQSQGLHGFHVHALGXTPPNGCMSDWAHFQPVXGKEHGHREDXTASXDLGNXTXEKCVVNVHITDTKTLAXPSATFQCSGYFAKGHYFQDESGDFWDIGPR

SEQ ID NO: 189465 - protein, 96 aa, Triticum aestivum
  unsure (1)..(96): unsure at all Xaa locations
  Clone ID: PAT_TA_83883.pep
LVRKGNTFXRLXPXXMXSVSCAAKKDTXDKVCEIVKKQLXLXDHTEXCXEXKFSELGADSLXTXXIVMGLDEXLDIXXEESNAQTIAPXEDPGELN

SEQ ID NO: 189466 - protein, 111 aa, Triticum aestivum
  unsure (1)..(111): unsure at all Xaa locations
  Clone ID: PAT_TA_83884.pep
LKPKPTQPQLSIGCGCTCTQDPLGAELFVLSASKWNLGPFTMEYDCYILGPGPIXRXPSVPSWLGPGLICXKLWIHGGXNFECXPQYXRMVLGGAXIIMAQNFIPQSHXTX

SEQ ID NO: 189467 - protein, 111 aa, Triticum aestivum
  unsure (1)..(111): unsure at all Xaa locations
  Clone ID: PAT_TA_83885.pep
XSRXCLPNWXSXIXCSEMFXRPLXXFRXPYXALVLRILXRKXXXPGIFLEXGESVEXXPIHFWGKSNRXGEAWKEXMXLVANXSNKIQCPSLRSALCPRLLARKXLGQVFS

SEQ ID NO: 189468 - protein, 89 aa, Triticum aestivum
  unsure (1)..(89): unsure at all Xaa locations
  Clone ID: PAT_TA_83886.pep
XGXXVXMXXTSCNPAXGTGLPRQGSLGWEPKCLEGGWCHGRCSXGALAVPXETKLKCLAVGEDIHGGSILIVGLSLFVAHISLRNLSSQ

SEQ ID NO: 189469 - protein, 141 aa, Triticum aestivum
  unsure (1)..(141): unsure at all Xaa locations
  Clone ID: PAT_TA_83887.pep
SHPPPLPLPSRDHEATPPARLTGADRSARLRYAVTLRSPDLTPLCSCRGGRVRGPAVATASLLGRRDEPRRSATATATVRPGQAPRGAAAAAAVXSGSTPXLLLSKVLXPLXPXRARRRRXKFPXASESKXALRPGSKXFS

SEQ ID NO: 189470 - protein, 172 aa, Triticum aestivum
  unsure (1)..(172): unsure at all Xaa locations
  Clone ID: PAT_TA_83888.pep
MTSVRSCAASLTPSIRGMSGLVRQEALRRELDGCQLLAGIWCHGFTVAQLRSIRASLPDAARLVVAKNSXWXAAVAGTGXEALRPCARGMNXWLFVRSDEIPAGAQPYRDFKKDGSCSXNDFTGAVYEGRSTASRNSRNPTRRIYNTPRMLKSRVKSRVYGAQEDVARRNRP

SEQ ID NO: 189471 - protein, 69 aa, Triticum aestivum
  Clone ID: PAT_TA_83889.pep
RRPGSCGRGWRRRSPSTTPCTTPPSRRASHAPPRVGARAASSPVGCAAAVARSLSGRLCVHMVDLSVAG

SEQ ID NO: 189472 - protein, 139 aa, Triticum aestivum
  unsure (1)..(139): unsure at all Xaa locations
  Clone ID: PAT_TA_83890.pep
TIGGKRLNDLGSNFYAPTVIRDMTPEMDMASQETFGPVAGLFPFETEEEVVKMANNTEVGLAGYFFSRDIERVHRIAESLEVGHGWVSTLGIISDAAAPFGGVXESGFGPXGSLYGXIGEYQVTKMITYGAWAXPSIIN

SEQ ID NO: 189473 - protein, 197 aa, Triticum aestivum
  unsure (1)..(197): unsure at all Xaa locations
  Clone ID: PAT_TA_83891.pep
SFTPPSLSAASLPRLGACLGCSRPRIRCSTPASSATPTSSPSSTTPTPTPRAPPPPPTPSLPTPPPPPLTTTSRRSPLRSSPPLXAAPPPPHTHXPPGVRTRCSCPPPLALAAXSRAPQLPXSQSCLPPPPAILPEAGSGRNPRLTLPAIRGXXAPREQVPRGGSGRGGGPDYRPRGQHGRRTLTETCTFQFRCQRI

SEQ ID NO: 189474 - protein, 139 aa, Triticum aestivum
  unsure (1)..(139): unsure at all Xaa locations
  Clone ID: PAT_TA_83892.pep
PLPYLKVGYLTAPPANNSIAPHGDWEVSQFILNHEGLQQADASDQPPSQSPGHLDRGRKPVRINVADIVSVSACADLTLPSGAGSXIETIHGPTSWVAHSWEVLTAGLDPYPCLHYFAKKEDDFLPGIILVKWLLQGRR

SEQ ID NO: 189475 - protein, 126 aa, Triticum aestivum
  unsure (1)..(126): unsure at all Xaa locations
  Clone ID: PAT_TA_83893.pep
EDHKPNRIDERKRIENAGGIVIWAGTWRVXGVLAMSRAFGNRLLKPYVVAEPEIQEEQFSDELECLVLASDGLWDVVENEEAVSLGKSXDTPESAAXRKLTEIAYLRGXADNITCIVGQFHHDKTG

SEQ ID NO: 189476 - protein, 140 aa, Triticum aestivum
  unsure (1)..(140): unsure at all Xaa locations
  Clone ID: PAT_TA_83894.pep
HHSAPLASKSNRGXXCSAXNKFLXXXGLPVAATVNCADNTGAXXLYIISVXGIKGRLXRLPXACVGDMVMATVKXGKPDLRXKVXPPVIXRHRXXWRLXDGVYMYFXXNAXVXXNPMGXMKGLXSXDHRXXVXDLWXXIA

SEQ ID NO: 189477 - protein, 82 aa, Triticum aestivum
  unsure (1)..(82): unsure at all Xaa locations
  Clone ID: PAT_TA_83895.pep
SERSGXSASLIRFLSPGNDEHDPAGRHXATDQQCPXLAPIAAHRLPXPXIWXRATEPPRLXHAFHNSXSXIXHPRCXGXXXV

SEQ ID NO: 189478 - protein, 168 aa, Triticum aestivum
  unsure (1)..(168): unsure at all Xaa locations
  Clone ID: PAT_TA_83896.pep
MVLIKSFVLSALAATVAAKSAVIELLPSNFDDIVLKSGKPTLVEFFAPWCGHCKTLAPVWEDLANTXEYAKDKXQIAKVDADAQRELGKRFGXQGFPTLKYFDGKTTSRITSLARNLTIHVEKMGETKEELNCQRVLLTMRIPKHGGTCPRLRSVENFPENKIYKSFR

SEQ ID NO: 189479 - protein, 87 aa, Triticum aestivum
  Clone ID: PAT_TA_83897.pep
NHIVFRTRQKFIKENNDILFFLRKHNKVLSPVKLTIFIFMKKWDLSSTFRICLYYKTLSIFFSSFWYSELKKYENSITTKNFNLSMG

SEQ ID NO: 189480 - protein, 145 aa, Triticum aestivum
  unsure (1)..(145): unsure at all Xaa locations
  Clone ID: PAT_TA_83898.pep
LESEKAVSGFHADNIAPAILGGFVLVRSYDPFHLVPLSFPPALRLHFVLVTPDFEAPTSKMRAALPRQVDVQQHVRNSSQAAALXVAAVLXGDAGLIGXAISPTGIVDPPRXLIPGMAAVKAAXLQLDAGCTLTGGPTWWLKRGE

SEQ ID NO: 189481 - protein, 133 aa, Triticum aestivum
  Clone ID: PAT_TA_83899.pep
REVVDARIQRLKRAMDLSMKHQYLPEDLQAQQVPFRGYLSDMLALVKKESAERQSLGALPLYQEDTSLGCWIDMVASILPLYRKSRTHQIKCSGMKLFFLFQPNLILLVQCHGALTMGVLLFSTNLSSTIINL

SEQ ID NO: 189482 - protein, 161 aa, Triticum aestivum
  unsure (1)..(161): unsure at all Xaa locations
  Clone ID: PAT_TA_83900.pep
PTFSVILVFPRHKTPSALLCSLPLSSLPPSQELHCTISTPRTQHRVGSESTGEAEAQLTPHSLHPSASHGQGLRQTRRRRPPALVXAPASILVVLALTVGVLALIVYLVLRPXHXALPARRXLXXWTLQRNNXTXXXLSQRVQVTYSQPXTXRVXTRSLXV

SEQ ID NO: 189483 - protein, 69 aa, Triticum aestivum
  Clone ID: PAT_TA_83901.pep
THTHTDKWFPKPSVCTSNQLARAAAGSHHVGGEAPPLLQPPQEGRGAARRRVRVLRDRGGHRHRRGRVR

SEQ ID NO: 189484 - protein, 165 aa, Triticum aestivum
  unsure (1)..(165): unsure at all Xaa locations
  Clone ID: PAT_TA_83902.pep
KDHVDSNYKLAYDGFLSKVPIPPGQVYAINDALSAEGAADDYEACLKQLVKNGVISMSAATXGFPRFDLHFRGMXGPDGHIASLXPGHLLLTRKKVXTYIKISKXTPXRITXTFQLTTIRILXMVVTGTGKGAXVXKXLRQQTLKPAPVKCAQDGESLVTDKGRF

SEQ ID NO: 189485 - protein, 41 aa, Triticum aestivum
  unsure (1)..(41): unsure at all Xaa locations
  Clone ID: PAT_TA_83903.pep
CKPAGVALTLRMQLGYAHXYYFIGTFVDDHIAHHAQFLKSA

SEQ ID NO: 189486 - protein, 48 aa, Triticum aestivum
  Clone ID: PAT_TA_83904.pep
EEEVDETGVEAKDVELVMTQASVSRPRAVKALKASNGDIVTAIMELTT

SEQ ID NO: 189487 - protein, 148 aa, Triticum aestivum
  unsure (1)..(148): unsure at all Xaa locations
  Clone ID: PAT_TA_83905.pep
YFMVCYIALPLLMSNMIMLSVPSSSQRTLVERLFGLVGYEQRFSSDRFHPSPYRQRRGVVSKGTEPRGGGLGAPHGDFPGPWVQREKXPNGLQVWAQXGQCTGTPMVADPXRRPQLRGATSXPFLRSNQKXRTXLEXXNASXXKTPTT

SEQ ID NO: 189488 - protein, 94 aa, Triticum aestivum
  unsure (1)..(94): unsure at all Xaa locations
  Clone ID: PAT_TA_83906.pep
KIEAXTGNYHFLLTILQXYLHRNLFICGLNHITTLLTPXXHPSFAFPFLLSGKMLTFAPGSYYFDPIFVGAHLQITGFPTSPTVSPCALDVTAS

SEQ ID NO: 189489 - protein, 115 aa, Triticum aestivum
  unsure (1)..(115): unsure at all Xaa locations
  Clone ID: PAT_TA_83907.pep
CIIIIQEVAGFCPIKLVMILXVLSVSFLQQPDLGIVKQRMVNQLLPRSLLXKFLKMGTLPSFGLVPSXDXAALLGXRGGVKXLGIXQVRTECXHRSTRWQSXPGXSQXHXQPVRL

SEQ ID NO: 189490 - protein, 60 aa, Triticum aestivum
  Clone ID: PAT_TA_83908.pep
FQTDFKFDPFKLPTRISYILKNHFIFSHENIESLKVPNLKYFLIKSNFSKKPFHLIKWEE

SEQ ID NO: 189491 - protein, 76 aa, Triticum aestivum
  Clone ID: PAT_TA_83909.pep
LINCWLPFPSAKQWELVINIAHRTAVERNPDLYTALIGMGQTLFSNRLFPEAAVCFEHAIPKVCCLPRATFIIWRQ

SEQ ID NO: 189492 - protein, 103 aa, Triticum aestivum
  Clone ID: PAT_TA_83910.pep
MLCHANGSMVRQQGDDGAAAAKEEEEKVRLGSSPPSCRGLCYACSPCTAVQMPTMSSSSVPLVAALSNYKPVGWKCRMAAGGRGRGGRSRWEGEGRKRRRGGG

SEQ ID NO: 189493 - protein, 32 aa, Triticum aestivum
  unsure (1)..(32): unsure at all Xaa locations
  Clone ID: PAT_TA_83911.pep
VLKGDRETXXLEXSXXFIVFIXXXPXLAXSXC

SEQ ID NO: 189494 - protein, 183 aa, Triticum aestivum
  unsure (1)..(183): unsure at all Xaa locations
  Clone ID: PAT_TA_83912.pep
MAESFVLSTGSRIPSVGLGVWQIQPDAANDAIYAAVKAGYRHIDCAAAYNNEEEVGLALKKLFEDGVVKRDDLFITSKLWAANHAPEDVEEGIDTTLQDLQLDYLXDLYLIHGPIRXKKGTNTMTLKTSPYRXPATWAAMENYIRQNCNPRDLVRTHDCRQCPTSTSTGWKKLGTSIKSLRSA

SEQ ID NO: 189495 - protein, 85 aa, Triticum aestivum
  unsure (1)..(85): unsure at all Xaa locations
  Clone ID: PAT_TA_83913.pep
LLLXPXXFPPXPDYQLNTEKNLQRPAFDSNSVSLAFPPTGLTGETSPGVAKQSKAKQPFSLSPEKFCNAAPRRLATTTWLEGPLP

SEQ ID NO: 189496 - protein, 147 aa, Triticum aestivum
  unsure (1)..(147): unsure at all Xaa locations
  Clone ID: PAT_TA_83914.pep
LGAAAAGHQATGCSSAAVIFLLMASSSSSSSTSTPXLPGRQPAAGAFVASSRSSSLPRPAPGTRLPPRPDPPXNVXVPPXERQDPWXPXSXKXHXKVGLPMSKVKWMIXLVIXKCPRXPWESXCARARPLIXFHXRLDKRXNXFPPP

SEQ ID NO: 189497 - protein, 147 aa, Triticum aestivum
  unsure (1)..(147): unsure at all Xaa locations
  Clone ID: PAT_TA_83915.pep
NCGHXGXNRXPRAXRTARPRPGALXNSXRXGRXSGSEQGPRRGXEXPPPIKVRQPRDEQITTFFKPENSGQIADSPNASESPRGRTKITDFPKRAERETAILDSGDERFRNGIHRCGQNPNPKGCGVRFGAAPRRGVGGWSSSLVVR

SEQ ID NO: 189498 - protein, 101 aa, Triticum aestivum
  unsure (1)..(101): unsure at all Xaa locations
  Clone ID: PAT_TA_83916.pep
AKSSTYKADGETCKITYGSGSIAGFFSDDDVLVGDLTVKNQKFIETTRESSITFIIGXFDGILGLRIPRDSVGKXPPIWQSMQXKELLAXDSLLLANRTRR

SEQ ID NO: 189499 - protein, 104 aa, Triticum aestivum
  unsure (1)..(104): unsure at all Xaa locations
  Clone ID: PAT_TA_83917.pep
GYAPVLDCHTSHIAVKFAELITKIDRRSGKELEKEPKFLKNGDAGMVKMIPTKPMVVETFSQYPPLXGRFAVRDMRQTVAVGSSRVWEKKDPTGAKLPSTAKKK

SEQ ID NO: 189500 - protein, 136 aa, Triticum aestivum
  unsure (1)..(136): unsure at all Xaa locations
  Clone ID: PAT_TA_83918.pep
PPPLGPAHRLLRRPPSTGDKDSDDAVGGVEASPPRPPPLPFNLGCHRRLQIRLPARARSPRVVWSGWRKMHVCEGAGGQGVRASRPQGHRREVXCEWNCTTCLDYWVPWGATLCNNLPRWVXMLVQLKSXXDSPXT

SEQ ID NO: 189501 - protein, 132 aa, Triticum aestivum
  unsure (1)..(132): unsure at all Xaa locations
  Clone ID: PAT_TA_83919.pep
LVSLLPGGYGTMEELLEMITWCQLGIHDKPVGLLNVDGYYDPLLALFEKGAAEGFISTDCSQIFXSPAPTASELLTKMEQYTRVHXEVPQRRLGDFGLRYGRRRRRRHAAKQQQQESKKEKLHISSLLLYAC

SEQ ID NO: 189502 - protein, 140 aa, Triticum aestivum
  unsure (1)..(140): unsure at all Xaa locations
  Clone ID: PAT_TA_83920.pep
TAHQERHRRTSGHSASTGAQHVNTKVQFNTXXQDIQCMXXPVLATGWITXRNSQRTGTVIKAEVFPALNEDPFLLPCIRTSRTMNNPKSETQDVIXDTYDGCPSSRNTSEXXFGVXTEVXGPSKXVSGSXNVSCXGKSFL

SEQ ID NO: 189503 - protein, 46 aa, Triticum aestivum
  Clone ID: PAT_TA_83921.pep
GVHIFYLESPLFRHVDMLTCCDVVHSYLYFSGDLEHFVDRYTVNIC

SEQ ID NO: 189504 - protein, 126 aa, Triticum aestivum
  unsure (1)..(126): unsure at all Xaa locations
  Clone ID: PAT_TA_83922.pep
MLGAARRQLGSGPMLGQVLRRLRPAAAAAEVARGYSAAAKEMTVRDALNSALXDEEMSADPSVFLMGRRVGEYQRCIQDFXRACLDNYGPDRVLDTPINRAGLYWIGVGHLQGLRLLNLRHFPVMY

SEQ ID NO: 189505 - protein, 112 aa, Triticum aestivum
  unsure (1)..(112): unsure at all Xaa locations
  Clone ID: PAT_TA_83923.pep
VPCFILLXSYFPVTQGVHLLXLWPMXGVKTTTXHVKVXKXGSLGCLNTYLWSTGGKGGRVGLCHXXAWKKISPIXXALMLSLIPKEERPCLRIMHYDICPGXHIDCLIWIDV

SEQ ID NO: 189506 - protein, 96 aa, Triticum aestivum
  unsure (1)..(96): unsure at all Xaa locations
  Clone ID: PAT_TA_83924.pep
GIWFXLSSWWWXVXWFAQVWIKSNRXLQKGDSCVGPCSFRGRYFPSGVRTHVMEHKDHFGIPICTRIQFFRNSKCXSGANNGTACPIPPSWGRKSP

SEQ ID NO: 189507 - protein, 51 aa, Triticum aestivum
  unsure (1)..(51): unsure at all Xaa locations
  Clone ID: PAT_TA_83925.pep
TPESCSXAXFGXSAXPLRDVLXSPQHFKAIXAASXRQIXSRVNXLPXXSPA

SEQ ID NO: 189508 - protein, 164 aa, Triticum aestivum
  unsure (1)..(164): unsure at all Xaa locations
  Clone ID: PAT_TA_83926.pep
IAREISAQVAKKHQALPPSKKVPEIEIIEVAENVCNLKKQEADWMLRIDIVEKGDKLELVEQDEEGHCNAECKTIERACQEVIGYADTDVAEFVYKNNPSXSIKLMKFSCKVFXKHCQRTHAISKNXVPGGTXARXPSKDAEWKNIEMEVRSPTMKIPRTGNTW

SEQ ID NO: 189509 - protein, 136 aa, Triticum aestivum
  unsure (1)..(136): unsure at all Xaa locations
  Clone ID: PAT_TA_83927.pep
LKHGGAVTTGDVKEICNHLALDNLQKQHTCLNTDEKNTVQGLVTSSCETNSAADIPAKDISSISILGVPGTLVASRMNLSCICTKMDRLYVITIGGYCTILKISSLHPHNFVKAPLIXYFNGTXWEVXPLDHXPIP

SEQ ID NO: 189510 - protein, 97 aa, Triticum aestivum
  Clone ID: PAT_TA_83928.pep
MATATSASASASASPGAFGAKTPAPARGLSTHPVLTPSPAFARPSPRTPACSRSRASLHLGGLGSTKQQQRRRRRETEPGPRAPTVAPLAVPKMAAP

SEQ ID NO: 189511 - protein, 155 aa, Triticum aestivum
  unsure (1)..(155): unsure at all Xaa locations
  Clone ID: PAT_TA_83929.pep
SRFLARKHTARAAERPWQVPGVSSSSSSSRCSCSSARTRRSAGPRREGTKVSLELYYESLCPYCSRFIVNRLAGIFEDGLIDAVHLRLVPYGNAHVASNSKXSCQHGPYEFLLKPLNHRPWWMIQIYALEDCRTRGSSPEATNLQNDMASLSNKR

SEQ ID NO: 189512 - protein, 166 aa, Triticum aestivum
  unsure (1)..(166): unsure at all Xaa locations
  Clone ID: PAT_TA_83930.pep
HRLTTPTSKQKFPNPLVSAAKMSGRGKGGKGLGKGGAKRHRKVLRDNIQGITKPASRSXARPGPAXKRISGAHLRXRPRGVLQIFPGRTSSRDAVTYTEHLXRKTVTAMSLPAPQAFPLFGSLRPPSPLGLCLIPIFVLGKFPNTLTHVSQWFPENFMGTSHLFKN

SEQ ID NO: 189513 - protein, 102 aa, Triticum aestivum
  unsure (1)..(102): unsure at all Xaa locations
  Clone ID: PAT_TA_83931.pep
PKEEAQNAPDIVLGTFPVXTIPAMVLFDSGASRSFISKSFALQNNFSMLPLEKSMTIKSPGIQQVTQNYCQNVVIEFEGLKFHANLIVLENKGLDVILGMDW

SEQ ID NO: 189514 - protein, 83 aa, Triticum aestivum
  Clone ID: PAT_TA_83932.pep
SHNTCVQQSRKPPNSSYWGLCIRSPLFCGCFLAWLFYSEQICMLLYFTIPKVLQCIVAGLRVNYKLSCQQPDLFDFRELGHQI

SEQ ID NO: 189515 - protein, 78 aa, Triticum aestivum
  Clone ID: PAT_TA_83933.pep
TTHGDHPVIIQVCVSSPNTGEWSDPCPGLDLGVDAFIMPVPPVVIRDRCSLLDACMRVVSIITLQEFSSTTWALIAYR

SEQ ID NO: 189516 - protein, 130 aa, Triticum aestivum
  unsure (1)..(130): unsure at all Xaa locations
  Clone ID: PAT_TA_83934.pep
MAKFALGHHREASDAGCVRAVLAELILTFLFVFAGVGSAMATGKLAGGGGDTVXGLTAVALAHTLVXVAVMVSXAGLHXSXRHINPAXTLGLAATGASXFRSGLYFAANCXSKLACLSWLSIAKTASHPW

SEQ ID NO: 189517 - protein, 84 aa, Triticum aestivum
  unsure (1)..(84): unsure at all Xaa locations
  Clone ID: PAT_TA_83935.pep
ARPGVTTTSHLARSGACIAVRPQTPRPXLQSKQVLRVHHYTLKIPWAWGEGHDHDKPRLWLNHTRGSQVCRSFFYLLFFTHRTP

SEQ ID NO: 189518 - protein, 116 aa, Triticum aestivum
  unsure (1)..(116): unsure at all Xaa locations
  Clone ID: PAT_TA_83936.pep
DXTXXFKXSDXXHRXXXSETTVRXXVXVSXNAXQHGNXKLKARDXPXVKSVGIQVDERSLAYYVSCAFRERQQRRPXAXXNLSCDRXSPRHPXYLRRVVPPXLXMGXXXLXKXVXT

SEQ ID NO: 189519 - protein, 117 aa, Triticum aestivum
  unsure (1)..(117): unsure at all Xaa locations
  Clone ID: PAT_TA_83937.pep
MASISSLAALSLFLLVSVGLSDAIRVARYSSSQGAPGKGGNGGAYQNGSGSGVGLGSGSGESGADGVYVSAGGGGXGGGWSQYGGTAFGGGSGTGSSSSQYSSGXSFGNGGSTLAGG

SEQ ID NO: 189520 - protein, 86 aa, Triticum aestivum
  unsure (1)..(86): unsure at all Xaa locations
  Clone ID: PAT_TA_83938.pep
TPGSRTCPRSPNPTPLTHGLDSGKEEERSWLTVLYYSLFLQATLPIFSCVRHKKRLDGLLVFPAVWVFSYRRTSVDVQSXGPCVRL

SEQ ID NO: 189521 - protein, 186 aa, Triticum aestivum
  unsure (1)..(186): unsure at all Xaa locations
  Clone ID: PAT_TA_83939.pep
LEVDEYSELGNLSSEVSAIYLAMQQSKLECIDEQSQDSTSTEGYGEAEETEEYDDFDPYSFIKDLPDLSMVVPKFRPVLLPKQTRSCPTMTLYLILDETLVHSTLEHCEGCXIQFQXXFNFRDHTXYVPSRPXSXDSGXGCNVFXTLFHXXQSIYXXTPMSDPKXFPSRLPELCQVEEHESYYPKM

SEQ ID NO: 189522 - protein, 113 aa, Triticum aestivum
  Clone ID: PAT_TA_83940.pep
LNHAYYAKNQEHRADHLGFHKALCVLMGWNYSVAPVHKTAYQALSTVDAEANQGDLILWPPTVIIENTYKSKNDGEKDVMSDKEVESKLREMGFAGVNVQPLLGKGRAEVGAS

SEQ ID NO: 189523 - protein, 120 aa, Triticum aestivum
  unsure (1)..(120): unsure at all Xaa locations
  Clone ID: PAT_TA_83941.pep
XIGTAPXXXGGXXSXXHPREPXXRLRNAXXEXXLGXDHFTXXAXXRRRHHYVSVSVLTLLGGGIGRCRFLCDVTNSSESYGQVVPAFLAVARTYADKRERDDTITQHTHEIKIISILLSC

SEQ ID NO: 189524 - protein, 126 aa, Triticum aestivum
  Clone ID: PAT_TA_83942.pep
MADTGDVAAAAEASARPAGSSSTQPLAGRVAIVTGASRGIGRAIATHLSSLGASLGAGLRGARRRRRARLAASLPRAVGPGGRLTKPASVFRRRGRGFRGRAILVATPGCWTHYPPAANGTETCLP

SEQ ID NO: 189525 - protein, 104 aa, Triticum aestivum
  unsure (1)..(104): unsure at all Xaa locations
  Clone ID: PAT_TA_83943.pep
SXGKCFXPGXXPFKIPGCPMEEPLNGGHTXXHSKSLXFVPPXXTPXXGDATNQPNHVGNXHGSXKEVNIVHRFFNXNMLYIYIYIYIYIYIYIYIYIYCPLKXT

SEQ ID NO: 189526 - protein, 142 aa, Triticum aestivum
  unsure (1)..(142): unsure at all Xaa locations
  Clone ID: PAT_TA_83944.pep
MAALSSAAVSVPSFAAKAATPMRSSRMVVRASLGKKXAASAAVXXAASAMLLGRSXRMAQDFSLGRQTAASGFXSPNDLSVNSRXNITXKEXPVPANLCXTKTLPFRVDFPNFPRFSSPKTLITVPTKVMPNGPNVKKKLFQ

SEQ ID NO: 189527 - protein, 150 aa, Triticum aestivum
  unsure (1)..(150): unsure at all Xaa locations
  Clone ID: PAT_TA_83945.pep
MFPKYIWDPLMCXESHNRXYWYSGKSMVFXXKXPXNRLGGYAFGDSAXTLNRGPIKNRWRXTLLEXWFGQGTQSSRFFKSLGXADXYVEELQPDXXIPNREKCVFIGYPKELLGIPSITDPKAKTFVAKFGNFLEKEFLSKEVSGRKVET

SEQ ID NO: 189528 - protein, 98 aa, Triticum aestivum
  unsure (1)..(98): unsure at all Xaa locations
  Clone ID: PAT_TA_83946.pep
DSQNQQEDLGEXPPIIFSGPLAKKPCRRGIWPGDDRGGGWTEQTEPAREEGERNSQELWFPLSLHNPSPPAAKNTGNAVPWNAERGAGNVRRGEASTS

SEQ ID NO: 189529 - protein, 120 aa, Triticum aestivum
  unsure (1)..(120): unsure at all Xaa locations
  Clone ID: PAT_TA_83947.pep
MARLLRAAAVLALLAVSTAALSAPAWAGGVSAGDLAHLGAAVVIXRGGGRACRGGTTVGECMEYWTLDAEGEXRLAGMATGXNKRRVLQXGXLIXYXALRRXSLRTRGPKMANLGVIPRG

SEQ ID NO: 189530 - protein, 139 aa, Triticum aestivum
  unsure (1)..(139): unsure at all Xaa locations
  Clone ID: PAT_TA_83948.pep
MSDSEEHHFESKADAGASKTYPQQAGTVRXKNGFHPSIKEPPCKFVEVLPPKTGXKHGPCQIHFXFXINIFQTGKXPEICPFVTQLXIFPHVNXTXYQLDLIYPKDGFVPSLLQNGNTXIFLTPNWSLWPLRRFLNCLL

SEQ ID NO: 189531 - protein, 56 aa, Triticum aestivum
  unsure (1)..(56): unsure at all Xaa locations
  Clone ID: PAT_TA_83949.pep
MLRHAARRLVSXTAAAPTXXRALVTADVPXXAAXDSTFXXAXKXVXXXIXPPLTLF

SEQ ID NO: 189532 - protein, 85 aa, Triticum aestivum
  unsure (1)..(85): unsure at all Xaa locations
  Clone ID: PAT_TA_83950.pep
RLNFXKMLXWXNLKTXKCIXIXDLEXEVQPSALRAKKGRTSAQPGDSQSDISGGVPAGSREDGSGXRAGTLAESVGDRFGRNSMC

SEQ ID NO: 189533 - protein, 69 aa, Triticum aestivum
  unsure (1)..(69): unsure at all Xaa locations
  Clone ID: PAT_TA_83951.pep
PGPXXFFVXLHNIDNKYGXXVXYNFNIFLGVLXGXNSMVXPLXGLKXGQXEWXCXIGIRXXITXHREPN

SEQ ID NO: 189534 - protein, 68 aa, Triticum aestivum
  unsure (1)..(68): unsure at all Xaa locations
  Clone ID: PAT_TA_83952.pep
TXEEHXTAEAXEIASADXERXTCXELPXIPNTXFPXVTLVLCQLLLXTGTPPPNXRRRRGRRLPGHRR

SEQ ID NO: 189535 - protein, 82 aa, Triticum aestivum
  unsure (1)..(82): unsure at all Xaa locations
  Clone ID: PAT_TA_83953.pep
ARGKQSSPTTLPSRFFSSFXRFLSIRAVLAIKIILQTSCYDSLLLPVHNPSLRPTILLXNYNPLLGXLEQKXPPKMNXINTP

SEQ ID NO: 189536 - protein, 124 aa, Triticum aestivum
  unsure (1)..(124): unsure at all Xaa locations
  Clone ID: PAT_TA_83954.pep
EAIAELTKAIAFKADLNLLHLRAAFHEHVGDVSSALQDCRAALSVDPNHQXEMLELHHRVNSQGTLSASHGVHTGQELHHTNRPYRCMFCSIHSNSDMFRHKLKTLIPPPLKPTPIPCSPNLLI

SEQ ID NO: 189537 - protein, 87 aa, Triticum aestivum
  unsure (1)..(87): unsure at all Xaa locations
  Clone ID: PAT_TA_83955.pep
AKTSFQTTSGKAKYNASIDSLVWKIRKFPGQTEATMSAEVEXLISTMGEKNPWNSHLSQMDPXPNXTAPGYVFRXFKVXEKSGLYTV

SEQ ID NO: 189538 - protein, 136 aa, Triticum aestivum
  unsure (1)..(136): unsure at all Xaa locations
  Clone ID: PAT_TA_83956.pep
VIFFWAAYKTNFFPKIFHVESLEKTAQDDFQKLASAVYLQVSTISQASSSVTRSXRSWHLSERPGSIGFASLVRTDATLIAVTPTGFTSIXELGLGLAXMCXCTXXFXFPPXTQFXNXYPLNGSWXLAIKIRLQGM

SEQ ID NO: 189539 - protein, 73 aa, Triticum aestivum
  unsure (1)..(73): unsure at all Xaa locations
  Clone ID: PAT_TA_83957.pep
FFFFRELXSRGFRVRPAPQVRCACSRGVTSVHAGEGSERPQESACPVLGPARPTFSKKALVLPFIVVRRGSRC

SEQ ID NO: 189540 - protein, 175 aa, Triticum aestivum
  unsure (1)..(175): unsure at all Xaa locations
  Clone ID: PAT_TA_83958.pep
VKGGPEKELKAIQYLERRECEYDQKISIDFYKEGDPLKPAVTGVLSVXVSTPRFQLGNNYYLGXSSCQDMARQILQQWPTGYNKDYLSXNGRKIYPALXXKISIYKLCNEXRKVLQQDKGTSLVPCFPIPPHLPPFKDGPNTTPPQLHCSLWFNNSVSLSGRVKKTKPDKLIKKK

SEQ ID NO: 189541 - protein, 114 aa, Triticum aestivum
  unsure (1)..(114): unsure at all Xaa locations
  Clone ID: PAT_TA_83959.pep
LQLWNQQITGLHYNIDHSLSFSLYPFSSITMNAFRCMRPVAGRVAFQRPTLPRVAPSLQLRGLMSISKFLNPTRCWTITLNRPKALKALCTPLNKRXKQXLPELMWADNTXXQF

SEQ ID NO: 189542 - protein, 108 aa, Triticum aestivum
  unsure (1)..(108): unsure at all Xaa locations
  Clone ID: PAT_TA_83960.pep
TGVFVLAYLRDSKLSPIPPLLPFLTTAAAPPVQQHHEGVHLDPHRPGWVSRSGNAVLGAVTASEHGIPGWMARCPGGQTIXGRLMMLFNTFLXXRLAPGXTPPXCFLV

SEQ ID NO: 189543 - protein, 81 aa, Triticum aestivum
  unsure (1)..(81): unsure at all Xaa locations
  Clone ID: PAT_TA_83961.pep
LGKSISNGNRCIKTXNNARXKIFYLENDTERLRDYESEGKATAGRPGEASPSPLGLLLPEAEAEAPAPVPLLATRSRSSSV

SEQ ID NO: 189544 - protein, 129 aa, Triticum aestivum
  unsure (1)..(129): unsure at all Xaa locations
  Clone ID: PAT_TA_83962.pep
LGGAMVGGPDKNDGFKDSRNTFGQNEPTLVGNAGLVAALVALTSSGRGXXVTAVXKNTMFSAVPPXFPAAPPPPSMGHDDRTFHGPYIFCIHLLTPISFLFNTTTLIYITLNIYPKFIRILYLLRSMGL

SEQ ID NO: 189545 - protein, 53 aa, Triticum aestivum
  unsure (1)..(53): unsure at all Xaa locations
  Clone ID: PAT_TA_83963.pep
LAAPLQHLYASSKSIKERLTYMQGDXGNNPLVNLXFVLGFXPTGFIGPAAXXA

SEQ ID NO: 189546 - protein, 122 aa, Triticum aestivum
  unsure (1)..(122): unsure at all Xaa locations
  Clone ID: PAT_TA_83964.pep
CRSXGHPQXNGQAXRGESGIVKGIKPXXWSLXKRMPGCWVEELPSVLWSINTXTPNRXTGYTPFFLVYGAEAIXPSDIRHDSPRVANYVEADNEQARQEALDXLDEKRDMALARSVVYQQDL

SEQ ID NO: 189547 - protein, 123 aa, Triticum aestivum
  unsure (1)..(123): unsure at all Xaa locations
  Clone ID: PAT_TA_83965.pep
RVRARRGQATDPHSIAERLRREKISDRMKNLQDLVPNSXNKADKASMLDETLDHVKFLQLQVKVLTMSRLRLPRXSSPFRKXQTEGYRRQLPVSQPTPQDYWTRTKPSPFQERNEPHSQMHTF

SEQ ID NO: 189548 - protein, 158 aa, Triticum aestivum
  unsure (1)..(158): unsure at all Xaa locations
  Clone ID: PAT_TA_83966.pep
MQIFVKTLTGKTITLEVESSDTIDNVKAKIQDKEGIPPDQQRLIFAGKQLQDGRTLADYNIQKDPTSTWVLRLRSGAKEAQEEDYTNPRSXAQAQEVNSQCCILQVDDATXXVTRLRKXCPNTXCGAGVSWQHTAKAHSSELSHRPCLPLLNITVVTN

SEQ ID NO: 189549 - protein, 91 aa, Triticum aestivum
  Clone ID: PAT_TA_83967.pep
CPDAWVYSHTRLRRMKQTTLLRWSILHVQKTIDNEALQSGYENMLLTRLCVSENTATKTLIKLLARARNYQHEILLRDTGLKWQSTFNFSF

SEQ ID NO: 189550 - protein, 76 aa, Triticum aestivum
  Clone ID: PAT_TA_83968.pep
PFGNVQSEVLMRKDARTFTFSMGWAFPRKIYFNGDECKMPPPDSYPYLPNAAPVVASQLVLSAAASAFLLLLLLVA

SEQ ID NO: 189551 - protein, 162 aa, Triticum aestivum
  unsure (1)..(162): unsure at all Xaa locations
  Clone ID: PAT_TA_83969.pep
MTPASSVSVPAPVPAPPKPLYLRGPVIAGAVALAAFLLLAAAYATRRAGSPPAALLSHPAVSTRFFSFDLVREYPHDPAAFTQGILYAGNDTLSSHWALXRKSQFXKVLVNXQMDGDFLEKGXILLGTDCSKVTWXKXTVIYDRXNFQMHNFTNKSXGWVWQ

SEQ ID NO: 189552 - protein, 155 aa, Triticum aestivum
  unsure (1)..(155): unsure at all Xaa locations
  Clone ID: PAT_TA_83970.pep
MGSTAGDVAAVVDEEACMYAMQLASSSILPMTLKNAIELGLLEVLRKEAGGGXAGLAPEGVVAXIPRRPGDXAAAAXMVDRMLRLLASYXXLXCQMXDRDGGTYPARPSQLSPQRRRFHAPLMNRKGLMEVSTRRGSLKRRIFIGSLLQDSQNVL

SEQ ID NO: 189553 - protein, 81 aa, Triticum aestivum
  unsure (1)..(81): unsure at all Xaa locations
  Clone ID: PAT_TA_83971.pep
MAEESGRPLPKFGDWDVNDPASADGFTVIFNKARDEKKGGNGQDTESPSKDTRTEXVXESYAAKPSTKKWXCCXKSXPTQS

SEQ ID NO: 189554 - protein, 80 aa, Triticum aestivum
  unsure (1)..(80): unsure at all Xaa locations
  Clone ID: PAT_TA_83972.pep
CLSSTLSVSSLLLQAEEDEWGYRRSAATSALTAGERARPTHTTPPLLLLILCHXRFLIKYLLRDNPFYGQXKKNXSKKKK

SEQ ID NO: 189555 - protein, 122 aa, Triticum aestivum
  unsure (1)..(122): unsure at all Xaa locations
  Clone ID: PAT_TA_83973.pep
RNPIGGAEVSLHLHPPPPWLSVVSPRRGDPSSPSPVPSSPRCPPFTPPPSPANDPDDDHSPSSSRAXXPRRAAESVILAFPGHQGSPPLVSHVVSAPESIELAPSPRVVLLRKRLKSSPDAR

SEQ ID NO: 189556 - protein, 107 aa, Triticum aestivum
  unsure (1)..(107): unsure at all Xaa locations
  Clone ID: PAT_TA_83974.pep
PPPRRPLPPRRPRPRPPRRWPSCRPPPRLXGPXXASXRXIPGXXQXVXSVQERRXXSLRXPXSXXRSPMXRXXPQSXXHPPSXXAQRXCTFGQRTDXXCPVGYXVGX

SEQ ID NO: 189557 - protein, 193 aa, Triticum aestivum
  unsure (1)..(193): unsure at all Xaa locations
  Clone ID: PAT_TA_83975.pep
GNLRSKQSQGSLVLLLKMQIFVKTLTGKTITLEVESSDTIDNVKAKIQDKEGIPPDQQRLIFAGKQLEDGRTLADYNIQKESTLHLVLXLRGGMQIFVKTXTGKTXTLEVESSDTIDNVKAKIQDKEGIPPDQXQRLIFAGKQLEDGRTLXDYNIKKDQPHLVLRLWWNEISSKSDGTYLESNIEIKSQEDPG

SEQ ID NO: 189558 - protein, 127 aa, Triticum aestivum
  unsure (1)..(127): unsure at all Xaa locations
  Clone ID: PAT_TA_83976.pep
DVDKRLNMVTEEIGVRSTEPNHIPSGPIDSDTVKPNVVEANITFQKPSSTDAIKLPTIPEGNFSTLETNNGFKQEAAPAKEILDVTSFRQRAEALEGLLELSAELLXNTVRLEELAIVLKPFGKARF

SEQ ID NO: 189559 - protein, 75 aa, Triticum aestivum
  Clone ID: PAT_TA_83977.pep
PFQQYKNSATVIMPETKDKGEKKNQSAPPPQPKDAHEHEEHHHGKDFAKRAGHAITFGAGATIGSDAVNGIIKNL

SEQ ID NO: 189560 - protein, 97 aa, Triticum aestivum
  unsure (1)..(97): unsure at all Xaa locations
  Clone ID: PAT_TA_83978.pep
MNAASTAAAAPAPAATVQVPRGQVDLIDFIDWTGVECLNQDSSHSIVNALKQSLRDDXGLYLXSDSDEQLLIYIPFMQXIKLXSXAIQSPEEEGPKQ

SEQ ID NO: 189561 - protein, 83 aa, Triticum aestivum
  Clone ID: PAT_TA_83979.pep
LGLTNATFVDIRFNSFYGELPAGVFCKLPRVQAIFVNNNRFSGALPDNIGQSPVNYLSLANNRFTGEIPRSIAPQRRHAPRGG

SEQ ID NO: 189562 - protein, 143 aa, Triticum aestivum
  unsure (1)..(143): unsure at all Xaa locations
  Clone ID: PAT_TA_83980.pep
ANFAAYTGLLQPNDRIMGLDLPSGGHLTHGYYTASGKKISATSIYFQSLPYKVSSDTGYVDYDKLEEKAMDFRPKLIICGGSACPREWDYPGSGPSAHKCGAXFLRDMAHITGLVSAHXXWFFXFPNVVTTTTXKILXGPXPV

SEQ ID NO: 189563 - protein, 191 aa, Triticum aestivum
  unsure (1)..(191): unsure at all Xaa locations
  Clone ID: PAT_TA_83981.pep
LLMGYQEIWSQAQSLFNQLGRMDSPTSSAFYNALTDMLWHFGQRQGAQLIVLKGVNLRVWENTWSEFCLXDLHLIHVVHSSNGHAWVPECASIVFRRTXMPDFLSILTGWGNHTRCRILASHLLNSNRPFRFTINIGSCTPTSGGCLETRTSTRYRHLAATQGARRHCALTRYRPVVTPRSLALKSRQRLF

SEQ ID NO: 189564 - protein, 89 aa, Triticum aestivum
  unsure (1)..(89): unsure at all Xaa locations
  Clone ID: PAT_TA_83982.pep
LEAITGRDPVDYGRPPNEVNLVDWLKMMVASRRSEEVVDPTIETRPSTRALKRALLTALRCVDPDSREETEDGQXVRMLESVIHSPXGG

SEQ ID NO: 189565 - protein, 130 aa, Triticum aestivum
  unsure (1)..(130): unsure at all Xaa locations
  Clone ID: PAT_TA_83983.pep
DRVMLETDFQNLPYLQAVVKESLRLHPPTPLMLPHKASSNVKIGGYNIPKGANVMVNVXXAVARDPKVWDNPLEYRPDRFLEENIDIKGQRLQGLPSVLAAVXPGPQLGINLRGSMIRHFLHTIALPGGH

SEQ ID NO: 189566 - protein, 89 aa, Triticum aestivum
  unsure (1)..(89): unsure at all Xaa locations
  Clone ID: PAT_TA_83984.pep
TXGGTILGQKVSXFCXFHXXQPDXFXLPMRENIDITYCFLLKTIYDQTYSKSGSMLSLNTTRYHTSACQPLQFEPSINTFLEYSCIWIS

SEQ ID NO: 189567 - protein, 78 aa, Triticum aestivum
  unsure (1)..(78): unsure at all Xaa locations
  Clone ID: PAT_TA_83985.pep
MTAGYIVGSLVGSFAIAYLCDTFISDKKAFGGSTPKTVSEKEWWQATDTNSKAWAPHCXGPPVVMNPSTAQNTSNPTD

SEQ ID NO: 189568 - protein, 94 aa, Triticum aestivum
  Clone ID: PAT_TA_83986.pep
PAPPPASSRIQLHVQPHCHSQAASSQGSTSNRSSQHQQAPRPATARARRGSWTPSRPPRRSATPSRDQVATASRPHQVTHPNRIEQVRNAATWV

SEQ ID NO: 189569 - protein, 65 aa, Triticum aestivum
  unsure (1)..(65): unsure at all Xaa locations
  Clone ID: PAT_TA_83987.pep
VADVWSCGVTLYVMLVGAYPFEDPDEPKNFRKTLTRPSYAVPDFVRFQWECRHLLSXVFVAKPEQ

SEQ ID NO: 189570 - protein, 79 aa, Triticum aestivum
  Clone ID: PAT_TA_83988.pep
LDADWYREYGIELILGTKVISVDVRRKTLDTSAGETISYERLIVATGARVCPHPIYACPCYFFFLPYILCAISYRPAGC

SEQ ID NO: 189571 - protein, 94 aa, Triticum aestivum
  unsure (1)..(94): unsure at all Xaa locations
  Clone ID: PAT_TA_83989.pep
SSFFFFFLDNKSAISLIKNPVHHDRSKHIDTRFHLIREYANSGQIEVKFIRTEEQLGDILTKPLGKLXFXELCMSRFGMPRSANPFTRRSILPP

SEQ ID NO: 189572 - protein, 128 aa, Triticum aestivum
  unsure (1)..(128): unsure at all Xaa locations
  Clone ID: PAT_TA_83990.pep
TXLXXMXKFKXLSXVWHXLXGYVFGLLPSXXXQXYSLWILAHXXYSGFLLXKQRSRGLLARGFHELDFSPHXTITPFCTLLXDCFRFRGTLATELSSLLPNFIFLLLRXHFQGWFAWFWQRTLAMRMD

SEQ ID NO: 189573 - protein, 46 aa, Triticum aestivum
  Clone ID: PAT_TA_83991.pep
DAALCLCTTIRARLLNINIYLPIALNLLITCGKHAPSGFQCPPLYD

SEQ ID NO: 189574 - protein, 55 aa, Triticum aestivum
  Clone ID: PAT_TA_83992.pep
FFWQISGFVIWSVFKVTHRILTSERDWTTVPVVVQLMIFEMGNVSAPWSTSGTVA

SEQ ID NO: 189575 - protein, 140 aa, Triticum aestivum
  unsure (1)..(140): unsure at all Xaa locations
  Clone ID: PAT_TA_83993.pep
MIIPKKNRNEICKYLFKEGVLYAKKDYNLAKHPQIDVPNLQVINSCKSFNPKEYVXREPSPGHYYYWXYLTNDGIGHLRNYLNSPSXXXPATLXESCQPPGRPFGPGLPGDRPRAQXFXTGQASFVTGWYVAPWAPVLWK

SEQ ID NO: 189576 - protein, 168 aa, Triticum aestivum
  unsure (1)..(168): unsure at all Xaa locations
  Clone ID: PAT_TA_83994.pep
ATASSMASAARFLVVVVVACALLASNNCHAGAPLGRHGRGPAAAGCRPWLPAVPTLPTVHHXTGGRCTYPAXPXSPXANTCRPCQRSPSAXRCAMPPSIXLPNXPATIPLXSXVSPKXLAAILXPNLTANXXXTLXGXXPXGXLKFLPXHHFTKXGTVCXGYVSNSML

SEQ ID NO: 189577 - protein, 93 aa, Triticum aestivum
  unsure (1)..(93): unsure at all Xaa locations
  Clone ID: PAT_TA_83995.pep
IRLPCHNCPALLRAVCCLLYSSCTAQFFFMTWFAIFQQISLEGDLLLKTRLVICFMLLGVLQRTFLAGSTENAKLGHKTCKXYQTLQRRTRSG

SEQ ID NO: 189578 - protein, 138 aa, Triticum aestivum
  unsure (1)..(138): unsure at all Xaa locations
  Clone ID: PAT_TA_83996.pep
MNDLMTKSFMSYVDLKKAAMKDLEAAGDGIELPEAGAGGVTDERLRGFFQDXEAVXAEMAAIRDRSTACTPXNXXGKSLRQVDXLXXERXRXXXDIVAVSXRPXXRARXSXGXANXAQRSFSGCPKXXAGRAVTRPEN

SEQ ID NO: 189579 - protein, 144 aa, Triticum aestivum
  unsure (1)..(144): unsure at all Xaa locations
  Clone ID: PAT_TA_83997.pep
RVQIPQSSCSTPLSSSNSAAMSGRGKGGKGLGKGGAKRHRKVLRDNIQGITKPAXRSLRKEGAALKRISGLIYEETPRRSPNFPSENVIPPTRSPTPXHLRXQTSTAMDVVFPLQPRPHSCYSRGPISFLRQRCCFPHFLLPLG

SEQ ID NO: 189580 - protein, 144 aa, Triticum aestivum
  unsure (1)..(144): unsure at all Xaa locations
  Clone ID: PAT_TA_83998.pep
MASIIVQAVVILLDVIAFGLGVAAEQRRSRATVTPDAAKEYDYCVYDSDIATGYGVRRAAXSAAAQVLLMLANRCFXCCGRXVXXGRSPACALILLLLQQGDFLXXPSFLLAGXITXAXHTXYRAYSTXXLSMQTVRKLPCWDY

SEQ ID NO: 189581 - protein, 144 aa, Triticum aestivum
  unsure (1)..(144): unsure at all Xaa locations
  Clone ID: PAT_TA_83999.pep
PHIGVVXFLXRQQXFRXRGXEIKQXVILAXTKXGVVAXMXRKQRRLPRKXGLXPXFQRXWRHPPGLAWLGGFDKAEDVGGEGADGGQPXSPAQWSAASLAPRLHGSPARWRGGGARARVLRRAVPERRRTVEPRGAVAGTRGPR

SEQ ID NO: 189582 - protein, 85 aa, Triticum aestivum
  Clone ID: PAT_TA_84000.pep
CAPHVISARDLLDLLKSMYPDYPCIANESILDRDHPAPMTSDKLKKIGWSCRPLEETIVDTVECCLRAGFLDHGWGRLPVASLLF

SEQ ID NO: 189583 - protein, 150 aa, Triticum aestivum
  unsure (1)..(150): unsure at all Xaa locations
  Clone ID: PAT_TA_84001.pep
XGPESXXAKPRPYXVSXSWRSPRAESRTXVNKDGEVTLSVRPRVRVXVXVSAGRIWQPAFLGPRVDQVLGGQGPSTTRQCRHCRKGPKMKREPGSPKDQERERVPWSGWCGVLEQVQVWMYYTRTSSRRTNGWMRALAAFRFSYCIKNGT

SEQ ID NO: 189584 - protein, 100 aa, Triticum aestivum
  unsure (1)..(100): unsure at all Xaa locations
  Clone ID: PAT_TA_84002.pep
VLTNXVXKQRVDLXTIDRVPIHARVAVQARTGQEHTHTHTEDNNITRQHTAALVGQAGRRHQWRRLPRRSATAGQRAAAKSDEETAAAPEAGLGAGASAA

SEQ ID NO: 189585 - protein, 124 aa, Triticum aestivum
  unsure (1)..(124): unsure at all Xaa locations
  Clone ID: PAT_TA_84003.pep
MAPTKKSKKSTESINNKLQLVMKSGKYTLGYKTVLKTLRNSKGKLIIIANNCPPLRKSEIEYYAMLAKVSVHHFHGNNXDLGTACGKYYKVCCLSIIXPSDSDIIIQPWAPEPAREPMQFAFQR

SEQ ID NO: 189586 - protein, 90 aa, Triticum aestivum
  unsure (1)..(90): unsure at all Xaa locations
  Clone ID: PAT_TA_84004.pep
KKNHFPKXQQTLSFVTXIPNXGSRLSXRNXTLPSFLVXQPGKFFKXRXXQNNREKTXXTCPQKFPHLLKXKXXPHCXPXTXXDXSXDXVX

SEQ ID NO: 189587 - protein, 70 aa, Triticum aestivum
  Clone ID: PAT_TA_84005.pep
IHSCRLKLFRIWSFRSIFFSTYCSSICNLLAAAHGCSNSKGLALERFSKPLYNVRRLIVAAFTMPGIYVV

SEQ ID NO: 189588 - protein, 177 aa, Triticum aestivum
  unsure (1)..(177): unsure at all Xaa locations
  Clone ID: PAT_TA_84006.pep
EIQLPQLDTSGLDLPFSEVEVWNAIKQSPPNGAPGPDGFSDVFYRQCLHIIKADLTRALQQFHDLNGGDSFKNLNAAMGGCSSQTLPDPTNIGTLYGPISLMHSFANLIGQILXTAPRPKAWYPVLPQRKCLPWTNASTNFCVKMSARLHPKKTCTAFKRYTKVSINPDTRRGAVPI

SEQ ID NO: 189589 - protein, 139 aa, Triticum aestivum
  unsure (1)..(139): unsure at all Xaa locations
  Clone ID: PAT_TA_84007.pep
MDNXYXVIVLGTGLKXCXXXGXLSVXGLXVLHMDRXDYYGGDSXSLXLXQLWKMFRGEXKPTAXLGAXXDXNVDMGPKFXMAXGTWVXLNHTDVTKXLSFXLWNYSQEHHVLHRMEVILMVNKHRNFVLKIMCHTGLAT

SEQ ID NO: 189590 - protein, 97 aa, Triticum aestivum
  unsure (1)..(97): unsure at all Xaa locations
  Clone ID: PAT_TA_84008.pep
KLHTLVLTNNRLTNLAEIDPLASLPKLQFLSLLDNTVTKQPDYRLYVXHKLKHLRLLDFXKVKQQERVAAAKKFNSXKEAEEEAKKVPGQNVYSWSA

SEQ ID NO: 189591 - protein, 116 aa, Triticum aestivum
  unsure (1)..(116): unsure at all Xaa locations
  Clone ID: PAT_TA_84009.pep
FSLISKASYENVSKKWVPELRHYAPGVPIILVGTKLDLRDDKQFFVDHPGXAVPISTAQGEELRKLIGCXAYIECSSKTQQXNIKAVFDAAIKVVLQXTKXKXKRKKKVQKGCTIL

SEQ ID NO: 189592 - protein, 63 aa, Triticum aestivum
  Clone ID: PAT_TA_84010.pep
NRCCMIVYWLVRLKNTGLDLDVNVCIVTGVPYLLTVLHITCLVLIRTDYVSSARLLYIYIVVI

SEQ ID NO: 189593 - protein, 103 aa, Triticum aestivum
  Clone ID: PAT_TA_84011.pep
ATVLLLLVAAAALAAPAAGHFESSCPFYDHGGHGEPHERHDHGHSCGGGADHEHHHHHHHGHGHGEQRLLPERLPGSGFPRSFRLRKTMTAPPPPPPSPHQRH

SEQ ID NO: 189594 - protein, 100 aa, Triticum aestivum
  unsure (1)..(100): unsure at all Xaa locations
  Clone ID: PAT_TA_84012.pep
MYFFQMRRTLARMRSPKRSRQSFFPRCSNKLDKIMDDEXELASLGRDASSERRRRFHDLQDALXKAFSEDKEEFNKTTTLSSSSSSTSTVARNLTGRPRR

SEQ ID NO: 189595 - protein, 71 aa, Triticum aestivum
  unsure (1)..(71): unsure at all Xaa locations
  Clone ID: PAT_TA_84013.pep
SHTHTHTDKWFPKPSVCTSNQLARAAAGSHHVGGEAPPLLQPPQEGRGAARRRVRVLPRPRWSPATGXGDR

SEQ ID NO: 189596 - protein, 102 aa, Triticum aestivum
  unsure (1)..(102): unsure at all Xaa locations
  Clone ID: PAT_TA_84014.pep
KKXXXGLXDXFXGIGYGPPXFSXKIALFXIKARPNPKVPRTGQXTLLGERAVDLIGGXPNLKGKXCKPFFPLENHPTXNPKLNYSLAYIMRVRPSRWMQSPQ

SEQ ID NO: 189597 - protein, 178 aa, Triticum aestivum
  unsure (1)..(178): unsure at all Xaa locations
  Clone ID: PAT_TA_84015.pep
KLNRXXGXXTINXPEAKCYXRHCXXQEFXRLDLIWIXXQXGLXXLRXPLEAVQRXIGRLRRXKXRXPXXTWPNLTXLEXVXPLAGVGXWITSRRCRRLTAXHRHRLGLXGRXGVPLAGDAGRRGGELGWSSPWSTACRGCGASRRRKASATPAASGSAAPSPWPLTAAVYYSGETLIS

SEQ ID NO: 189598 - protein, 75 aa, Triticum aestivum
  Clone ID: PAT_TA_84016.pep
YGVAGDQCVDFSMQYRNNIHPYSGPEFGFLPSQPVHKTSVNFHAVPVTPLTPLCSRGMPVATNQREAADPASSLN

SEQ ID NO: 189599 - protein, 142 aa, Triticum aestivum
  unsure (1)..(142): unsure at all Xaa locations
  Clone ID: PAT_TA_84017.pep
VNGNSPACPCGAPHYSLFVYEREKNKIDMACPATTHGRARTSLRSSVRPLLTLHRGATMGWPTTPLKASATARWLVTAAAGGPSSEGEQPKLGXYELRRXAPPSPHLGHNEADTRRXXISSGNTQAGXFSKXLHXXVDHLKL

SEQ ID NO: 189600 - protein, 55 aa, Triticum aestivum
  unsure (1)..(55): unsure at all Xaa locations
  Clone ID: PAT_TA_84018.pep
YXGKIPXVXSWAAEKAXXLGSXPXHGIPTEGCQKPHSRSRWRXHACKELGYFQAE

SEQ ID NO: 189601 - protein, 101 aa, Triticum aestivum
  unsure (1)..(101): unsure at all Xaa locations
  Clone ID: PAT_TA_84019.pep
MKGKANASKKDEARLRAGGGGAGKRKKAAASGKPKRPPSAFFVFMSEFXRQEYQAQHPWQQERCGRLAXQQXENXALFXEQENNPMXDQAWQEDQTYEKLK

SEQ ID NO: 189602 - protein, 141 aa, Triticum aestivum
  unsure (1)..(141): unsure at all Xaa locations
  Clone ID: PAT_TA_84020.pep
MVLSHASSGRDDDDAVASTFASRYVRERLPRYRMPERSIPREAAQQFISDXLMLDGXPRLNLAXFVTTWDGPDATXHHGSIKQXYFXXDXPFTTXLQNRCVNMIXHLFNRPFKEDEYWGRTWILGIQSGFKRNGRQEKTRN

SEQ ID NO: 189603 - protein, 184 aa, Triticum aestivum
  unsure (1)..(184): unsure at all Xaa locations
  Clone ID: PAT_TA_84021.pep
VVFERSQADVVAYALCLANIIVMVVWLSPDTGSTVSAAKSLLRLSDDEDEGSGGSSGAEDKCCVCLAGMREDQALRALPRCGTASTTMHRQVVKAHPTALCAGQRRXAXVQXRGRGSANXILPRXTTSLNDSXXYLXXDLWNXLGIWENCIYQXLSTXQIHXDXKXLXTXXKHSLXIXKXKKKK

SEQ ID NO: 189604 - protein, 79 aa, Triticum aestivum
  Clone ID: PAT_TA_84022.pep
VDSESFHTKYRRHEMRVRLSGGEPEKPLVIHVGRFGREKNLDFLKRVMERLPGARIAFVGDGPYRCTIPQSLAICYFFK

SEQ ID NO: 189605 - protein, 136 aa, Triticum aestivum
  unsure (1)..(136): unsure at all Xaa locations
  Clone ID: PAT_TA_84023.pep
MATLQLNHIARETSDVARLAAFYEAVLGFERIPSPTYSGFQVAWLRLPSSPDVALHLIERDPPAXVAVGPGAXRPPPFALPPGHXXAFSXADTTVXDRAEXXGRCFXKSQPDXRRXXFFXXLTEWLKFYVKEMNRT

SEQ ID NO: 189606 - protein, 157 aa, Triticum aestivum
  unsure (1)..(157): unsure at all Xaa locations
  Clone ID: PAT_TA_84024.pep
MIIYFLNVYSMCIETKVWRIEELCNVEARIFQCRRGARVHYSEDSQXPTEFLRHNXDTGGDKYWRDASASLAXRPFPGRQRHKGRWPHTPQRLRGVVERFTALTRGLGVELLRLLSEAMGIRPDYFEGDISAGDVVLNVNHYPPCPSPEKTLGLPPH

SEQ ID NO: 189607 - protein, 207 aa, Triticum aestivum
  unsure (1)..(207): unsure at all Xaa locations
  Clone ID: PAT_TA_84025.pep
MATDVAETPAPLVDAAPEAPADTPAAPAVDAKPAKAKKATAPKKRASPTHPPYARDGLGGDSRPQRERTGSSTLLLPISLEDKHKDXFPPTFRNFLNFNXKNSXPGGTDKVKILTTXSRNXPKRPXRNQTGXKTQGAAKXKHSPXNPTRKNPRGATPSNRTQTKDNKPQLKETRCGQTTQKAAPRAKQPEKVQPPRKAPKVQFKNGV

SEQ ID NO: 189608 - protein, 143 aa, Triticum aestivum
  unsure (1)..(143): unsure at all Xaa locations
  Clone ID: PAT_TA_84026.pep
MNSSKQALIYSFVAKGSVVLAEHTAFSGNFSTVAVQCLQEASPQQHQXTYSCDGTPSTSLRQPRLVFPXVXDKRPGRGPFVSLERLGKLHQYVHIKRAHRSYLRDFVPRYIPKTAQVRQIWLGIKQGNPYRRIAEWFGKWKNQ

SEQ ID NO: 189609 - protein, 152 aa, Triticum aestivum
  unsure (1)..(152): unsure at all Xaa locations
  Clone ID: PAT_TA_84027.pep
RKPKKERIQSKSNHRARLGAAGARRGQQAQESNPPTPQPGAPRFYKIRFPPSTVXVPGXXRFXLXLPHPLRFPSPTXGYFPTPXPPXPGLRSLXSKLAXGWPPRLKGALKLSSPPSFASGLGGRTFPRTCNLQGKTGXPRLXSPXPHLLFGT

SEQ ID NO: 189610 - protein, 178 aa, Triticum aestivum
  unsure (1)..(178): unsure at all Xaa locations
  Clone ID: PAT_TA_84028.pep
VRPFLAFLPEVQSADRKIPFREKVIYTVISLFIFLVCSQLPLYGIHSTTGXADPFLLGCVLPRIQTVGTVMEFGXTPXVTSXGMVMHSLXVRNSLEVDNSXRXDSLRPNGAQXXLXTLIAIGELWHSPCPGMFGMLXTLDRNATPTHFPWRDIAPSGDPKKYGGIPNAQYEDYQTKAG

SEQ ID NO: 189611 - protein, 112 aa, Triticum aestivum
  Clone ID: PAT_TA_84029.pep
PRRPPPPGSPASRAPPPPWPAASPRPPPPPPPPPPAPPPCSSPDAPNPYPRPVRKEASGHSGRFQTAQICQVHSRLGITQVIFMGAQKGFLLRYLDMSLLEFNAFGHIVSTV

SEQ ID NO: 189612 - protein, 98 aa, Triticum aestivum
  unsure (1)..(98): unsure at all Xaa locations
  Clone ID: PAT_TA_84030.pep
LAAGIKAAGRSMRGMFGRRAMNGGHRTXTVXRRVCXQSKVAQPQPPXCQPPSISSMAPPLSPLARCQQFAILHRHRAPFIISEGLVLRRWLGIHSFQV

SEQ ID NO: 189613 - protein, 91 aa, Triticum aestivum
  unsure (1)..(91): unsure at all Xaa locations
  Clone ID: PAT_TA_84031.pep
XCAHYNHQVLEXPYNNQAVSNFRWREDPXPHLIVTTXCFAATXPXVXMVQLYRCQIPEASCRSRRKPFGHIIRVXGYIIXRPXEQFRLLPR

SEQ ID NO: 189614 - protein, 89 aa, Triticum aestivum
  unsure (1)..(89): unsure at all Xaa locations
  Clone ID: PAT_TA_84032.pep
PPPLXGRPQVIIRTIPFQGAGLKAAVAVPETCPVRKNGRLPVMSSCLPTPSFSVDSYSSSLQGWCSLLRRSVNRNKNSVYSCTELCMFF

SEQ ID NO: 189615 - protein, 129 aa, Triticum aestivum
  unsure (1)..(129): unsure at all Xaa locations
  Clone ID: PAT_TA_84033.pep
HAGAMASRCLAAASEAAVVFLIRPILAIVFRLHPHPPRLGTWRGTTVLGARAAGCRRFARPAPRRXLLNPKPANRRPLAXFYXEPSPRPHKRTANPRRAPFKRILLHTNYQFPXYSXXXCILXMIRFPK

SEQ ID NO: 189616 - protein, 174 aa, Triticum aestivum
  unsure (1)..(174): unsure at all Xaa locations
  Clone ID: PAT_TA_84034.pep
ISNPRRRFFPDRRGHGEGVPPCRRWVFTPSTPTHRGTLPKALGALPSARVRAAPPSNSXRGNRPLXVVPCIXCRASSSXXNLXAGXVXRSGRPXRKTXLKGGPVPLPXMSLXXXMAPLXSDGNLGYQLXLENPFQRGNXKXRCLXXXTXXMTPYGITGVWYHXRNSXQXPFFSX

SEQ ID NO: 189617 - protein, 97 aa, Triticum aestivum
  unsure (1)..(97): unsure at all Xaa locations
  Clone ID: PAT_TA_84035.pep
SWWGFGILSSSLGCYPFPXXXGFVNSRGIFPFLTGWXXYPVGILMWHFXHKEXNLRIXPSSMGCSSRLSFARSGIXRTRSLSSWLWPYXSRTIHMVV

SEQ ID NO: 189618 - protein, 80 aa, Triticum aestivum
  unsure (1)..(80): unsure at all Xaa locations
  Clone ID: PAT_TA_84036.pep
MGCSSSVPXRNTXGLXTXSXDSSXTPSSKXLRAKLVLLXGDSXVGKXCIVLXFVRXQFXXXSMVTVXASFLAHXLXLEDS

SEQ ID NO: 189619 - protein, 94 aa, Triticum aestivum
  unsure (1)..(94): unsure at all Xaa locations
  Clone ID: PAT_TA_84037.pep
LLHRRRKRLRQTRNPKDFQEPXDYGLRVXAKTTNMPRXTPTLTIPXQEXMIRSLXYNEXDGGRTTILXSFKXRGTPXNXNTGXSRDVGYSQCGG

SEQ ID NO: 189620 - protein, 77 aa, Triticum aestivum
  unsure (1)..(77): unsure at all Xaa locations
  Clone ID: PAT_TA_84038.pep
WTTTAAAKNDTQRFRPGDELRRYRRVQALLKRLNKPALRSIQPAFDHPKAAKARGHWXAGPPPARPKGNRLRDPDKN

SEQ ID NO: 189621 - protein, 121 aa, Triticum aestivum
  unsure (1)..(121): unsure at all Xaa locations
  Clone ID: PAT_TA_84039.pep
SXTRGXAXPGTVXRGTXQPNXXADXRPPFXGSRRGEFRRSAQMRRXNGRXTMXVSLSLQTSSLHSVAFLFVVKEEEEVSPCCSAPCPHAQEHEFTTPNRKGRRRWTTPIDGRTRSATIAAA

SEQ ID NO: 189622 - protein, 38 aa, Triticum aestivum
  Clone ID: PAT_TA_84040.pep
YSDNQQPSNRSPYSRCQKTKTIIEMYIRARKYQGDFTN

SEQ ID NO: 189623 - protein, 69 aa, Triticum aestivum
  Clone ID: PAT_TA_84041.pep
RIVPRHVLLAIRNDEELGKLLTGVTIAHGGVLPNINPVLLPKKTAEKASNGGSKEAKSPKKAANPPKKA

SEQ ID NO: 189624 - protein, 174 aa, Triticum aestivum
  unsure (1)..(174): unsure at all Xaa locations
  Clone ID: PAT_TA_84042.pep
DMEIFSMYGVGIPTERAYVYKLAPQAECYIPFRIDTSAEGGEENSCLKGGVYLADGDETVPXLSAGYMCAKGWRGKTRFNPAGSKTTXREYTTPPPLLSLGRQGHPRAVHMFDIMGELAPNXDSXRIXLGATXXEXXGDSVYPNISNGQKQELLPKGIKIPTFMRPNVRMHPVC

SEQ ID NO: 189625 - protein, 52 aa, Triticum aestivum
  unsure (1)..(52): unsure at all Xaa locations
  Clone ID: PAT_TA_84043.pep
SVXILXSVIVSSSXXHXIDPPRMFTXLXVDTFXGLPSFXFXXXGNFXXCIXX

SEQ ID NO: 189626 - protein, 144 aa, Triticum aestivum
  Clone ID: PAT_TA_84044.pep
IIILSTVRSNSVGKVGFLSNAQRANVCLTRARHCLWILGNATTLASSGSIWSDLVRDAKDRRCFFNASSDYVISHVIAKQRRDLDRVNVEKSIHISSSKNCRVWVETRSPNDLNEQGTSSTSVSHYAGIPSSDIVVVLNSTSKQ

SEQ ID NO: 189627 - protein, 118 aa, Triticum aestivum
  Clone ID: PAT_TA_84045.pep
LPFLLIHGEPRPNIWDTLEGKWRLRQSLCRWAVEYSICKCLIVQHSLLLGRKTDRLSRAARYFDPALLPCTNLVLNKAGRNVHLPVEQRNLHSIYVQTSLHVPSILGKTEYLYQSILD

SEQ ID NO: 189628 - protein, 59 aa, Triticum aestivum
  Clone ID: PAT_TA_84046.pep
QQEVYLFIKNANTGRYRKNKLQRAKTQAADRSAWQQQQQQRTSSTYLINPFQLMEGKLN

SEQ ID NO: 189629 - protein, 83 aa, Triticum aestivum
  Clone ID: PAT_TA_84047.pep
GVLEMLPFAPHVSTALYLLNAKRGKYTKGVCGAVDLLPIRESCEESINDFNLAYVSVALPVSTTRHLVIHSRFWPVSGCGSML

SEQ ID NO: 189630 - protein, 109 aa, Triticum aestivum
  unsure (1)..(109): unsure at all Xaa locations
  Clone ID: PAT_TA_84048.pep
LSPRVPRXLXSTFXSXAGARCFGPAARCXATAXXGVAXAXPPXSELXXIRWGXAKLXGXRDXMXDEVXLRPXSLLXGFXFXAVLDXHAXFSDVQFLRDXLXKECXAXVG

SEQ ID NO: 189631 - protein, 178 aa, Triticum aestivum
  unsure (1)..(178): unsure at all Xaa locations
  Clone ID: PAT_TA_84049.pep
EKKKSRYIQPPANRPGTLVGDTRVQFHNDQTHLLVVHESQLGIYDGNLDCLRLWSPRDALPAPISSAIYSCDGLLVYAGFCDGAIGVFEAESLXLRCRIAPSAYIPPSILACAGRVYPLVVAAHPWEPNQIAIGMNDGXVHVVEPLDGDRMGIGTPQDNGGTAPHQRYNGTSTHNKHL

SEQ ID NO: 189632 - protein, 138 aa, Triticum aestivum
  unsure (1)..(138): unsure at all Xaa locations
  Clone ID: PAT_TA_84050.pep
MGTKKQGGGGGDQKVLLWRLPEVTSKELGKIGPALGIGIGCGAGAGIGFFGGAGLGYGFPGLTLGFGVGAGCGVGIGFGYGLGKGIAYDEKKXYSNVGKXVPXTPHFPMDTVGALFDXLVIXTKKLVTSTSKRIXKWR

SEQ ID NO: 189633 - protein, 157 aa, Triticum aestivum
  unsure (1)..(157): unsure at all Xaa locations
  Clone ID: PAT_TA_84051.pep
MEPATWAVFLGIALCAAAALFLSRGRRPVYNPPPGPKPWPIIGNLNLMGELPHRSMNELSKRYGPLMQLRFGSLPVLVGASVEMAKLFLKTNDAAFSDRPXFAIGKYXAYDXSDLLRAPSGXLRQASXICATNSRQADPSTLATRSSNSQALATSVH

SEQ ID NO: 189634 - protein, 115 aa, Triticum aestivum
  Clone ID: PAT_TA_84052.pep
MGFHLPPLVDGMGMGMPAAMDCGALGHDHRVAGGNNNGQAAAAAAGMANGCCYGQLQKQQEEEQQPSLGQEDQWDDESARHLLMWDDDQELTPSNLEAMESTAHSLLFMGPNDHT

SEQ ID NO: 189635 - protein, 138 aa, Triticum aestivum
  unsure (1)..(138): unsure at all Xaa locations
  Clone ID: PAT_TA_84053.pep
MALYLLFESASGYGLFHAYGIDEIGQSVEAVRSSVLDLDRFGKAVKLTAFNPFSSAVDALNQCNAISEGIMTDELRSFLELNLPKQXEGKXKAKYSLGVVEPKVGSHISXVTGIPCQSNEFXQELLRGVRLHFDRSST

SEQ ID NO: 189636 - protein, 109 aa, Triticum aestivum
  unsure (1)..(109): unsure at all Xaa locations
  Clone ID: PAT_TA_84054.pep
RYMTPAEVRXFPASHLFSFNQMERRLMKLAQAKARRATARGKLPPPPPTPMAPKPPAPATRSAAAADDEEAVDGAVPVPPEAVNISLPLIAAGPSRWVVWLAHWLPRSL

SEQ ID NO: 189637 - protein, 92 aa, Triticum aestivum
  unsure (1)..(92): unsure at all Xaa locations
  Clone ID: PAT_TA_84055.pep
FXXXSINXGRGAEFXGXXIXLXFHLXTTRTXKVSALREAFYRXQNLPNVTNLLATVLXFLIXIYFQGFRVVXXXRSXNARXHEXLIPKFGSI

SEQ ID NO: 189638 - protein, 81 aa, Triticum aestivum
  unsure (1)..(81): unsure at all Xaa locations
  Clone ID: PAT_TA_84056.pep
XRSNVIAPYTXMXXELGXXGXSVARPHPLLSSLCYDXAMKGXREQLCCCCCWWWYYQYGYXALATPPPLVLRHPVQIRTCL

SEQ ID NO: 189639 - protein, 65 aa, Triticum aestivum
  unsure (1)..(65): unsure at all Xaa locations
  Clone ID: PAT_TA_84057.pep
EXSGFPSKXXPXMYXIQXYKECDARRREAAXAXRARAPPRQELKTLSGMVFXAGRCYTCSAXFXT

SEQ ID NO: 189640 - protein, 37 aa, Triticum aestivum
  Clone ID: PAT_TA_84058.pep
KARGRAADKAKGKFTADDVAAAAAGGAATGASLQEID

SEQ ID NO: 189641 - protein, 108 aa, Triticum aestivum
  Clone ID: PAT_TA_84059.pep
VCSRLLPVGNSVTRPRLCVASARPAGRRVRLLSVRCEQGAKGGGGLDVWLSRGAMLGFVGAVAVELTTGKGVLQNVGLTAPVPTLALALTGAVGVLTAFLIFQSGTRD

SEQ ID NO: 189642 - protein, 56 aa, Triticum aestivum
  unsure (1)..(56): unsure at all Xaa locations
  Clone ID: PAT_TA_84060.pep
IIXCDXNRRVXQQFXLQXQRSXYLDXNLLRXLLLVXXTXEHXSEXXXETVTGGRVA

SEQ ID NO: 189643 - protein, 57 aa, Triticum aestivum
  Clone ID: PAT_TA_84061.pep
PMFGCTDATQVINEVEEVKKEYPDAYVRIIGFDNMRQVQCVSFIAFKPPGCEESGKA

SEQ ID NO: 189644 - protein, 100 aa, Triticum aestivum
  unsure (1)..(100): unsure at all Xaa locations
  Clone ID: PAT_TA_84062.pep
LESISEGVPMICRPHFGDQMINARYVQEVWKIGFVLEGKMDRDNIQRSVKKLFCHKEGGXMRRRANNLKDKATQCIKKGGSSQTGIDLLVNCIMALPSSI

SEQ ID NO: 189645 - protein, 188 aa, Triticum aestivum
  unsure (1)..(188): unsure at all Xaa locations
  Clone ID: PAT_TA_84063.pep
MNSAFSGSSEALLDHQRTKDGSDKGEPELGRNGHDGVLSSEAAAAGDCSSKRTSDSKKRRRPNEVMGGDQVQSSNLPADSANESVHSKDKGEESSLATTTTGPGNRKGKGAKETSESQKEDYIHVRARRGQATNSHXLANVXXGKXXREDELLQDXXPGCRXSLEXVILXDXNLSSCKTIQFYELENQ

SEQ ID NO: 189646 - protein, 106 aa, Triticum aestivum
  unsure (1)..(106): unsure at all Xaa locations
  Clone ID: PAT_TA_84064.pep
ISLPTAAAATATRSRAGSNSKQHCPCFYRSPSALPLSPSISCTTGQPLPLSRCPGLHRSLVSSSPALRRRQAPPVLMLPXARLVNHTGKNGDGVLXLGLLRCMLLP

SEQ ID NO: 189647 - protein, 162 aa, Triticum aestivum
  unsure (1)..(162): unsure at all Xaa locations
  Clone ID: PAT_TA_84065.pep
LGLTFSNEAGTLPPCGTGGQCCIWQFNFRGFNPHTDPYSPDSIDLLRRSGIDFDLFAVEGVDSTRFAELMMSSGIVLNDDVQWVTFHGSHDFGYLLRLLTGREMPXTLDEFLKLTKIFFPVMYDVKHLMKFCGXGLYGGLXRLXKLLKVKRVGTXHQAGSDR

SEQ ID NO: 189648 - protein, 46 aa, Triticum aestivum
  Clone ID: PAT_TA_84066.pep
EQLGPQLLYTIFSSVCVVASIFVRRHVLETKGKTLQEIEVSLLQPQ

SEQ ID NO: 189649 - protein, 98 aa, Triticum aestivum
  unsure (1)..(98): unsure at all Xaa locations
  Clone ID: PAT_TA_84067.pep
GTCRRTPSTPAPPPGPPSSSTPSTSRPSYLLRTLACDSGPWLLVRPSISPXALYTPCLSSLSGIRICXAXFTTKVSKFHRVVGSRIXMCRXHVXRPFL

SEQ ID NO: 189650 - protein, 59 aa, Triticum aestivum
  Clone ID: PAT_TA_84068.pep
LVGHVHVKEEHDSAVGSSHLHASVRQPPPITAEVSQMEGFGMLLTKKAGIQWTQREDVS

SEQ ID NO: 189651 - protein, 99 aa, Triticum aestivum
  Clone ID: PAT_TA_84069.pep
FFSRCARFFSIDGRYTRLSMVRNQPKKKTVACMKHRLIRHAWLTQRVCCQTPSETVDHHASNQPKLGFLGKRSLLCLRKRGQRATLFMSRRSTASKLPI

SEQ ID NO: 189652 - protein, 153 aa, Triticum aestivum
  unsure (1)..(153): unsure at all Xaa locations
  Clone ID: PAT_TA_84070.pep
RQQEQANRQDQLSSQFASKAQVGPTPALIKAEVPWSARRGNLSEKERVLKTVKGILNKLTPEKFDLLKGQLMEAGITTADILKDVISLIFEKAVFEPTFCPMYAQLCSDLNEKLPTXPSEEPGGKEXTFKRVILNKCXEAXXGXSNLRAEIPN

SEQ ID NO: 189653 - protein, 95 aa, Triticum aestivum
  unsure (1)..(95): unsure at all Xaa locations
  Clone ID: PAT_TA_84071.pep
LDWASRGKNCWADKPAAIVSAGGGFGGGRSQYHLRQVGVFLDLHFINKPELCVQAFQQPPKFDSDXNLVDAEIXERLXKVLLXLQAFTLXLQKED

SEQ ID NO: 189654 - protein, 83 aa, Triticum aestivum
  Clone ID: PAT_TA_84072.pep
QGLDVILGMDFLSMYGGNIDCTSKSILLTTPEGKRIKYVSRHAPKRTQVNSLSGVVQEEVPVVKDYPDVFPEELPGMPPDRDI

SEQ ID NO: 189655 - protein, 170 aa, Triticum aestivum
  unsure (1)..(170): unsure at all Xaa locations
  Clone ID: PAT_TA_84073.pep
MAKGKRWRFAMVCSSNMNRSMEAHSQLGRAGLDVESYGTGTHVKLPXPSLHEPNVYDFXTPYXAIYDDLRRKDPXLYKRNGLLPMLKRNTXGELAPQXVGKTMXXTGCFDMIMXXAERXFDXVXXNIXNRXRGYECVLIINMIQRYNWCWNLRKFAKTLTIDTGRILLIR

SEQ ID NO: 189656 - protein, 193 aa, Triticum aestivum
  unsure (1)..(193): unsure at all Xaa locations
  Clone ID: PAT_TA_84074.pep
RRSXXIXPLAIGTAPXXFXFXCLSLNHAEXIKLYIIMGFAKVSSLFEVQRDKLTVSKQRVGNLSIILHAPPPAEVGPTRTVQPGGKWTAKSLPATHVLQGPSKAVAGRSSWCRLGCGIWGYLLSSSLLRHKDVLSVSKITVDDWKCKMARGLLQAVIKFPQAASTQAPKSLMAVRRRTVRMPMPRHCCDVPSL

SEQ ID NO: 189657 - protein, 95 aa, Triticum aestivum
  Clone ID: PAT_TA_84075.pep
CWLTLGLEHPHQVFEDPVSTMRFQVLPPNHDGRDVGDILVSDRARADGIDVERILSIDLADTGLALLDDGLDGAGLDDVLQGKNGSLGPGLKGRC

SEQ ID NO: 189658 - protein, 42 aa, Triticum aestivum
  Clone ID: PAT_TA_84076.pep
MAPPQPKSGLFVGINKGHVVTKRELPLRPSHRKGVSQLSAFF

SEQ ID NO: 189659 - protein, 149 aa, Triticum aestivum
  unsure (1)..(149): unsure at all Xaa locations
  Clone ID: PAT_TA_84077.pep
MRPLDEKETTQVFEKLFKFTGPNLKHLLERPAVEGPDAEPGRYCLRLHRNRVYYASEALVRRATAVSRPRLAXRGDAHRXFTHHGAFHLTATRSTPRXTARRRVWXKPDTERPFXLGFRAKSSXAXITXNTKRGRVAXSMVXPLGSDEP

SEQ ID NO: 189660 - protein, 81 aa, Triticum aestivum
  Clone ID: PAT_TA_84078.pep
SSKTSGWCWILCVAIDLIVKPVDGVGYYELEMMRKQMSSWLDSDSLYTPWGLIVHSKFMFICKCTFIVLCEHCCVLYLGWS

SEQ ID NO: 189661 - protein, 58 aa, Triticum aestivum
  unsure (1)..(58): unsure at all Xaa locations
  Clone ID: PAT_TA_84079.pep
MSRPXDGXRSFFXMGNPXRMILPRGARLSPKLXELLTSYXDGXASNXREXKPXXTXRF

SEQ ID NO: 189662 - protein, 176 aa, Triticum aestivum
  unsure (1)..(176): unsure at all Xaa locations
  Clone ID: PAT_TA_84080.pep
LIIXIVFDAPXRTFSPILXIXLWDXPARXSXMPGXYXXXLXISLPLVSXXDXXQLVLXSCMPXTXPPENQXGQELRSXITSDYHVDXVTSGTWMVVSWPWTAHTTDAPRPVPRRSLERTVVARSGEDLTVRREDDDGIAQQMRCPGWGGEETQASGKEATGKARPAAMTIRDGGGG

SEQ ID NO: 189663 - protein, 100 aa, Triticum aestivum
  unsure (1)..(100): unsure at all Xaa locations
  Clone ID: PAT_TA_84081.pep
GQLGQHQPSQGGNNAGSATGTRGNPSLDTLMSMLSGLGSGGGLGVPNTSSVPPEELYATQLTQLQEMGFIDTAENIQALXVATAGNVHAAVERLLGNLGQ

SEQ ID NO: 189664 - protein, 55 aa, Triticum aestivum
  Clone ID: PAT_TA_84082.pep
LLQYACAGRRRRALPLVSFCSSDACFKASMDALRICVLISRVREPDRRGCCFIFT

SEQ ID NO: 189665 - protein, 151 aa, Triticum aestivum
  unsure (1)..(151): unsure at all Xaa locations
  Clone ID: PAT_TA_84083.pep
FLLSGLTYRIILHGHPRLAADHQGCRPGRHPGKPSRVCFVLFSGFFARTNLQSFRVESRIMVPCFFSLPPNATGSGILPRTPQIRAAWIRVGLLGKTASSRPMWPPPPPRGTTTQFSPLPMILLGCNGLRGVVYTAVXSTRGCEVXGELGM

SEQ ID NO: 189666 - protein, 101 aa, Triticum aestivum
  unsure (1)..(101): unsure at all Xaa locations
  Clone ID: PAT_TA_84084.pep
LITNCRQVIVLHSIIQILNWNQTKCSMNRAPKTCTGRTLTPPGAQRHKNTGNDIPLNMKRLAWEAXKVARGFXGRRPDLAGTTSGTXXXGFXTALGXXPLA

SEQ ID NO: 189667 - protein, 154 aa, Triticum aestivum
  unsure (1)..(154): unsure at all Xaa locations
  Clone ID: PAT_TA_84085.pep
SHIHSNQSLFYPTSQLFFHTSHNGCSEDHHLRGQRPLSPGRPKGHHPIHRLGSRTSPSLTTRATIPTVRPAWVLPSVNIGCLARHQRVGMRVLPQMKAGEKPSSDIIPGLRYGAVGSPXQPSQASPLXGLXPRVNXSQLLRTFHXFWKXXXRLX

SEQ ID NO: 189668 - protein, 91 aa, Triticum aestivum
  unsure (1)..(91): unsure at all Xaa locations
  Clone ID: PAT_TA_84086.pep
GXXLSTHLGGLWHLXYSRTCLSTHLGFQDLPVFLQXATXAXXDHXVIHARNFRVQPHAIMRSSIVXXVLRILQGXTSXCRGCTXXTVYPPM

SEQ ID NO: 189669 - protein, 124 aa, Triticum aestivum
  unsure (1)..(124): unsure at all Xaa locations
  Clone ID: PAT_TA_84087.pep
KGLGKGGAKRHRKVLRDNIQGITKPAIRRLARRGGVKRISGLIYEGDPRRAQRSFSENVIRDAVTYTEHARRKXPVTAMDVLYALKAPRARTLLRFEALGPPSYPGTGLRECLLCDLSGGNIAA

SEQ ID NO: 189670 - protein, 127 aa, Triticum aestivum
  unsure (1)..(127): unsure at all Xaa locations
  Clone ID: PAT_TA_84088.pep
MADQLTDEQIAEFKEAFSLFDKDGDGCITTXELGTVMRSLGQNPTEAELQDMINXVDADGNGTIDFPXFLNLMAXKMKDTXSEEELKEASASXTRTKNXFIXGAELXXVMTNLXGEVXXDEVDEMIR

SEQ ID NO: 189671 - protein, 105 aa, Triticum aestivum
  unsure (1)..(105): unsure at all Xaa locations
  Clone ID: PAT_TA_84089.pep
MSRGGSAGGXQSSLGYLFGXGEPAKPAAXXXAXXEPAEKQEXEXAXVTKXIXXGIXGSRANNXYXEYGQNTEXXLRDRPSTKGHAAPXGGSXXGYLXGRKLLMML

SEQ ID NO: 189672 - protein, 94 aa, Triticum aestivum
  unsure (1)..(94): unsure at all Xaa locations
  Clone ID: PAT_TA_84090.pep
KEXPLGTVFXKEMLRLVFAPVKGRRVXXVQPRSLEVFKANFQRTSXMRSGKNGEVAXXGPSRRPSPXPGKLLAQGXAQRMPRLSIVYCCVCPVV

SEQ ID NO: 189673 - protein, 138 aa, Triticum aestivum
  unsure (1)..(138): unsure at all Xaa locations
  Clone ID: PAT_TA_84091.pep
VFFESSLQRHPRFTTESLEKNKQIYLKIEDLAKKYQCSPAQLALAWXVLRQGDDVVPIPGTTXTKNLDANVXPWKVKXTAGGXLKEIXSQILQKDVVGXKTYIPYAXSLGKYASTPKSEFALELGIVCNVDPLHPILR

SEQ ID NO: 189674 - protein, 149 aa, Triticum aestivum
  unsure (1)..(149): unsure at all Xaa locations
  Clone ID: PAT_TA_84092.pep
HYNVHSIDNELEDRTQIKPIVRTSLFLCSSVYIATSFFAYLLFGEGTLDDVLANFDANLGIPFSSVFDDIVRVSYAAHVMLVFPIVFFALRLNXDGLLFPTSRHISRDNKRFXIITVSLLASNYLXAFSIPXIWDASXLLVQNXAVLIG

SEQ ID NO: 189675 - protein, 195 aa, Triticum aestivum
  unsure (1)..(195): unsure at all Xaa locations
  Clone ID: PAT_TA_84093.pep
VEQRLRADAPAAEAGRPDRGRAGRRRRPGAPSGSSSTPSSGMSIKGRVGHIXHQNMRFXAPPHTAQRFDEHSDIXVLSSSXEGXERVPESXRQRFRPXTTLKPXNKNLIXTRHPKETIRLTGQPRFMFXRPXRXPVVWKLLGTRXRYTNVANSXPKXSGKXHYNSWHQXXPXXXSIQMXXXYDKXIAXVTXMXQE

SEQ ID NO: 189676 - protein, 203 aa, Triticum aestivum
  unsure (1)..(203): unsure at all Xaa locations
  Clone ID: PAT_TA_84094.pep
LQQALAMAEHFVLCPVMAVLLLSMDVLGAARRRLQAAAGDVRVRRLRRWTSETTTTCRERASPRANRPTTGPTPPAGFPPERLSNGYNTARFNCKVHRFXXQPPAVPVAAGEQQAAAAASGPXGLTIXVKYLPEGAGPRSXNAXTHPLSNKCIXNXQAXXFXGVSTXXACXRXXXLLGGTLXXRXDGAEXRXTXTNXXXFXGA

SEQ ID NO: 189677 - protein, 77 aa, Triticum aestivum
  unsure (1)..(77): unsure at all Xaa locations
  Clone ID: PAT_TA_84095.pep
KKPSFDIVTVCPPLVLGPVSKHLATLESINTSNERIVKLLRGGWKDEIPPCTPVPLWIDVRDAAXRAHVRASKRGPV

SEQ ID NO: 189678 - protein, 80 aa, Triticum aestivum
  unsure (1)..(80): unsure at all Xaa locations
  Clone ID: PAT_TA_84096.pep
MPTIIVSVDLECSRCRAKIHRVXNRIXXKGXFCIDDIDFDXKNNKVXVTGPFDPXKLADKLXCXAXXIIXQXEIAXSXPR

SEQ ID NO: 189679 - protein, 88 aa, Triticum aestivum
  unsure (1)..(88): unsure at all Xaa locations
  Clone ID: PAT_TA_84097.pep
SCRHEVGLXXVWGQILPXPFLXRLIXRXIFXRAXLFYFHSDXHEYLXPCLPTLPESVSPHAXAIXXPILXLXXXLSAATGLTSDSTRN

SEQ ID NO: 189680 - protein, 165 aa, Triticum aestivum
  unsure (1)..(165): unsure at all Xaa locations
  Clone ID: PAT_TA_84098.pep
LWLLLTGKVPTKEQVDALSKELLARSTVPAHVYKAIDALPVTAHPMTQFTTGVMALQVESEFXKAYDNGIAKIKVWGATYEDCLNMIAPVPTXGSYVYRRISKGGKSIRNWTFXXIMRNFSHXLGLDDPKMLELMRXLVTSHXHEGGSQSNGTGGKGLQILLLRV

SEQ ID NO: 189681 - protein, 136 aa, Triticum aestivum
  unsure (1)..(136): unsure at all Xaa locations
  Clone ID: PAT_TA_84099.pep
MSDSEASPPPTPAAATPAAPVETSPSSARKEELLPVEEKISELSESQSRVLGRSRGXKEVLLXWRSNLDPKVTKYKVGSLTSKMHSXXEISXSLRFQRVKTXLKEHRKSVTLLGNLGFKDATXNDGNKERRTMLVN

SEQ ID NO: 189682 - protein, 178 aa, Triticum aestivum
  unsure (1)..(178): unsure at all Xaa locations
  Clone ID: PAT_TA_84100.pep
DLGRRAGVPCDSWRLAVETYNKRDWTTVPASCERYVGHYMLGGHYRRDSRVVIDEAIAYAEGLKLGGNGKEVWVFDIDETSLSXLPYYATHGFXGTKLYNATSSNEYVLGGGARXAPRRRNGVXRTLSLGIXPVFLTAAXGQXASPSQLRRXGIRWMTCVNPRLKARIPKGTHQDPVT

SEQ ID NO: 189683 - protein, 182 aa, Triticum aestivum
  unsure (1)..(182): unsure at all Xaa locations
  Clone ID: PAT_TA_84101.pep
QNESRSDAEKITNTFIFNTFVFCQIFNEFNARKPEEKNVFKGVTKNHLFMGIIGITTVFQILIIQFLGKXFKIVRLXWRLWLXVQVAIRLVSWALXAYVGKFIPXVPVKTSSXTISKPRCCWETARRDXEEGGXSSATMGSVNRHVINGDNCGDPVTWGLPGGLVLQETGESKQVTLPRPRA

SEQ ID NO: 189684 - protein, 127 aa, Triticum aestivum
  unsure (1)..(127): unsure at all Xaa locations
  Clone ID: PAT_TA_84102.pep
SHHPHHLPLLPTLELALTLVEDHFATXGEGLAVVGYYHANPRCDDTELPPVAXRVXXHIFRYFPRSAXLXXDNKKLGGXPSRGXFWMPVIKLXPXDSTKNWRQGGXXDXXIKLILKRXSXNVVLXXY

SEQ ID NO: 189685 - protein, 29 aa, Triticum aestivum
  unsure (1)..(29): unsure at all Xaa locations
  Clone ID: PAT_TA_84103.pep
KVKPSSPAELEGLLDXAXYTKHCEEEDAH

SEQ ID NO: 189686 - protein, 139 aa, Triticum aestivum
  unsure (1)..(139): unsure at all Xaa locations
  Clone ID: PAT_TA_84104.pep
RERERKASYLAWSAAARRQXAVCWRCCFSSWGXLRRRXRPASCRXIPPPWLAWTSSXGSLAIXVXGILCGETCVFLACXXGAMXCQCIGQICMXVISGLTQXGIXXXEXHXDGXXVFXLXHXYXXLISTXLSXXMLVFT

SEQ ID NO: 189687 - protein, 95 aa, Triticum aestivum
  Clone ID: PAT_TA_84105.pep
LDALYRHKYRHATLVLSQDGSTVHSMAIPTQCTIAGHRKQHGDPYNIKPQNLTDLSFQWTQEACLDGLCTLTFGLFLRASLRSSTLTFSLRSVMT

SEQ ID NO: 189688 - protein, 136 aa, Triticum aestivum
  unsure (1)..(136): unsure at all Xaa locations
  Clone ID: PAT_TA_84106.pep
MPVSRIAVGAPGELSHPDTAKAAVAEFISMLIFRLPPAQGSGMASSKSRTAAHHPARLIRASLGRTPRLFRGXPLGATSPGGQRYPARDFPGFWWAEHQLXQGLXYWXXXSLVRSRCSSKATAGGIWLLAVRRPHS

SEQ ID NO: 189689 - protein, 116 aa, Triticum aestivum
  Clone ID: PAT_TA_84107.pep
VLPLATSLGFELATPFPQWHRRGLPVFQGSEHLLRTDPEDGLEGFFIALFVRKAGPTSEEPSEDATVEVRTKQVRGRRNGGQAFSSLRLSKDDPLVTKGVLGFNLMYHCYFWESMW

SEQ ID NO: 189690 - protein, 126 aa, Triticum aestivum
  unsure (1)..(126): unsure at all Xaa locations
  Clone ID: PAT_TA_84108.pep
GLEALQAQVMEQPMYMDPSLPLPQARSKQQXKQQAGGGSKEQEYGGFPCLLFNCFFLVKLLIXEKXPPPLGIAXFRRYGRETFVYPSSPVXPXRSXXPSTXPEPLLGXFPSNFXKVVHRWVPPQKK

SEQ ID NO: 189691 - protein, 92 aa, Triticum aestivum
  unsure (1)..(92): unsure at all Xaa locations
  Clone ID: PAT_TA_84109.pep
FXTSVVFLHSIDHXTXAAXGVDXLSXPXXXAXVGTFFSTTTXSPVLPDRSDPVHPLILXXXSXSIRXXHGSLSRXXHSSXVXXFSLSLLSLS

SEQ ID NO: 189692 - protein, 104 aa, Triticum aestivum
  unsure (1)..(104): unsure at all Xaa locations
  Clone ID: PAT_TA_84110.pep
MVSLTLGPLLHSKKLARPSRRTCSARATPSPPRPRTPRGPSPRSRPRPPPPPPCSPPASXRISAKASPSXGPPPRSPPPRXYPXGSRPRRTASSKRKRHRLDDS

SEQ ID NO: 189693 - protein, 59 aa, Triticum aestivum
  Clone ID: PAT_TA_84111.pep
DNKKTRIVPRHIQLAVRNDEELSRLLGTVTIASGGVMPNIHNLLLPKKSGGGSAKAAAG

SEQ ID NO: 189694 - protein, 127 aa, Triticum aestivum
  unsure (1)..(127): unsure at all Xaa locations
  Clone ID: PAT_TA_84112.pep
MQIFVKTLTGKTITLEVESSDTIDNVKAKIQDKEGIPPDQQRLIFXAGKQSKDGRTSPTTTSQKESXTLHLVSAFXGGAKEAQEEDVTKPKKFKHKHKKVXGLLQFYRFTTQRXSNRFRKXAPTMGA

SEQ ID NO: 189695 - protein, 105 aa, Triticum aestivum
  unsure (1)..(105): unsure at all Xaa locations
  Clone ID: PAT_TA_84113.pep
LNNIRKMRPHTFIHAIVNGSFSAPFFVTRFREALFFYSALFDALDTTTPRDSNQEDXLLEENFSGRAALNVIACEGQFGWERPGDYKQWXVRIKREGSTTADLKS

SEQ ID NO: 189696 - protein, 79 aa, Triticum aestivum
  unsure (1)..(79): unsure at all Xaa locations
  Clone ID: PAT_TA_84114.pep
GGGHPKKPEDPPRKEEGEPTKKDGGEHKEGIVXKIKDKITGEHGDKSGDHKEKKDKKKKKHGEAXDHDGGHSSSSSDSD

SEQ ID NO: 189697 - protein, 145 aa, Triticum aestivum
  unsure (1)..(145): unsure at all Xaa locations
  Clone ID: PAT_TA_84115.pep
MSLVRLLDTLALDSWVRNPFTIFGTAVAADAWLASDTSAFANTHIESRDTAAAYVFSAALPPGVKKEEVTVELDXGNVLVIAGERSVCRQERSDGCHHIERXRATSSPRFHLXEDAAVDGVRXALDAXRSTVTXPSGPRPPSCRE

SEQ ID NO: 189698 - protein, 147 aa, Triticum aestivum
  unsure (1)..(147): unsure at all Xaa locations
  Clone ID: PAT_TA_84116.pep
MSTAAEQTIADQKRTLRAEVRRALKALSADQRASEDLAIQTTILXSSWVKSKQTVCAYISCQHCEKFDTSKNTSRVSTVRSWDKRMGKVFISSXWEDKXRNMRISXHTMGDLLRSNGIPGTSPVDATGEXLKSLSHGPVVFFMXGXL

SEQ ID NO: 189699 - protein, 208 aa, Triticum aestivum
  unsure (1)..(208): unsure at all Xaa locations
  Clone ID: PAT_TA_84117.pep
AWLHTVRTLLFSPFPGRSLCFTRVAELASDKRDTVGGGGDAGPRLDDGEDSSAVSSKAVVEELYRALERGDVDAVRRLLNPDVDGGPTAARAPAPGCSCAWSPAPGAGAGSRSRSGPGTLXPTVLAEGADRRAXLRVHRDVGPGALTGSRXATRVXSQSRGXHGXRQGTVVXCVXQCENXXDXSRTLAXXHYGXAXSXKCSTRXXYYS

SEQ ID NO: 189700 - protein, 59 aa, Triticum aestivum
  unsure (1)..(59): unsure at all Xaa locations
  Clone ID: PAT_TA_84118.pep
IFGGIMKCDVIASGIVNAAKQVDLKVPVVVRLEGTNVDQGKRILKESGMTLXITAEDLG

SEQ ID NO: 189701 - protein, 115 aa, Triticum aestivum
  unsure (1)..(115): unsure at all Xaa locations
  Clone ID: PAT_TA_84119.pep
SLRRCNPGPSEAMGSGDWVXDDXSSKEKSEAGKVXSTQSLLAKXQMGGNQDNPEXRRPSFKXVETTXDNAXLRGMGCYPIQDAFPEYKARKPAFLXGXKNCPCGQGDPXRXNAAR

SEQ ID NO: 189702 - protein, 73 aa, Triticum aestivum
  unsure (1)..(73): unsure at all Xaa locations
  Clone ID: PAT_TA_84120.pep
NILLDDDLNPKVSDFGSSKLLAIHSYYVRAVAADIGYMDPLYMKTEHFTXECDVYSFGVVLLGVITRRKGSWV

SEQ ID NO: 189703 - protein, 139 aa, Triticum aestivum
  unsure (1)..(139): unsure at all Xaa locations
  Clone ID: PAT_TA_84121.pep
KDWNPGLGLRHVLLVVRCLLIEPFPESALNEQAGKMLLENYEEYARHARLYTGXIHALKPKNTSKTGAILESNHSPECRQXXYCLLARTHHPMPPAVSTSCIQILDEFAGLRPTVSDLLDCRGRKKMAKVIPGKGGRKL

SEQ ID NO: 189704 - protein, 121 aa, Triticum aestivum
  unsure (1)..(121): unsure at all Xaa locations
  Clone ID: PAT_TA_84122.pep
MAVTITWVKARQIFDSRGNPTVEVDVGLSDGSYARGAVPSGASTGXYMRLGSLRDGGSDYXGKGVLKGCQAMLNTIIGPSIGWERPTEQFELTLQWPTLDGTSNGXGWCKQNLGANASLRS

SEQ ID NO: 189705 - protein, 160 aa, Triticum aestivum
  unsure (1)..(160): unsure at all Xaa locations
  Clone ID: PAT_TA_84123.pep
RDSTASSPPRPPPLPPFLTALRTRPAAGRAEFRSLAGKEAIFLCFLDGSRPEKGPNSTTSDRRLLLCWGLPCAKKSYQGEPGILSPGPPHGIHGARKGRVWFTXLVRLDKRLRSGAVXHPXWMDATHPKEGADXTCXSSGXLHXNEQRESGQRKXGILXG

SEQ ID NO: 189706 - protein, 87 aa, Triticum aestivum
  unsure (1)..(87): unsure at all Xaa locations
  Clone ID: PAT_TA_84124.pep
MGGGNGQKSKMARERNAEKNKGGKGSQLEANKKAMNIQCKICMQXTFICTTSEXKCKEHAEARHPKERPLXCFPHLQRFISSRYDLL

SEQ ID NO: 189707 - protein, 121 aa, Triticum aestivum
  Clone ID: PAT_TA_84125.pep
CSDPDLFGWPVAHYGGPMQSPGGSLLWNGISTGARPRNSSPDWWYDDVSCLSLPLYKKLISAMEYRGISQGVIVGSLNHYAKRRLPGLNRRKSIGDASNCLSMTSLTSIPSEDDQKYLKGG

SEQ ID NO: 189708 - protein, 43 aa, Triticum aestivum
  Clone ID: PAT_TA_84126.pep
ATEERRRLIWEHLERNAAFHPVTRDISFAAFPKPAPLVAPTMT

SEQ ID NO: 189709 - protein, 117 aa, Triticum aestivum
  unsure (1)..(117): unsure at all Xaa locations
  Clone ID: PAT_TA_84127.pep
PRLLPLXAXLPPPPPEXLLHSQAXXLVAAXQAXFMRXIXDATXPGXDHHRGSXXLCVVRALLKKIRRRMLVGDRVLDGAVNWXDXRXMIXXVFXRXXEXVDXPVANVDALSSSRNPM

SEQ ID NO: 189710 - protein, 95 aa, Triticum aestivum
  Clone ID: PAT_TA_84128.pep
RAEMVEILRTLEGALGDGPFFGGDALGFVDVALVPFTSWFLAYDRFGGVSVEKECPRLAAWAKRCAERPSVAKNLYPPEKVYDFVCGMKKRLGIE

SEQ ID NO: 189711 - protein, 48 aa, Triticum aestivum
  Clone ID: PAT_TA_84129.pep
FILSMPKRKPMDETQETLRTSAFPSSHVKEKWAKNLYIASICYGRTVC

SEQ ID NO: 189712 - protein, 152 aa, Triticum aestivum
  unsure (1)..(152): unsure at all Xaa locations
  Clone ID: PAT_TA_84130.pep
XXQXKKLNLXILPTTTIGSFPQTVELRRXRREYKAXXISEEEYVTXIKEEINKVVKLQEELDIDVLVHXEPXRNDMVEYFGXXLSGFXFTAXGWVQSYGSRCVKPPIIYGDVSRPNXMTXFWXKXAXSMTSRPMXGMLTGQHNPNSPEYNRG

SEQ ID NO: 189713 - protein, 124 aa, Triticum aestivum
  unsure (1)..(124): unsure at all Xaa locations
  Clone ID: PAT_TA_84131.pep
YRFGGLAWLFLGVANSDSLLYDEEFTSYLKQYPDNFRYDKALSREQKNRSGGKMYVQDKIEEYSDEIFKLLDGGAHIYFCGLKGMMPGXIQDTLKKVAERRGESWXTKKLGQLKKNKQWHVEVY

SEQ ID NO: 189714 - protein, 111 aa, Triticum aestivum
  Clone ID: PAT_TA_84132.pep
ETALVLAGRVYAGFVDSGGRVFAKVLEKGEVMVFPRAMVHFQMNVGDEPATVYGTFNSENPGIVRIPATVFGSGIKDAVLERAFGLEPEELRRLQKRFGPPPKTKTAEMDD

SEQ ID NO: 189715 - protein, 98 aa, Triticum aestivum
  Clone ID: PAT_TA_84133.pep
ERLIEFGIGGICNSCVDPANALIITQCGGIPLVIQCLSSPVRNTVTYALGALYYLCNPSTKKEILKPDVVSTIREYASAGTVNNNFSNLANAFLGETC

SEQ ID NO: 189716 - protein, 51 aa, Triticum aestivum
  Clone ID: PAT_TA_84134.pep
PPLLLAATFCVLLKHARKIRRWLLRQIVHTLIIGSSLSFVDEAQHGYFLYF

SEQ ID NO: 189717 - protein, 134 aa, Triticum aestivum
  unsure (1)..(134): unsure at all Xaa locations
  Clone ID: PAT_TA_84135.pep
GNCSGAAACVPAVSFIAPYQASLGCQRATTSATQPGTPTTLAARAALSRSVVPMDPPQELAAAGRKRRRRGGVRNRKRLSSQKGLPPATAPPTPXSPTVKRRRKDIAGXAAAMPKRXNTSVYWARCVXGFWXQF

SEQ ID NO: 189718 - protein, 71 aa, Triticum aestivum
  unsure (1)..(71): unsure at all Xaa locations
  Clone ID: PAT_TA_84136.pep
PXVPASRNPRPSAPALRRHSHCADRELDPPRRTPLLRGSGASSAGAAERAKVLGVRSGRSVEWREPRRAIC

SEQ ID NO: 189719 - protein, 61 aa, Triticum aestivum
  unsure (1)..(61): unsure at all Xaa locations
  Clone ID: PAT_TA_84137.pep
LHILNVILXYDEKPRYAPKIIDVLLXSYVGIEPQRCPIVFCTPHVMKICPACVRPSALVYA

SEQ ID NO: 189720 - protein, 161 aa, Triticum aestivum
  unsure (1)..(161): unsure at all Xaa locations
  Clone ID: PAT_TA_84138.pep
DSELLSVPSFSAPIASAHRFSPLHCAGCMAPPFACAMHGRALLAAAAAALLASAVTLTLLPSAAAQPWVGPWPTCDDTTGNYSAGKRLRQKHQAAHPQPQGKRVQHARPLRDGSAGAGADAVYGLISAAGTQAHECXXAEQXRARPVRSERNRDAGCLXQX

SEQ ID NO: 189721 - protein, 148 aa, Triticum aestivum
  unsure (1)..(148): unsure at all Xaa locations
  Clone ID: PAT_TA_84139.pep
DVESKIAKISAVPLVSLLRRHAKRSPFSLSGSGPRGPGATDDPDRNGASASPPIALLRSTGTRQLLAGLSSAGKASXLXSVRSFXKMAXTXNTXLKXDCXRCKIPXESGLXXKLVQXIXRXRXNXKKXGXKFXKXXVGIVTXGGXNLI

SEQ ID NO: 189722 - protein, 134 aa, Triticum aestivum
  Clone ID: PAT_TA_84140.pep
LFRYIAPEQVPVQFGGLFKEDDPEFTTSDTVSELTIKPSSKETVEIPVTENSTIVWELRVLSWEVSYGAEFTPDAEGGYTVIVQKTRKVPANEEPIMKGSFKAGEPGKLVLTVNNPASKKKTLLYRSKVKSTSE

SEQ ID NO: 189723 - protein, 137 aa, Triticum aestivum
  unsure (1)..(137): unsure at all Xaa locations
  Clone ID: PAT_TA_84141.pep
AKEKKLEKDIENENGGAGVYSASLKKHYILANDEWKEDILPEILDGHNVADFLDPXDILVRCESWKRRKXGFVLEEQAAERCFXKIDGHELTXEQKEILXKIRKKEALXIXDIDEEXXLQESLLMXXXKFAXXRNSN

SEQ ID NO: 189724 - protein, 87 aa, Triticum aestivum
  unsure (1)..(87): unsure at all Xaa locations
  Clone ID: PAT_TA_84142.pep
RSRSXSTTDAXAARXDAERWXXAQXEAAXPSXSXSPPVPXSGGRGVXYXTXSXXDFLLLPDDXKXRRYSXLPXXGRQDXTXRXRVPL

SEQ ID NO: 189725 - protein, 185 aa, Triticum aestivum
  unsure (1)..(185): unsure at all Xaa locations
  Clone ID: PAT_TA_84143.pep
LASSADDGTSIELALPIHYTTAAASNGVRLCYRRSTSSPPLAAGGGGGGXSFLAVAAPPGALVTSVPGFRQQAAVPSXKHYAGYVTVDERHGRRLFYYLVESGARPGRGPVRVWXNGGPVLNFDGSSTTRAFTLTIRRSTGTAKLISTLYWLVQCDILDPLPASGFYQVYKRRRADRNFGQSSSE

SEQ ID NO: 189726 - protein, 113 aa, Triticum aestivum
  unsure (1)..(113): unsure at all Xaa locations
  Clone ID: PAT_TA_84144.pep
MASGAAXAPVVQTVVLKVAIHCHXCKKKVRKVLRGIEGVQDVTVDASQHKVTVTGTVDADTLIKRLYKSGKKGVPWQCHPPAKNSEPAPEAPPAPQPXGDXGKIAAVRGNHRG

SEQ ID NO: 189727 - protein, 154 aa, Triticum aestivum
  unsure (1)..(154): unsure at all Xaa locations
  Clone ID: PAT_TA_84145.pep
LKAASSANVQRVVVVSSMVAVEISPKDWPEGKVRDERCWSDREFCRSIESWYPVAKIISEEAALAYGQQTGLDVVTINPGLVFGPMLQPTVNTTIQFLIYFLKGGPDPVXTSSGHIVDVRDVADAMLLLYEVPEATGRHICAPHVISARDCWIC

SEQ ID NO: 189728 - protein, 185 aa, Triticum aestivum
  unsure (1)..(185): unsure at all Xaa locations
  Clone ID: PAT_TA_84146.pep
EQNQIPNQTLNPRGFDVFDSIKAQVEAVCPGIVSCADILAVAARDGVVALGGPSWTVDWGRXRDSTASFPAQTSDLPPPTSSLQXLLRAYSXKNLNQTDMVALSGAHTIGQAQCLSFNDHIYNDTNINXAFAMSLRTTAPRPEHLALWTHDATLSQRLLNQKGSQSNGRIAKPNLGFPRMETNTV

SEQ ID NO: 189729 - protein, 115 aa, Triticum aestivum
  Clone ID: PAT_TA_84147.pep
FANGIDSSQVRVQRGGSSRSATRSSHRSTQDPAEVEQLREELRRHQDYLKQQAAQHKYYTTQIQQQQTLIQQLAQVQGIHVPVPPPPPPPLVHYPWVFTSTYTYISIYRTSRPSK

SEQ ID NO: 189730 - protein, 151 aa, Triticum aestivum
  unsure (1)..(151): unsure at all Xaa locations
  Clone ID: PAT_TA_84148.pep
MGDTGSSSILVHILVVALCLTAFGFAVAAERRRSTGSIVTDSSNATFCVYDSDIATXGYGVGAFLFLLSGHSLLMGVTRCMCFGAPLAPXGGSRAWSIIYFASSWITFAVAEXCLIAEQQRTIHTKYDMYMLVTGPAKLSQMLPENLGHMI

SEQ ID NO: 189731 - protein, 138 aa, Triticum aestivum
  Clone ID: PAT_TA_84149.pep
CRYGSPGGLPGAAGPAHSVVRAERAVAQGGRVARLHRGEHHRPTHHGVHAHPDGVDGLQLTTGLQPAAHTGHRHRRQHHGRCGGRGAVAARRLQLHRHQRHDDAHAHHDHRRHRRRTSPYLVRAASLALTGSGVVLAG

SEQ ID NO: 189732 - protein, 141 aa, Triticum aestivum
  unsure (1)..(141): unsure at all Xaa locations
  Clone ID: PAT_TA_84150.pep
LRFINAALNTELFVSLAGHTMTVVGADASYTKPYATPVILVAPGQTTDVLVTFDQPPSRYYLAARAYASAQGVPFDNTTTTAIFDYGTGASNSSSPAMPTLPAYNDTATATAFTXSLXRLRAADLPARVDEXLFFNVGVGS

SEQ ID NO: 189733 - protein, 138 aa, Triticum aestivum
  unsure (1)..(138): unsure at all Xaa locations
  Clone ID: PAT_TA_84151.pep
MVQRLTYRKRHSYATKSNQTRVVKTPGGKLVYQYTKKRASGPKCPVTGKKIQGIPHLRPAEYKRSRLPRSRRTVNRPYGGVLSGXAVREKNHPCFLXPKDRRWSKKVLKIQXTKXKDSCKVISRNGEAPVHKILGMEI

SEQ ID NO: 189734 - protein, 127 aa, Triticum aestivum
  unsure (1)..(127): unsure at all Xaa locations
  Clone ID: PAT_TA_84152.pep
FSEGGLDYLGNPSLVHAQSILAIWACQVVLMGAVEGYRVAGGPLGEIVDPLYPGGSFDPLGLAEDPEAFAELXVKEIKNXRLAMFSMFXFFVQAIVTGXGPLENLADXXAXPVXNNAWXSXNFVPGK

SEQ ID NO: 189735 - protein, 113 aa, Triticum aestivum
  unsure (1)..(113): unsure at all Xaa locations
  Clone ID: PAT_TA_84153.pep
GCCVTTRXRPLXXRHYFQNTXGXLFVVXXXDRDRVVXXXXXRLHRMLNEDXLRDAVLLVFATKXDLPXAMNAAEITDKLGLHSXRQRHWYIXXTCXTSGEGLXEGXXWXSTKL

SEQ ID NO: 189736 - protein, 171 aa, Triticum aestivum
  unsure (1)..(171): unsure at all Xaa locations
  Clone ID: PAT_TA_84154.pep
MAAPNSNDAASASGTGPAGEEDISIEALARRVQEHMTLNSNPAARRHKFWETQPVGQFRDAADASLPNGPIEPPTPLSEVRADPYPLPAAFEWXTCDLDDDXLLADLYXLLAHNYVEXDDEKFRFNYPXFLRWASNRVLLPGLDIGVAQGSKNSLNSGRRIAQPMLKSRQR

SEQ ID NO: 189737 - protein, 127 aa, Triticum aestivum
  unsure (1)..(127): unsure at all Xaa locations
  Clone ID: PAT_TA_84155.pep
MGHXDVKVTARAQGIPHXLYHXRTGRXWNVTKRAIGVEINXQVNXRIIRKXIHVRVEHVQPSRCTEEFRLXKAKNDQLKADAKARGEVISTKRQPVGPKPGFMVEGATLETVTPIPYDVVNDLKGGY

SEQ ID NO: 189738 - protein, 146 aa, Triticum aestivum
  unsure (1)..(146): unsure at all Xaa locations
  Clone ID: PAT_TA_84156.pep
MGSFFSTLVTPPPAADDPNCAVVAAHSKATYDEQWAAHKSSSKLMVIDFSASWCGPCRFIEPASRSXGSRFTDAIFXKVDVDXLAEVARTWKVEAMPTSVLXKDGKEXSRVMGXRRXLXRKSRCSHSLLLLIRMHTSHFLRFPIQW

SEQ ID NO: 189739 - protein, 165 aa, Triticum aestivum
  unsure (1)..(165): unsure at all Xaa locations
  Clone ID: PAT_TA_84157.pep
LRDLYPEELDNPQAALEALPPRHEAYLAEAQRLQREYASQIHILIGFEAEFIRPNCAAHVRKLAEHPIIDYFIGSVHYVHSTPIDYNKEMFATAREASSRKTEESLYEDYYDLQYDMLKELRPRVVGHFDLVRLMSEDQXRDVRQWKAFGERILRNLVLRNKMDG

SEQ ID NO: 189740 - protein, 90 aa, Triticum aestivum
  unsure (1)..(90): unsure at all Xaa locations
  Clone ID: PAT_TA_84158.pep
AAADAELDVAALLPDDSVDLLDTDDLFYAPDVHHPHNAKPXLLPGYDLDMLRALSLXSPRXXAAPSPSLLRAQRDRPHHRGVLRVIIHLR

SEQ ID NO: 189741 - protein, 156 aa, Triticum aestivum
  unsure (1)..(156): unsure at all Xaa locations
  Clone ID: PAT_TA_84159.pep
SPXXLNLRXETDARQTLCPGXQDQCRXXKXHDPFCVGEDSLAGKMQLXATQSTSEVRDGNGKSRRRKDQRWNKENGLKSTAVNAGFKSSRTNSKTLPLKDNSDELSNLNKILDRICQIHSTPGKPANHTHRDCWVFKQSGHLNAEHKGLDTPSKDD

SEQ ID NO: 189742 - protein, 51 aa, Triticum aestivum
  Clone ID: PAT_TA_84160.pep
PNTNTMEQGVTPKLFKTTGSFRAIRPWSYQTTSFRAGKLGADELGGRDHVG

SEQ ID NO: 189743 - protein, 144 aa, Triticum aestivum
  unsure (1)..(144): unsure at all Xaa locations
  Clone ID: PAT_TA_84161.pep
FNRRANLRVSPDQGMCLLWLTAILPVYKNTPECAPGRPVGCAVLPWQLPLLFTSFAFMSLGSGGIRPCTLAFGADQLDKRDNSANXVRTLHTFFNWXYTVLGLSIVFASTVIXVIQQAKGXVXRLXPAVXLMGTVLSCPPGLAF

SEQ ID NO: 189744 - protein, 163 aa, Triticum aestivum
  unsure (1)..(163): unsure at all Xaa locations
  Clone ID: PAT_TA_84162.pep
AAGRLQGYGSRLATNTCGQREWEDYLFHLVHPDGLADHALWPAYPPDYIAATRDFGRRTRDLASTLLAILSMGLLXTXRGDALEKALTXTXTXTAADDDLXLQLKINXYPRCPXPXELAVGXEXAXTDXSAXXLIXQQRXAGLXVSNGXXWVTAXHQPGTSSS

SEQ ID NO: 189745 - protein, 44 aa, Triticum aestivum
  Clone ID: PAT_TA_84163.pep
RGSICLPCDVFKTGEFGDMVVSQGKMLLQLYHSINTKREMGTGL

SEQ ID NO: 189746 - protein, 157 aa, Triticum aestivum
  unsure (1)..(157): unsure at all Xaa locations
  Clone ID: PAT_TA_84164.pep
DLPHAYVCAESYIFDVTEWFNCQGMRCPANTHKATFHVNANMAKQSSGKASTSTQRAGKAPSGVNMDGGGLNEEEFFEWSRMQSTLGMFETTFXGAQGDPTSPGNGSMPKSXGXSSSNNNSRKKKGKKQWYQNKQLGVTRGGKEQISWVLNTLGNPG

SEQ ID NO: 189747 - protein, 154 aa, Triticum aestivum
  unsure (1)..(154): unsure at all Xaa locations
  Clone ID: PAT_TA_84165.pep
GHDLGSFLHAWVLSFKGSDARPFGKGVLRRPPARPGRVQLHGPFGRGRPNVGRGGRRAEAPVASLDSDLEAFSHNPAHGSFAPLAFQPSAMTNCVNQRFLSYXVELLSRRGHQXGKTNLSHDGLTPAHVPYWWVNNPTLGEFCFTMIGRADIEG

SEQ ID NO: 189748 - protein, 135 aa, Triticum aestivum
  unsure (1)..(135): unsure at all Xaa locations
  Clone ID: PAT_TA_84166.pep
GFQEGLYMGAGGGANAVNPGYTKGDGLGAEIVGTFVLVYTVFSATDAKRSARDSHVPILAPLPIGFAVFLVHLATIPITGXTGINPARXSLGAAIVYNRSHAWNDHWVFLGWPFIGAVLPSTTWHHQGLPFKDRD

SEQ ID NO: 189749 - protein, 94 aa, Triticum aestivum
  Clone ID: PAT_TA_84167.pep
LIIRGLSHEHYFISLAYQTVTDLHDVAHSVTRNINPPTQSHCRRMHSALARCMLGPVSVSVPTGELGLDEIHDTGVHPERLGEHRRGDRRRGAE

SEQ ID NO: 189750 - protein, 53 aa, Triticum aestivum
  unsure (1)..(53): unsure at all Xaa locations
  Clone ID: PAT_TA_84168.pep
HRRXVPRRXXRXERHXXLRHGHGHXAAAVFGEQRRQPEAXXRXGXRATPRRRR

SEQ ID NO: 189751 - protein, 74 aa, Triticum aestivum
  unsure (1)..(74): unsure at all Xaa locations
  Clone ID: PAT_TA_84169.pep
LAKCLHAAPAVVSPSSRRLVASPRAGRVASIQPSVVNCWRYLSPASLLMLLEYWVSMTMLDCWAWVXDGQDTLS

SEQ ID NO: 189752 - protein, 107 aa, Triticum aestivum
  unsure (1)..(107): unsure at all Xaa locations
  Clone ID: PAT_TA_84170.pep
MEVAAASARPVLRVAAICGSLRKASFNRGLLRAAAEVCEDSIPGLRIDELDISDLPIINTDLETGSGSGTVFPPAVEASRAKVCQADCFLFRRARVQLSXRTPLKNR

SEQ ID NO: 189753 - protein, 71 aa, Triticum aestivum
  unsure (1)..(71): unsure at all Xaa locations
  Clone ID: PAT_TA_84171.pep
GASGPVNRPSLISLSGVSVQLLHNHVXSLGNFLLHMNHVSCCFSLLPCHWXIVSXAXFWLKRVVRFIWXCX

SEQ ID NO: 189754 - protein, 56 aa, Triticum aestivum
  unsure (1)..(56): unsure at all Xaa locations
  Clone ID: PAT_TA_84172.pep
WLXPPXLLSYSGKERGILLGLGSPSRTPTLGVPPLAPASPLLLYIGGQGATHRHNN

SEQ ID NO: 189755 - protein, 198 aa, Triticum aestivum
  unsure (1)..(198): unsure at all Xaa locations
  Clone ID: PAT_TA_84173.pep
FRGVIVLEECNLEEIEEEEISKSSKDSKKANGQEKGPSLVFKITNRVSYKTVLKAHSAVILKAESMADKIEWIKKIKGVIQSRGGSVKGPTEDGPMRQSRSDGSLDTMARRPADPEEELRWMSQESVXYVEAVLNXSLXANVPKXAXVXCQVEKSKEDMLXQXYNSISAXSNARXKXLKRTXANLAEQIIPKPCNNDK

SEQ ID NO: 189756 - protein, 63 aa, Triticum aestivum
  Clone ID: PAT_TA_84174.pep
LPRRQPQRTAIFGWWQSWLPWWQPWLPGSRRQLQLPVNMTTSTKLAPLFQSSLLQEMVRRSLA

SEQ ID NO: 189757 - protein, 187 aa, Triticum aestivum
  unsure (1)..(187): unsure at all Xaa locations
  Clone ID: PAT_TA_84175.pep
RTPMAGSGSDRVPAWGSRTPAAASGRTPAWKAPDMSGARTPAWADGSRTVNPYDGNRTAYGSGGRTPAWQAGGRTPAPGDAFGAGSRTPAYGGGGDSWGXXDXRLLLXXVSAPTPGASXNDSWGGSGAYDXPTPGVGLGAPTPXALSAPTPGAXISTDPAAISAPTQGAXEGGWGTTSLWCSLVYGP

SEQ ID NO: 189758 - protein, 169 aa, Triticum aestivum
  unsure (1)..(169): unsure at all Xaa locations
  Clone ID: PAT_TA_84176.pep
WGALSSMVLPKYPLPTYDVVVRGGAPNAFSQCMVAYDETQRPSLKKALLLGDAFSDLPKVENHQPNDVMEYGGSPKTEFQAXYFDLGRKDMLXDWSFGXEEAGPXDKGNSWXNKPLRLNNDDNERGXQIPVKXXSNFRDLKGVKGWSKIXVVXWDSKIQRVXPFXXKWS

SEQ ID NO: 189759 - protein, 140 aa, Triticum aestivum
  unsure (1)..(140): unsure at all Xaa locations
  Clone ID: PAT_TA_84177.pep
GAAVVQMKEYLDKFAQSEEHSEVIEETGSFQLRRKKSDKAHGFVDISIRICKQEDDHGRFSGLPEGLKNSDQVGITLAIEDGPVYNYPPPPYXHYRGDREDADHHSXFRPVXPGTRXVITXGSSYSYXPQCSINPGTTTT

SEQ ID NO: 189760 - protein, 89 aa, Triticum aestivum
  Clone ID: PAT_TA_84178.pep
SRVMWSLGLIRRASANPNQSPLNHRDSAITNRQKRSSLGTDEIQGTLLRRDADAGGRRKRFQERRARVRGVCATEAREWGKRSAGRGRA

SEQ ID NO: 189761 - protein, 114 aa, Triticum aestivum
  unsure (1)..(114): unsure at all Xaa locations
  Clone ID: PAT_TA_84179.pep
XVXRLGTCFXCRMMSHCKQITVEPLSPHLHCTEPIQIASXQPRVIQVQXLQLHTVPQPIPIVPHVLASRLVLGAFCTSTACQHPWYLPLLSPLLEQAPLGKDKTVKNVEDLREQ

SEQ ID NO: 189762 - protein, 102 aa, Triticum aestivum
  unsure (1)..(102): unsure at all Xaa locations
  Clone ID: PAT_TA_84180.pep
ERRAXSHSGXYRTAGXXPPXXPRXXRRSXXWDACLXRYPSVXREARXLAXQALGGVPVPMPTRASEGXWKRGGRGAAGVGWGPVGSAARRLRLRLREWLPAG

SEQ ID NO: 189763 - protein, 110 aa, Triticum aestivum
  unsure (1)..(110): unsure at all Xaa locations
  Clone ID: PAT_TA_84181.pep
MGKEKSHINIVVIGHVDSGKSTTTGHLIYKXGGIDKRVIERFXEKEAAEMNKRSFKYAWVLDKLKAERERGITIXDIALWKFETXKYYCTVNGCPGHRDSTKXMVTGTPS

SEQ ID NO: 189764 - protein, 41 aa, Triticum aestivum
  Clone ID: PAT_TA_84182.pep
GKLEEWTKRYGGFFKPCSYLAERAAKGIPLSAPTKKVQARL

SEQ ID NO: 189765 - protein, 89 aa, Triticum aestivum
  unsure (1)..(89): unsure at all Xaa locations
  Clone ID: PAT_TA_84183.pep
EDRARFWKPPFWPXPPPKPWPGPATKVGTAPPDWXPXPLPLPAPGVXKGVSGTSGVLLLPPPRPAPGVGLVTAPSPPPKPVPGPATKVG

SEQ ID NO: 189766 - protein, 35 aa, Triticum aestivum
  Clone ID: PAT_TA_84184.pep
YVKRKNPRRITEKLEFRKYDPRVNKHVLFTEAKMK

SEQ ID NO: 189767 - protein, 168 aa, Triticum aestivum
  unsure (1)..(168): unsure at all Xaa locations
  Clone ID: PAT_TA_84185.pep
ELAHRVDDALGFMTASGLTVDHPIMTTTDFWTSHECLLLPYEQALTREDSTSGLFYDCSAHMLWVGERTRQLDGAHVEFLRGVANPLXGIKVSDKMNPXELVXLIDILNPSNKPXXITIITRMGAEXEVKLXQLIPAVRNAGXCTWITDPMXGTQQSPCGLKSFYPSG

SEQ ID NO: 189768 - protein, 67 aa, Triticum aestivum
  unsure (1)..(67): unsure at all Xaa locations
  Clone ID: PAT_TA_84186.pep
VGSETRRDDPPSPQPELVLPHLIPLTXXLRXXASICTXVMSQLPLXSSXRPXCGCSIWXPXSLSXVA

SEQ ID NO: 189769 - protein, 157 aa, Triticum aestivum
  unsure (1)..(157): unsure at all Xaa locations
  Clone ID: PAT_TA_84187.pep
VFNFGDSNSDTGGRVAAGFESIFPPYGSSFFGGPAGRFCDGRLVIDFLMEAMDMPLLNAYLDSLGTPSFRTGVNFAQAGCSITPAKPTSVSPFSFGLQIKQFFAFKNKVTKLLSEGDMHSRYIPQXDYFSXGLYTFDIGQNDLAGEFEQTHRINPIC

SEQ ID NO: 189770 - protein, 117 aa, Triticum aestivum
  unsure (1)..(117): unsure at all Xaa locations
  Clone ID: PAT_TA_84188.pep
MARSSFKLEHPFERRQAEANRIREKYPDRIPVIVEKAERSDIPXIDKKKSAIHEYFVPADLTSDKFXVSGTGSGXVXAEKGSXPXXXNPQKAPPSGQGGQMTGETRALTGFNGEAVI

SEQ ID NO: 189771 - protein, 175 aa, Triticum aestivum
  unsure (1)..(175): unsure at all Xaa locations
  Clone ID: PAT_TA_84189.pep
MEYGQQGQRGHGATGHVDQYGNPVGGVEHGTGGMRHGTGTTGGMGQLGEHGGAGMGGGQFQPAREEHKTXGGILHRSGQSSSSSXSEDDXAXKGGKXGIKEXVKEKLPXGHKDDKHATATXXGAMGXGHTXGXGQXGHTGGXATXRXTXEXRIWQQENRQTDGTCLAAANLQVMV

SEQ ID NO: 189772 - protein, 74 aa, Triticum aestivum
  unsure (1)..(74): unsure at all Xaa locations
  Clone ID: PAT_TA_84190.pep
LLAASTTNFPNFLLQISVPLCPSKFSVASLFTGSXVVFSNFLXGFFRMVPLVLLVSSHLPLVXFSXVLPYPSVX

SEQ ID NO: 189773 - protein, 100 aa, Triticum aestivum
  unsure (1)..(100): unsure at all Xaa locations
  Clone ID: PAT_TA_84191.pep
MAFMRYRALPRGELTAEEFRAWLAQFDADSDGRISREELRHALRSLNVRFAWWKAMGGVRAADADRDGGVQLGEDEVARLFAFXQSXLGVXXPSSGYYPS

SEQ ID NO: 189774 - protein, 119 aa, Triticum aestivum
  Clone ID: PAT_TA_84192.pep
FNRKLNATVGALVRRHAGLKVAVFDVYTPLRGLSERPAAHGFAEARRTCCRTGKAGTRVYLCDPATAARMCRNASSYVYFDGVHPSEAANLGRRRVPGCRPASTSHLSKLATAYVLLAV

SEQ ID NO: 189775 - protein, 63 aa, Triticum aestivum
  unsure (1)..(63): unsure at all Xaa locations
  Clone ID: PAT_TA_84193.pep
GLFLSFGHRLVLESVTHYQVFQRSELVSIQICCCFXXHVXQRHLCTPMENCFSYQRIDCQCWY

SEQ ID NO: 189776 - protein, 111 aa, Triticum aestivum
  unsure (1)..(111): unsure at all Xaa locations
  Clone ID: PAT_TA_84194.pep
MEFCPVCGILLQIDPGTGSHRLRLFCPVCPYVCPILNKIVKKARLVKKEVEPISSTADEMKSAPKTAVTCQRCNHGEAYFKQXMRSDSADEPMTTIYRCCKEECQHEWRXD

SEQ ID NO: 189777 - protein, 54 aa, Triticum aestivum
  Clone ID: PAT_TA_84195.pep
QAEEDERFVKEWKKYLEEEARIMKDVPGWKVGESVYNSGKWMPPATGELRPEVW

SEQ ID NO: 189778 - protein, 100 aa, Triticum aestivum
  unsure (1)..(100): unsure at all Xaa locations
  Clone ID: PAT_TA_84196.pep
MARLLRAAAVLALLXVSTAALSAPAWAGGVSAXDLXHLGAAVVIRRXGGXAXRGGTTVXECMEYLDVDAEGEXDVAGMXXGXIKRRVLQXXSGYIXYDAL

SEQ ID NO: 189779 - protein, 155 aa, Triticum aestivum
  unsure (1)..(155): unsure at all Xaa locations
  Clone ID: PAT_TA_84197.pep
LAGPFPPHPCGLPHPTRPGLPQTLGQLLPCPSRALYDWAAAGTLHQLPRSLSSGTFPGERASTKVIAGERPRKSDTLGNQQAKLDDEGQTMQVVVGSSPGKVSIAPKGHKNPLKDXHFPXXIRLESXFSKNXRGFLLXRXRREECTXTFXPPCGG

SEQ ID NO: 189780 - protein, 145 aa, Triticum aestivum
  unsure (1)..(145): unsure at all Xaa locations
  Clone ID: PAT_TA_84198.pep
RTWNCRNSTGPSKALPEGGCQDTGVGLGAKRGPTFKQATFQGRKGSSFEMLEAEGVPGTATPSDVNYERMMXDIQLASVQTPNPAXAASTXGPQEETPVXAAAHPDDKSPAXDXGXVATDRWMRGLRHTNEXREHXEERLSNRGT

SEQ ID NO: 189781 - protein, 131 aa, Triticum aestivum
  unsure (1)..(131): unsure at all Xaa locations
  Clone ID: PAT_TA_84199.pep
RDRRLIRHGEAGGGEEALCGVDRRTDTGSGPGFGCPPLPPAXSPPXSRFPQPAPGTAASASAPAAACAPPPDPIPTLSSXGHKSAASENRRVGALRRCXGCTSRDGGGPXPEVSTDGESTXTKTTSMTLRV

SEQ ID NO: 189782 - protein, 136 aa, Triticum aestivum
  unsure (1)..(136): unsure at all Xaa locations
  Clone ID: PAT_TA_84200.pep
MVSLKPQKRLAAGVLKCGKGKVWLDPNEVYEISMANSRQNIXRSWVKDGFIIKKPQENPLXGPRARRAMRPSKKGRHSWVTGKRKGTKEARSPTKSFXVPKMRSSKALLRKXPGSKRXXQHMYHDXFMKVKGTFLK

SEQ ID NO: 189783 - protein, 171 aa, Triticum aestivum
  unsure (1)..(171): unsure at all Xaa locations
  Clone ID: PAT_TA_84201.pep
LMTAASTFAAAFMTPLLTSKLAGQYVAVDPMGLFVSTSQVVLAPVLLGALLNQYMGRLXLSQVSPVMPFIAVATVXVLCGNAIAQNASTILTSWLQGDWLSLLAWFRFSFXYVFQRSSXTXTXXTKSPXXVGMQXPVLVFPRAFGNLSRSRGSNTATGVWTGRVWRHAPKQ

SEQ ID NO: 189784 - protein, 116 aa, Triticum aestivum
  unsure (1)..(116): unsure at all Xaa locations
  Clone ID: PAT_TA_84202.pep
HLLFFSFFSFFSLDVCNPRGHHKIIILDHGGRLGWEYTWGTSKHYHCWCTILFKDDRSNLRRGGKISXXXXNVGLTLQXQRFXELKKCNYPLHXYKATSASTSNYXPRMGXAPATK

SEQ ID NO: 189785 - protein, 181 aa, Triticum aestivum
  unsure (1)..(181): unsure at all Xaa locations
  Clone ID: PAT_TA_84203.pep
HGMDSLMHGSSITLHTYCTSLFGPPPPVCCSSPSFWVPGGFCSAFLTPPSSAADGSVAVSADFGRRSFALRRTPLGSRLSREXWXVSCYPLLIRXDLPGXKSAGGAGTNSPKMXXLRAXXAXFKXLTGKPXYQXXLXXPLRXXETKGRRCLQSXTXXWTPDGITGXWVPXTVIQPSRLLFX

SEQ ID NO: 189786 - protein, 106 aa, Triticum aestivum
  unsure (1)..(106): unsure at all Xaa locations
  Clone ID: PAT_TA_84204.pep
KIMEEQGEKDGGKCFLSSPRKIGGRRVRXPDGGQTTGSTDGRGGTRLTHPSRWHHGGRSSQMWTLLRRGGQIWSSMATGCRSTERRWRRAAGARSCGGGGLPEEQP

SEQ ID NO: 189787 - protein, 158 aa, Triticum aestivum
  unsure (1)..(158): unsure at all Xaa locations
  Clone ID: PAT_TA_84205.pep
ETEPSGPLAVLKGFKNLPTGMPSVLLVTGLTWLSWFPFILYDTDWMGREIYHGDPKGSNAQISAFRRKASRVGSVPGCCSTRFVLGFSPFLDRAMCRKXXPKVVWXTNNFMXCVAMAATXADXFWPSKDYNGYVXDPSPPDIKASARLFASWVSSRIL

SEQ ID NO: 189788 - protein, 123 aa, Triticum aestivum
  unsure (1)..(123): unsure at all Xaa locations
  Clone ID: PAT_TA_84206.pep
GLGLRTLEDVDYLXAPLMVPKDELLPPTPAGDGEDERALVLLVQVTAFACGGFVVXFRFSHAVDDGPXAAQFMTXVGELARGRRPXXSRSRXXSVEPQWGXXAVPXDPAVXLVGXXXGXXGXH

SEQ ID NO: 189789 - protein, 141 aa, Triticum aestivum
  unsure (1)..(141): unsure at all Xaa locations
  Clone ID: PAT_TA_84207.pep
MATFTKLEDSPMFRKQVNSLGTSXDELKERCSNLHKGCKRFXWDHLDEAYAGDLSFAVLLQAFGCWSWMILLSVAIGRAVMSKFTTAFKGLGDIQGLLRSQLEHMLSDRLXTFINVGLNGVKXVRNFGVHYDKVKFQCKRT

SEQ ID NO: 189790 - protein, 154 aa, Triticum aestivum
  unsure (1)..(154): unsure at all Xaa locations
  Clone ID: PAT_TA_84208.pep
MAAVSTAPALEGRIALVTGGSRGIGREVSSHLAALGARVVVNYATNPAKAEELVAELASRGLRAVAVRADVSDPAAVRALFDRAEEDSGPAPRSGRLRGIMDAKYPXLADTAVEDFTHVPVNTAXVPGVREAPPPGWRYEFLTVSAPATGWSSV

SEQ ID NO: 189791 - protein, 114 aa, Triticum aestivum
  unsure (1)..(114): unsure at all Xaa locations
  Clone ID: PAT_TA_84209.pep
LGVSFAAPVKLGAVLCCALQLIVXQIDEQVQERXAAQVXEPLITGRAAAERVAVVQVQQXSGPCPCPPGRTRTPXPPXPRRLPWXGGPXXAAXLXGISRXAVRXQRGXXXTXSD

SEQ ID NO: 189792 - protein, 152 aa, Triticum aestivum
  unsure (1)..(152): unsure at all Xaa locations
  Clone ID: PAT_TA_84210.pep
RMYESFLEEVPLLASLNPYERSKIADALETKKFAAGEVIINEGDPGHAFYLLESXGEADAYIGTAWITRFRHLQRRAITSGELPCLNDAPPKQLSIRCYVSQSKVXXLGKDLSXRLFGPWWEAPYQRTXFXGVATGSKEWSSPANHKGSIMN

SEQ ID NO: 189793 - protein, 159 aa, Triticum aestivum
  unsure (1)..(159): unsure at all Xaa locations
  Clone ID: PAT_TA_84211.pep
QGGARYGESSSPQDNSSEAMKTDSTCKMKSNSDAAPIKQGSNGSSNNDVGSSTKNVAARPSGDRERVASPLAIKSTQHASSXFNTIQNQTSPANLIGGKTKLDEGIXNTVKMSHPTEVHKAXVQHHHHVHYYLHVMTQNSINRPWISDVTVVANVLISC

SEQ ID NO: 189794 - protein, 95 aa, Triticum aestivum
  Clone ID: PAT_TA_84212.pep
QVTFANPAASGYVSIDSACCGSGRMGAESDCLPNSTTCADHDRFVFWDRGHPSQRAGELSAAAYFDGAAGFTAPISFDQLARKIFAGPEDLASYS

SEQ ID NO: 189795 - protein, 136 aa, Triticum aestivum
  unsure (1)..(136): unsure at all Xaa locations
  Clone ID: PAT_TA_84213.pep
MGGGDADAGGEPADAQATLHIRCTNGSKFTVRTDLGATVGAFKGDSSPTAGDVPAPAAAVIYXGRFWKDEQTYQYGVGDRHTSTWYVGAVLSPTSTAPANQRLQCCPAFPRQQGWLLQWYPAANEGFPLDTNQQQY

SEQ ID NO: 189796 - protein, 126 aa, Triticum aestivum
  unsure (1)..(126): unsure at all Xaa locations
  Clone ID: PAT_TA_84214.pep
DIDQDLSRSEKLLGDLGGLFSKKWKPKKNGAIRGPMLTRDDSFIRKGSHLGAKGKKLRAGQFIHLXQMRAIPXLNLNNTXRKXEXEKXKQDDDLXDLKHIXGPEXXRMAVXMALRGNKSMGDAKKV

SEQ ID NO: 189797 - protein, 135 aa, Triticum aestivum
  unsure (1)..(135): unsure at all Xaa locations
  Clone ID: PAT_TA_84215.pep
RISRSGDISPXGIFGTLARSLLLVLGSKXPRHSEXCHSRLTPGSCSSWGERTTQACGRFSLALGPQLRFEVVLGTVRPSFLLLLLEEEFCCLTSCFVVAASPATTAFEVVEETIAEAEAGPSFRRCSALRSSSST

SEQ ID NO: 189798 - protein, 77 aa, Triticum aestivum
  Clone ID: PAT_TA_84216.pep
MSSLLLRVLLIQLAAVECLSAAIPGCLTQCGGVEIPYPFGVGTNCSRKGFRIKCINGSAGEEIQCCYLLRATRTSGC

SEQ ID NO: 189799 - protein, 135 aa, Triticum aestivum
  unsure (1)..(135): unsure at all Xaa locations
  Clone ID: PAT_TA_84217.pep
MWPVPSMGPQFFSIPWERRQELGEVDCPPFCFPXRCKXSALIERLPSXSDLXNEVIFGQEHLSXDDXSFIFSLKVSDNAPLYGVCLHVQEIVQKAPGILGAVSPLNPTSYKPSRFLVSAPRCYCLLTKVPFFLHH

SEQ ID NO: 189800 - protein, 125 aa, Triticum aestivum
  unsure (1)..(125): unsure at all Xaa locations
  Clone ID: PAT_TA_84218.pep
LPGRDPPVLPIAYSVPGAPSEVRPWRSASRRLPSPRSGSYPRRSVVQCCPADRTSVHLLCGWVPPWIYQSGTIKMTIPIESDRERGQXWVPICTTKXKKPVILXNXDLXXKVXWNPYGSCIIXSI

SEQ ID NO: 189801 - protein, 125 aa, Triticum aestivum
  unsure (1)..(125): unsure at all Xaa locations
  Clone ID: PAT_TA_84219.pep
CRCCWWRLLWRRSWVGYVRADSSHAAPLRRRRPCXTASVTVPNWAFLXTVTRFKWSDAARGPXPPAPQVXRPVRXXGEKXEXPGKTXSIFREHSVFGHFDQTYLKFIXQTNQWIKRXEXPTFGWD

SEQ ID NO: 189802 - protein, 59 aa, Triticum aestivum
  Clone ID: PAT_TA_84220.pep
FSGASMNPAVSFGPALVSWEWGYQWVYWVGPLIGGGLAGVIYELLFISRTHEQLPTTDY

SEQ ID NO: 189803 - protein, 136 aa, Triticum aestivum
  unsure (1)..(136): unsure at all Xaa locations
  Clone ID: PAT_TA_84221.pep
MSVRDGKVVLAPANPKDEYQHWIKDMRWSTSIKDEEGYPAFALXVNKATGEGIKALRWGQSHPXVRLGAYNPDFLDXXACWPESRDVRNASRGXAWXTHLLTXTPPTGQVXGGXRXGPTPVWXLXQGTPRGXPPYY

SEQ ID NO: 189804 - protein, 108 aa, Triticum aestivum
  unsure (1)..(108): unsure at all Xaa locations
  Clone ID: PAT_TA_84222.pep
PVAHSERSPVLLLMGGGMGAGKSTVLKELKQEAFWTNAEANAVVVEADAFKEADVIYRAIKSMGHHNDMLQDGRVXHHPRRRXVRPLLVTGLTXGRDXILGRTLPWEP

SEQ ID NO: 189805 - protein, 150 aa, Triticum aestivum
  unsure (1)..(150): unsure at all Xaa locations
  Clone ID: PAT_TA_84223.pep
IFPRXXKFXRXDXRAPWXNLSGXLARXSXSXRDALXAPVKVGTGGXGXGKXAADXRPXKGXGEGSGGXXTEQPGLGSFGFAAVAIAGGLQLPPPFRRVQEGSTSTTTLDRNFSMLFPLRHWPRRLRRCRALAGAASSLAGDLVAARGFVP

SEQ ID NO: 189806 - protein, 169 aa, Triticum aestivum
  unsure (1)..(169): unsure at all Xaa locations
  Clone ID: PAT_TA_84224.pep
LNYLVMISAKDEPDAPLSPAMDGLLRVHKRITDSSDGESSQPQRXLGNIGPTRLLSAIFRKLGXLLGKQGSXTFNPIQDPQNLWPXLLENXPPCCTXNDDRVXVEIQGXPLGVPXAVGFIPXHLENSLVDRMSTLFGXHMKCMVAXGXQCXXQGGPQLQTSPSGWVGGI

SEQ ID NO: 189807 - protein, 144 aa, Triticum aestivum
  unsure (1)..(144): unsure at all Xaa locations
  Clone ID: PAT_TA_84225.pep
MSGGIARGRLAEERKAWRKNHPHGFVAKPESLPDGTVNLMIWQCTIPGKQGTDWEGGYFPLTLHFXSEDYPSKPPKCXXPQGFFHPNVYPSGTXLSILNEDSXWRQVLLLSRSRRDQDLLVSNPADLLKQTVHFFQGSTEYRGR

SEQ ID NO: 189808 - protein, 64 aa, Triticum aestivum
  Clone ID: PAT_TA_84226.pep
YSCNIHEHPLSRSCFIYATAGMHAKDASGDKTPVILLVRMHACARSMGAMVISSVGSVVGLDLP

SEQ ID NO: 189809 - protein, 47 aa, Triticum aestivum
  unsure (1)..(47): unsure at all Xaa locations
  Clone ID: PAT_TA_84227.pep
RDLAGGGRSYGGXWGGGRRSGGXGGXGACYKCGXPGHMARDCPSADG

SEQ ID NO: 189810 - protein, 189 aa, Triticum aestivum
  unsure (1)..(189): unsure at all Xaa locations
  Clone ID: PAT_TA_84228.pep
DAHYKACLYAGIDISGINGEVMPGQWEFQVGPAVGVSAGDQLWVAPLHLERITEIAGLVVSFRPKXIPGGLGMGWVHTPNYKTNPMKERXAGRVIQEAIXXLGLXGPGRIXRLRXXNXAAXTGGKXTADIKFXXGRXQXRXXXRVXPHXQKEXKGIXGPXRXNMDLLGDSYAKHLETITGRKAPSLLIE

SEQ ID NO: 189811 - protein, 75 aa, Triticum aestivum
  unsure (1)..(75): unsure at all Xaa locations
  Clone ID: PAT_TA_84229.pep
GGXCTFLLHIPQPPNEAISSVLDLYNIYPRVRHVEFPVVVEPRFRKHGGVGRGYKDTHVGESAEMIFQQACLGLR

SEQ ID NO: 189812 - protein, 67 aa, Triticum aestivum
  unsure (1)..(67): unsure at all Xaa locations
  Clone ID: PAT_TA_84230.pep
LRDGNHSCLPRXVSTAVTFILDTYLLGISLPSVLSRSXFLCTMLYHSPCXLLGMXYGGDVWFVFPPN

SEQ ID NO: 189813 - protein, 93 aa, Triticum aestivum
  unsure (1)..(93): unsure at all Xaa locations
  Clone ID: PAT_TA_84231.pep
AGQVRSCTSWFSXLIGQLFVLFCQIXGNIKVRIFREHNLFKINFQILKKXXQYGKHWLXXXQKMWXHKKKLGDXKKCXMXQIXADIKTXXTMX

SEQ ID NO: 189814 - protein, 91 aa, Triticum aestivum
  Clone ID: PAT_TA_84232.pep
NGNRTEDLLHLPGTHAAKSLTHLWQSSRRFESRSPGWRRRRDRHRGARRSPSAPPRTALLRLLIRPNIVTSSPMAEPSLLPTADTTAEASK

SEQ ID NO: 189815 - protein, 144 aa, Triticum aestivum
  unsure (1)..(144): unsure at all Xaa locations
  Clone ID: PAT_TA_84233.pep
XTHQSDIGESGRLXALKAKGFCAGLGKTGRGDPDGRXSGLGLLGCSRMMADSWTRWRSGEDDGGRGYVDGAAAGASAMLGEGEGERQRSERGVCGVGAATWSSPKCPRARAASRWRGGELSRAGVTSLPAWRTRSSWLARANTV

SEQ ID NO: 189816 - protein, 137 aa, Triticum aestivum
  unsure (1)..(137): unsure at all Xaa locations
  Clone ID: PAT_TA_84234.pep
YIDYPGLNRVASQECFWPSRVWHCTGPPHSFVRMPFCLPNASATHQRLMRSILEAQVAKHHAFLGGDGDGTSSGPLRTSLELPEAPXPEGSVRIDFFTPHRQCSRHHWCNSTRDSFXFWFKWXRPPRCTSQXRVGXP

SEQ ID NO: 189817 - protein, 88 aa, Triticum aestivum
  unsure (1)..(88): unsure at all Xaa locations
  Clone ID: PAT_TA_84235.pep
RVTPRRPMMSFRVPRRLVASRAAGGASPSPPVPAGLKKKKKKVAVAXWXXKKEGSSGXDPAAPDAVAGRAVQAHAAAAARLLRHGDQT

SEQ ID NO: 189818 - protein, 52 aa, Triticum aestivum
  unsure (1)..(52): unsure at all Xaa locations
  Clone ID: PAT_TA_84236.pep
ARRXTHRXPRXXPXLGSPAXDASDGAIASFIVCSSSASPAVRARACGRCXWX

SEQ ID NO: 189819 - protein, 39 aa, Triticum aestivum
  Clone ID: PAT_TA_84237.pep
TKGGMDHMSRKNGFNQKLSRSNSDITPSISTAPLCLQLE

SEQ ID NO: 189820 - protein, 72 aa, Triticum aestivum
  Clone ID: PAT_TA_84238.pep
LLQVSFFLVGPSSCGCKFQLENWWEEVRMKKVELKVVDFRIVLRDLPELPVKVLGYMLGNEGSSSTPLHSSQ

SEQ ID NO: 189821 - protein, 42 aa, Triticum aestivum
  Clone ID: PAT_TA_84239.pep
CGASIQHVEILLSSGAMRSVYSSCSKSECSAPVNCTPLCVIL

SEQ ID NO: 189822 - protein, 69 aa, Triticum aestivum
  unsure (1)..(69): unsure at all Xaa locations
  Clone ID: PAT_TA_84240.pep
TMXFXPXFGKTNALXPCHVGAPTLXHPWXTLLLNMFEMGYEKRXADLSLFPFLAGIKAKYPIGXIWVSQ

SEQ ID NO: 189823 - protein, 122 aa, Triticum aestivum
  unsure (1)..(122): unsure at all Xaa locations
  Clone ID: PAT_TA_84241.pep
ENKGFAFVTFMDKEAAQRAIEDVQDREFKGRTLRCSLSQAKHRLFVGNVPKGLSEEELXNTIXGEGPGVINIEIFKDXHDPNRNRGXLVEYYNILXQTIQANFTPNXKVYGTINVNLANLRL

SEQ ID NO: 189824 - protein, 98 aa, Triticum aestivum
  unsure (1)..(98): unsure at all Xaa locations
  Clone ID: PAT_TA_84242.pep
SNCTAGRAENRGRKEGPDCFSVLLVRVLCINFQDYSVTLGFFWGSYLHFGISTNVEWEGTTHGWGFPLVKKRRKISXAPPWSLTRIPXGSNAGCVFXX

SEQ ID NO: 189825 - protein, 86 aa, Triticum aestivum
  unsure (1)..(86): unsure at all Xaa locations
  Clone ID: PAT_TA_84243.pep
SPCRHCAAKAPSEAGPSGWRFLLPFGKLGFPDLQEVPSSLPPGRENVQIFPWVPPXTEASSPXVGISSRWEAVSPLYPPFTPFXGX

SEQ ID NO: 189826 - protein, 168 aa, Triticum aestivum
  unsure (1)..(168): unsure at all Xaa locations
  Clone ID: PAT_TA_84244.pep
STSTLYPWDPSSTYIHEPPYFKDMTMTPPGPRPVKDAYCLLNFGXDSITTDHISXPAGNIHPDSAAATYLKERXGVERKDSTXYGXSXRGNDEXMVRGTFCHIXRXVNXSXKGEVXPKESHVPXGDXXSXXGAAMKYKMEGMXYXTLAXAXTGGDPRDWVXXPCSRSE

SEQ ID NO: 189827 - protein, 143 aa, Triticum aestivum
  unsure (1)..(143): unsure at all Xaa locations
  Clone ID: PAT_TA_84245.pep
VVITVVSCLITILKSPEGLNKSLVENSAITLGRLSWVCPDIVAPHMXHFMQAWVQCLCARSRDDFXEKEDAFXGLVCXWVGSKPTRSAGSLAYICQXCASWTGDKSEXLHMKVCQIXXXYNTAFGTRGWEHHGALEQTAITYV

SEQ ID NO: 189828 - protein, 128 aa, Triticum aestivum
  unsure (1)..(128): unsure at all Xaa locations
  Clone ID: PAT_TA_84246.pep
XXLMXXNXLLXXXGXXVLRAXXLNXXLMXEXGSPVKCNDAICFXFPKXFLKFXLXIRASHXSHQVFVGVYXGHYYLWSQSTYSQLLXXGILWHPLFTYDLLLMVSHLVPILLXLVXDDXHVYWMSTNY

SEQ ID NO: 189829 - protein, 156 aa, Triticum aestivum
  unsure (1)..(156): unsure at all Xaa locations
  Clone ID: PAT_TA_84247.pep
MAPKAEKKPAAKKPAEEEPAAEKTTAGKKPKAEKRVPAGXSAGKEGGEGKRGKKKGKKSVXETYKIYIFKXCLKQVHPGHPDLLQXHSIMILSSNESSXELGRRAAXXARLQQXPHHXREFKLPALLSPGXXPXRXXXDQHNYSPSCPFGRPGIPG

SEQ ID NO: 189830 - protein, 77 aa, Triticum aestivum
  unsure (1)..(77): unsure at all Xaa locations
  Clone ID: PAT_TA_84248.pep
RRXAPRRGRXSAPXXXXEXTXAPDVGLGXGXVGGHXDXXEGGXGERGGXDGXEGLGXHFLTXQXAGXYRAXXEREMP

SEQ ID NO: 189831 - protein, 116 aa, Triticum aestivum
  unsure (1)..(116): unsure at all Xaa locations
  Clone ID: PAT_TA_84249.pep
MSRGGSAGGGQSSLGYLFGSGEXPKPAVAPAASAPPVGETSAAKTGCGKQVAGWGLPAKPNNYHKXLDGQNTGTSLNGXPXNQSPRCPWAGSSLGTVVGTDPLLGQQTSPAWCVLV

SEQ ID NO: 189832 - protein, 55 aa, Triticum aestivum
  Clone ID: PAT_TA_84250.pep
CICFEVSVNMLWKRIWCTLMFFMICCSSTLLCFRCYVKNIYILTSRKMYVFYGLK

SEQ ID NO: 189833 - protein, 84 aa, Triticum aestivum
  Clone ID: PAT_TA_84251.pep
LASEPGTIRGDFAVDIGRNVIHGSDSIESANKEIALWFPEGPADWQSSQHPWDLREVNMESTSKLGEQEEACHHFVLLAFPKRL

SEQ ID NO: 189834 - protein, 120 aa, Triticum aestivum
  unsure (1)..(120): unsure at all Xaa locations
  Clone ID: PAT_TA_84252.pep
MGPSDSPYSGGVFFLAIHFPTDYPFKPPKVNFTTRIYHPNINSNGSICLDILRDQWSPALTISKXLLSICSDVDRPQPDDPLVPRDAHVYKTXDRPGYEATVREWIRKYASRANTRAGCG

SEQ ID NO: 189835 - protein, 157 aa, Triticum aestivum
  unsure (1)..(157): unsure at all Xaa locations
  Clone ID: PAT_TA_84253.pep
PPXFXRPASTXTGGXGFXDXDXVIRWVSVSFLGLAAPXAAXRRXXALTXVVGAADVVAACASHGRLVRGRRGGDNAGAVTERGGVEEEVXRVEGVVDRARCRWAARTARPLAPTWRVADGRSRALALGSSSSSASAWLLLGVGKLLATRGIVYLLRS

SEQ ID NO: 189836 - protein, 134 aa, Triticum aestivum
  unsure (1)..(134): unsure at all Xaa locations
  Clone ID: PAT_TA_84254.pep
RQLLNILGAVYRYKKLKGMSAEEKQKVTPRTVMIGGKAFATYTNAKRIVKLXVNDVGXAVVNNDPEVXNKYLKVVFXSPNYNVPSGLEVLYPWGSEFPQHIXLAGYGSKVGQAHESSSLNGCVSLDPFXGANVE

SEQ ID NO: 189837 - protein, 131 aa, Triticum aestivum
  Clone ID: PAT_TA_84255.pep
VIPASRGGKWEWENLVTACSRCNSRKGNKTLLQANMKLRKIPKGPKEFDIIAVPLTKSAFRTIRRRHGLPEEWLQYLGRGISMTKGKIPSNHNQVPSSISMVYIYITTSSSPKPSMYVHHSCTCLLLPDFK

SEQ ID NO: 189838 - protein, 79 aa, Triticum aestivum
  unsure (1)..(79): unsure at all Xaa locations
  Clone ID: PAT_TA_84256.pep
LRAKAIGLMPMIDQGEADDKIIAVCADDPEYRHYNDIKELPPQPLGLEIXALLXKDYKEEWRTRRLLVNDFLPSRAPAL

SEQ ID NO: 189839 - protein, 75 aa, Triticum aestivum
  unsure (1)..(75): unsure at all Xaa locations
  Clone ID: PAT_TA_84257.pep
SPAHSLPWXSXVLCPRSIXLFTSLAWRSISMDPHLSXXVHAAXXAAXVFXDGXKLXSDXLPPGGXDPPXXGGCAX

SEQ ID NO: 189840 - protein, 174 aa, Triticum aestivum
  unsure (1)..(174): unsure at all Xaa locations
  Clone ID: PAT_TA_84258.pep
PCLPFALPSLSLSFTQPLTLPVGFPSVVVGAYLVAAGQARKEGGFSAVVPPAWLPAVLLFLAGAASGEPLQQYYNAIFSFXRLLLRHGQLRHHQLRGKLPNMPNSRRRTRGAPNGRLVIRFPGPRRSXPAVPPVXRTRAQFNQRRQFXVMGAKXLDSSIQGQQRVXTRPXXVXG

SEQ ID NO: 189841 - protein, 60 aa, Triticum aestivum
  unsure (1)..(60): unsure at all Xaa locations
  Clone ID: PAT_TA_84259.pep
AMVXGDQIPPSRCSRRRRSWTNXLLELHFPLCARCSLQGRVGVGLFRVGGWMRICCCVSS

SEQ ID NO: 189842 - protein, 109 aa, Triticum aestivum
  unsure (1)..(109): unsure at all Xaa locations
  Clone ID: PAT_TA_84260.pep
MKGKANASKKDEARLRAGGGGAGKRKKAAASGKPXRLPPPSSVFMSEFKAGYQAQTLGNKSVAAXVEQSSKGKVGSMSRAKRXPYVGQAGXRKKQDYEKDLYLEGRSKG

SEQ ID NO: 189843 - protein, 173 aa, Triticum aestivum
  unsure (1)..(173): unsure at all Xaa locations
  Clone ID: PAT_TA_84261.pep
DEDDKSIQPGNFERHWGIFTYDGLPKYQLNLGTSNAGXAVSVRAKGVKYLREEVGACWXLLVNSNDPEVRPTTWGYAVLPWADGTXLGYKTSXPGCWASRGTLPYAFXNNYFPKKNDQDDVAAXFQASADDQRPDPXTGLQSHVSIFSLSAVLESPVSWLGFNYPFPARMWWN

SEQ ID NO: 189844 - protein, 107 aa, Triticum aestivum
  Clone ID: PAT_TA_84262.pep
MALPASSSGLFRFVSPRSRPQSTDIVAAASWGVFAGTAGLYLVQPFDWIKKTFFQKPGTRGMISKAEKCCKSGNLGYTTFVRDDPWMITQANNMNPSSSLGLILSKW

SEQ ID NO: 189845 - protein, 95 aa, Triticum aestivum
  unsure (1)..(95): unsure at all Xaa locations
  Clone ID: PAT_TA_84263.pep
PPPFETXSEAGGWEKSFEXSRASXXXGXXPRXADTPCRCGPGAPHTRSRGPTAAAAGGRRWERLMPLISARREGGCSLGFGSAGCGVGGAAVGVP

SEQ ID NO: 189846 - protein, 60 aa, Triticum aestivum
  Clone ID: PAT_TA_84264.pep
PFVAGLVAYILDNTLQVKESAVRKDRGNHWWEKFRSFKKDARSQEFYSLPFNLNKFFPSV

SEQ ID NO: 189847 - protein, 143 aa, Triticum aestivum
  unsure (1)..(143): unsure at all Xaa locations
  Clone ID: PAT_TA_84265.pep
MATAAVSVDEKLDKLRAEVAKLDQISENEKSGFISSVSRYLXSGEAEQFEWSKXQDPTDEVVGAYDTVASPPRXLQGDERTAGIXPLCSXLNGGSGTTWGCTGAXLSLEAWILDLWDQIPEQMVNVLDDLNTCDNRRCEINST

SEQ ID NO: 189848 - protein, 161 aa, Triticum aestivum
  Clone ID: PAT_TA_84266.pep
MASISVPSRAPSAAEDAENIRKAVQGWGTDEKALIEILGHRTAAQRAEIAVAYEGSTTNHIRQLHPSPGDSRERDDAVDGWPARDAKVRPTSHERSKASGRVVLIRVPCASAPGTSSPLRKATARLSAPWRRTRRGSSSSILGPSTYPTTTASGGRHRVAG

SEQ ID NO: 189849 - protein, 99 aa, Triticum aestivum
  unsure (1)..(99): unsure at all Xaa locations
  Clone ID: PAT_TA_84267.pep
VDIVDTFRLQEQPAFDKKQFISHMKRYIKNLSAKLEGDDLDVFKXKNVESATKYFLSKXKDFXLWLGEEHAWMDGGVGVPYYKGGSCWIQFPWYFCTWG

SEQ ID NO: 189850 - protein, 142 aa, Triticum aestivum
  unsure (1)..(142): unsure at all Xaa locations
  Clone ID: PAT_TA_84268.pep
KVAGHGCFGARLMYDPEFVGDAMSAIAANCDVPVSVKCRIGVDDRDXYERTLVHLVDKVVSNQPTKXILIIHAPEGVAXVAXXLPENRKVLPFXKYXYYYLLLPDFPKXYTFTLNGFNDYWTYAPDKHQWALLTPKGYAGHI

SEQ ID NO: 189851 - protein, 83 aa, Triticum aestivum
  unsure (1)..(83): unsure at all Xaa locations
  Clone ID: PAT_TA_84269.pep
TSRPLSATHFMGMHQSLGIQLAQLGKDASAAGAARRVSAQRKAVEVESVAAAGXNKRFREVVKKLFRAEFVEKRYEXLDEDID

SEQ ID NO: 189852 - protein, 141 aa, Triticum aestivum
  unsure (1)..(141): unsure at all Xaa locations
  Clone ID: PAT_TA_84270.pep
LLEALDQITEPKRPSDKPLRLPLQDVYKIGGIGTVPVGRVETGVIKPGYGSHLWVQLGLTTGGESVEMHHEALQGGLPGRQCWFNVKNVAVKVXKRGXVAPNPKDDPAKEVPXHSQVIIMXHPGXMGTVSPMLDANSPSIC

SEQ ID NO: 189853 - protein, 125 aa, Triticum aestivum
  unsure (1)..(125): unsure at all Xaa locations
  Clone ID: PAT_TA_84271.pep
XFYRRYXDXAXIELXXQFASIRRRGMCWXFPELDPMXXLELHAXGPRIGPSQTEERSASQMXNXSPVPHTVGLRXGXHVYXSRQAKQDQSAVAEVSRRCXDVPATHVNPRGSSALPVRYVANVAS

SEQ ID NO: 189854 - protein, 67 aa, Triticum aestivum
  unsure (1)..(67): unsure at all Xaa locations
  Clone ID: PAT_TA_84272.pep
MARGVVSAKGGTAXXKXKGSVAFTIXCTKPVEXXIMXIASLXKFLQERIKVAXXMXXILGXSVIISR

SEQ ID NO: 189855 - protein, 71 aa, Triticum aestivum
  Clone ID: PAT_TA_84273.pep
DETAGDGAEICNLQIRRLPSPRRHPCGGRHPCIRHRRQVRRLQGRCCGARDWEFPSEKPEKHLGLAQPLNG

SEQ ID NO: 189856 - protein, 155 aa, Triticum aestivum
  unsure (1)..(155): unsure at all Xaa locations
  Clone ID: PAT_TA_84274.pep
NIVKFIGACRKPVVWCIVTEYAKGGSVRQFLAKRQNRSVPLKLXAVKQALXDVARGMAYVHGLGSIHRDLKXDNLLGYXGDKPTKIADFGXYSRIESKNWRELTPGNGTYXWDGPKMIPTQAYDQKFDAYXLXLVLWXSITGVLLPNMTXXSAPW

SEQ ID NO: 189857 - protein, 70 aa, Triticum aestivum
  unsure (1)..(70): unsure at all Xaa locations
  Clone ID: PAT_TA_84275.pep
QXLLFRAGSHSXFSNPYPQRSKLXDHRRPLALCXNIWSCQCPTGLNYISFPXLQTRLDNPGLHQEGRAHM

SEQ ID NO: 189858 - protein, 54 aa, Triticum aestivum
  Clone ID: PAT_TA_84276.pep
DATATSVPALRPWIVDLLPLLVVLLIAAHVLALGYWIYRLATDGSRQPARSKKH

SEQ ID NO: 189859 - protein, 134 aa, Triticum aestivum
  unsure (1)..(134): unsure at all Xaa locations
  Clone ID: PAT_TA_84277.pep
FAAAVAAAVLAGSREYFELVRSTASGGGTPPPRYVSRACSAICALMPILTLYYGRMDVTVAFSAFXVIAIALLLQRGNLRFAQANXSXLGWFYCGLSTFFPGLXPARITAPALNTSIHTVGILLRWTXHWDIGL

SEQ ID NO: 189860 - protein, 45 aa, Triticum aestivum
  Clone ID: PAT_TA_84278.pep
EEFARLFAKFTQDVALVGALLVFLGMKNSIPKRQGKKKAHKAKTN

SEQ ID NO: 189861 - protein, 103 aa, Triticum aestivum
  unsure (1)..(103): unsure at all Xaa locations
  Clone ID: PAT_TA_84279.pep
HGECQQEGRSRCVGAAASPADGSSDDSPPPAAGGYLPRVRPGTSWRGSWHPDGASPVGEPVSSYHALLXFGCRCQNXAAXTTEXPSXSGRDKXXLISVSSFAC

SEQ ID NO: 189862 - protein, 72 aa, Triticum aestivum
  unsure (1)..(72): unsure at all Xaa locations
  Clone ID: PAT_TA_84280.pep
MASLMEVFAGGSLEMKVMEKVXCQKYSATQWESDKPNEYQRQIHYKFSKKLSXLGGEVTGTQQKSLMPNKKG

SEQ ID NO: 189863 - protein, 84 aa, Triticum aestivum
  unsure (1)..(84): unsure at all Xaa locations
  Clone ID: PAT_TA_84281.pep
RSGCAVLPCPPGGPWQVDGVHLRPHIWXRGGRHARTFNTXDRFTGQPRTGLTTAXKXEYCRXYXXSNXGYXPXGIRHXSVTTVY

SEQ ID NO: 189864 - protein, 124 aa, Triticum aestivum
  unsure (1)..(124): unsure at all Xaa locations
  Clone ID: PAT_TA_84282.pep
LAIAVLRRIPQADRYVRAGLWKSRGDYTLTTRFSGKRVGIIGLGRIGQAVAKRVEAFXDCPVSYHQRTEQRATYPXYTYYPSGGWSWAAEQRRAGWXACPAGTRKTRHIXVXREVMXTLGPTAD

SEQ ID NO: 189865 - protein, 96 aa, Triticum aestivum
  unsure (1)..(96): unsure at all Xaa locations
  Clone ID: PAT_TA_84283.pep
ESRRRKPSHCPPLLKAWSLVLHPLLFPSVSLSLSLFGFACLPLLDSSRRVRPWATILGEHPRRRGPADQAAQRTSAHLSKGGGXEQGGEHLFKKKK

SEQ ID NO: 189866 - protein, 126 aa, Triticum aestivum
  unsure (1)..(126): unsure at all Xaa locations
  Clone ID: PAT_TA_84284.pep
RRRSQSPRGSSASQRSYPMAPTSKLSMGIKRASRSHAYHRRGLWAIKAKNGGVFPKXRSRAAAGTQXYPADDVXLGVPSTRKLSHQVRSSTRLGTVLILLXGGVHGKRSWCSSSXQSRLVLVSGPF

SEQ ID NO: 189867 - protein, 168 aa, Triticum aestivum
  unsure (1)..(168): unsure at all Xaa locations
  Clone ID: PAT_TA_84285.pep
TNHLCGRRRLQRQSLIRPRSAHTFSMAEQLASQDAPNPPAPAQRVLMTNTHGEKLVGLLHHMGSDKVVVLCHGFTGSKDYSLITDLAAALTKQGIXVFPFDLSGXMGESEGESQYGNYKKEVLTCICCLVLXQGEXDVHIVXHNKXGDVGLLYPLLQGSHGGNSLAVK

SEQ ID NO: 189868 - protein, 163 aa, Triticum aestivum
  unsure (1)..(163): unsure at all Xaa locations
  Clone ID: PAT_TA_84286.pep
LVPNFKSFDRAAPPALSQLSPMARTKQTARKSTGGKAPRKQLATKAARKSAPATGGVKXPHRFRPGTVXLREIRKYQEXTECHPEVPSXRWXVRXRKTFXDRLPVXXSRVARACKEPPERTGXLFXGTTSXATTPKXHIIPKTSXRARIKXXRLLSSRSVSPD

SEQ ID NO: 189869 - protein, 96 aa, Triticum aestivum
  unsure (1)..(96): unsure at all Xaa locations
  Clone ID: PAT_TA_84287.pep
QSCXHDEGISHPVSIAQDCXVYNRLNQVGVNIXDKIVIDRVLLXTIXQXYWNFVMNYNMQGMTKXIPCALRDTKIGEGRNQEKHQVLMVDKTTSFR

SEQ ID NO: 189870 - protein, 91 aa, Triticum aestivum
  unsure (1)..(91): unsure at all Xaa locations
  Clone ID: PAT_TA_84288.pep
VPGPPXXSIGGIKWXNXQXIMTGVMALSNREXWLPKEQQCNASFXPXGVNHQHWXACRGTPKRACALTLKNVPNTHIITRTLGDXVGRNGA

SEQ ID NO: 189871 - protein, 124 aa, Triticum aestivum
  unsure (1)..(124): unsure at all Xaa locations
  Clone ID: PAT_TA_84289.pep
MADQLTDDQIAEFKEAFSLFDKDGDGCITTKELGTVMRSLGAKPTEAXLQDMINEVXDADGNGTIRFPXEFLQLMVPKMEGHRLLRKXSKEASVCFDKDQNGSSRRXXPHVMTTWVRNDEEWNR

SEQ ID NO: 189872 - protein, 117 aa, Triticum aestivum
  unsure (1)..(117): unsure at all Xaa locations
  Clone ID: PAT_TA_84290.pep
MATSSKPAAPVDPMVVLAHEFPEVSFDYDERDVALYALGVGACGDDAVDEKEFTSVYHRDGQPHIKTFXYFVSLFPNKNSNGVGLXLPGLNFDXKLLLHGQQYIESIRHPFMPMLTG

SEQ ID NO: 189873 - protein, 113 aa, Triticum aestivum
  Clone ID: PAT_TA_84291.pep
LKARYYPLGRLDDTVFTGNASSSWQAISYGLDLLKKGLVWRVGNGRSIRVWRDKWIPRPFSYKPISPQGRCRVRFVSDLLNQNGSWNYELLNAYFVNADVQEIANIRASPRLE

SEQ ID NO: 189874 - protein, 103 aa, Triticum aestivum
  unsure (1)..(103): unsure at all Xaa locations
  Clone ID: PAT_TA_84292.pep
HPSLGLFPTASSSSRLPASFARERREWGAARRPLPLTAKYTYAELEREPTGPSEKLRIPITGGWWVHWDSTCSPSEERGHYTLPLTGRRTXHDRXHFCMSSLV

SEQ ID NO: 189875 - protein, 167 aa, Triticum aestivum
  unsure (1)..(167): unsure at all Xaa locations
  Clone ID: PAT_TA_84293.pep
LVKQAEDSASNKKPEKKDMVGMQEQVFVWKIIELHDKYVAYVTECFQGHTLFHKALXKEPLEASCNKGXSGIPNAELLXTSCDNILKKGASEXSSDEPLKIPFXEVXRLLXNIXDKXLFADSYRKNFQXILSXKXAKDNMRDILTXSXTCGGIYSQMEDGTYVEQTI

SEQ ID NO: 189876 - protein, 205 aa, Triticum aestivum
  unsure (1)..(205): unsure at all Xaa locations
  Clone ID: PAT_TA_84294.pep
PSLLGGGGSSSLRLCTLQWQRDRCFFPLRSSSSWWCWLLRRPPMATAPTATATLLLTQGPVLQGXCPDAEAVVRRLSPKPSKKTPRPTRRCSSPXXRLLSSGAATSXLRQSNXGEHAXKGRXXQQTLDPXNSSXTSKERGXPPRDXPWAEPRXAARSVRWHKWYKALXRRNXQVXRXGRLSNXXVKFDQXDRXXRVVQLXSFRXR

SEQ ID NO: 189877 - protein, 187 aa, Triticum aestivum
  unsure (1)..(187): unsure at all Xaa locations
  Clone ID: PAT_TA_84295.pep
PAPTSPPPPPTTASSSTTTPSTQPPARSASPPAPRSTTPSTSTSSXPSPSTPPSPRPRARXSTSTXSSSTPSATASPSXERALALAPPRRKYTYAAEATAGSQSGTAEGQARRGAATSKWEAESKTRTRRFHASGMGKDPPRNKAKGQGKGKRLGPNPRRLRESCRTTGEHGERGKRGGIRKSSIVL

SEQ ID NO: 189878 - protein, 176 aa, Triticum aestivum
  unsure (1)..(176): unsure at all Xaa locations
  Clone ID: PAT_TA_84296.pep
XYLXAIMXXXHXLXFXXPSGXXRAXLKSSLGPWTSLRFESXVLLVESLHPXPRRLGXXVNXGLPNXFSTKVDNFFDKVVRSLASXMFVEKCRXPSPSHPIGDEXLTLCSLASFDKSKGMFSRLRTRKHLRDHPGEVSAKAYFTSVYLSPGHSRRQEIPYWRGTPQSRSRQPSTPRY

SEQ ID NO: 189879 - protein, 113 aa, Triticum aestivum
  unsure (1)..(113): unsure at all Xaa locations
  Clone ID: PAT_TA_84297.pep
GAAPPVFAGKIRRCWAGGMPPXPGSSPSIVMVPXSQLQGLWFSKQXLQDLHHSEAEXREGXXFXXCSRXXXHSXACXKGGRXNRLRGDXASXXVKADGNLGTXXLRNPSXGGG

SEQ ID NO: 189880 - protein, 143 aa, Triticum aestivum
  unsure (1)..(143): unsure at all Xaa locations
  Clone ID: PAT_TA_84298.pep
QTAPNAGGGASGRRPPSIDPPRLEKGKGLARRWAVELPDASSSSPAVPDPPGFTRSAPDADDAAGARQRKDSEAAWKAQKAWEVAXAPFKNLMMMGFMMWIXXSNCQLLXESDYFSALVEPLNXLRSVGKXFEQFKDQRWILS

SEQ ID NO: 189881 - protein, 140 aa, Triticum aestivum
  unsure (1)..(140): unsure at all Xaa locations
  Clone ID: PAT_TA_84299.pep
NISPVCISTSKXSHXEVIQTSNMLLTCGGTGIAFPPSRSSHPICPQYPNNPTCYSPGVGPSRREVSLRDLDTVEGVDVDESTNCQRGIRLAAVRVGGATGAKDLDEAAETVAANVRALSRAGGLVIAVVAAASARLDLVV

SEQ ID NO: 189882 - protein, 136 aa, Triticum aestivum
  unsure (1)..(136): unsure at all Xaa locations
  Clone ID: PAT_TA_84300.pep
MAPRRLLVLAVVALAATAAAANSGFADSNPIRPVTDRAXASALESTVFXAALGPHPRRVRSARLAVRYGKXYESAXEXHKRLRSLRELQSSVQHRKALLRLGSTGMTGGFVRVRTKCPAYGTRMRALPRGEMRRWP

SEQ ID NO: 189883 - protein, 128 aa, Triticum aestivum
  unsure (1)..(128): unsure at all Xaa locations
  Clone ID: PAT_TA_84301.pep
QLHHAVNRANTSGDPKIPQLRHTARSISFSSSPDLLPRVGTAMATGGVVVLNLRVPSASVAPARPVGGGLEDDHYRTLEAGRPGAPRGEAKRASXRSALQYTRTSXRRGGTTSGKKXTTSRGXXXYXR

SEQ ID NO: 189884 - protein, 136 aa, Triticum aestivum
  unsure (1)..(136): unsure at all Xaa locations
  Clone ID: PAT_TA_84302.pep
XLXTPLXXLTNWPALTXLPIXPEFXPGKFCNPRXEKEDQYXFXMPXKTPTNXVLINPPQGTQFFPXFTAYIHSXAGRRDQGNQLXALDMRVCQXKKNCNQXRSARSHTPYTPKAGMSRILLKPRTLTNRNRGNSFP

SEQ ID NO: 189885 - protein, 101 aa, Triticum aestivum
  unsure (1)..(101): unsure at all Xaa locations
  Clone ID: PAT_TA_84303.pep
SGESGLLPLLPATKSSSSALHLLVFPPPLSLKLRELQAVDFLFKRAHMWSVLQFSLGMVDSCPVFLLAVNSVHTGLTPVPMQIHVWRPLQSIGASWTPFXA

SEQ ID NO: 189886 - protein, 71 aa, Triticum aestivum
  Clone ID: PAT_TA_84304.pep
KRDLEDNNTTDVSTESNDEGLNPKQLPFHEVAQDYQEVDSVISESNENQDRLFTGDATHQVSSNDCYEAGN

SEQ ID NO: 189887 - protein, 71 aa, Triticum aestivum
  Clone ID: PAT_TA_84305.pep
PGYYDGRYWTMWKLPMFGCTDATQVINEVEEVKKEYPDAYVRIIGFDNMRQVQCVSFIAFKPPGCEESGKA

SEQ ID NO: 189888 - protein, 85 aa, Triticum aestivum
  unsure (1)..(85): unsure at all Xaa locations
  Clone ID: PAT_TA_84306.pep
XCXCHIRWKXRWSXVLRKPRVVPXXWARWRPRXRRPGPXXTKRGAAEAERGLGTAAGPRRRRRRRGRREAXPSRLGFLSPPLLPP

SEQ ID NO: 189889 - protein, 83 aa, Triticum aestivum
  unsure (1)..(83): unsure at all Xaa locations
  Clone ID: PAT_TA_84307.pep
RHHRTSDXFMSRSRSFVKGRVPLGPSXGANTGKEPVLAFSPRMSRCWALGSLLPSGRALAPASFLWAPRLGVFSMGPPKNIDC

SEQ ID NO: 189890 - protein, 83 aa, Triticum aestivum
  Clone ID: PAT_TA_84308.pep
DNDAESCCFGGDAASPARWAWCRACGEREASVLLLPCRHLCLCKACEPRTDACPVCSGAKNTAIHIRAQLMASVRRSPGSATK

SEQ ID NO: 189891 - protein, 121 aa, Triticum aestivum
  unsure (1)..(121): unsure at all Xaa locations
  Clone ID: PAT_TA_84309.pep
CSSPALTSSFSSLSGSLPEERHCHTTTPPMLNMMTDLSCGPSSKAKGGQPAAAPGSGGDXQXGRGKIEIKRIXENTTNRQVTFCKRRNGCSKKRTXLRCLRSRRRVVVFSNRGALRVANNM

SEQ ID NO: 189892 - protein, 52 aa, Triticum aestivum
  unsure (1)..(52): unsure at all Xaa locations
  Clone ID: PAT_TA_84310.pep
LFXLFILNFEAGGLNAPNGQVRPLVLFFYFLXYFGFLKAGSSNGTPWGRCAH

SEQ ID NO: 189893 - protein, 132 aa, Triticum aestivum
  unsure (1)..(132): unsure at all Xaa locations
  Clone ID: PAT_TA_84311.pep
DRTALEWRLLYGRIFKTVIILAEQSNAELAVERCTLSHAYKYLPKVFERYSGADGFVFLQDHMXLNYWXNLMQADKEKLGITNXRCTSLGLLSIGETNKEEWVVKQGDMXKQVIXNSPFISQTNYKGDMGXR

SEQ ID NO: 189894 - protein, 55 aa, Triticum aestivum
  Clone ID: PAT_TA_84312.pep
VPTFQSCVFGKHSLDFEVKLLTLLNQVWSSVSMFTRLLLLSITVLHPMIYISCLD

SEQ ID NO: 189895 - protein, 92 aa, Triticum aestivum
  unsure (1)..(92): unsure at all Xaa locations
  Clone ID: PAT_TA_84313.pep
ITVSTSCXXCXDKLGXPLRQQXQERHQXNXXGCYRDEDXAGGXXGLHQLXHQHPVQXREQPVRHRRPPLVSLXLAQQDKEEKSSTXPQFHSR

SEQ ID NO: 189896 - protein, 150 aa, Triticum aestivum
  unsure (1)..(150): unsure at all Xaa locations
  Clone ID: PAT_TA_84314.pep
KYYVKIDPQGEGARWRRTFGQEIYSPLLLAFTEQDGGNWANSHVAKFSAMDSTYSLPDNVAMLTLXELEDGSVLLRXAHLYEAGEDKDLSVFXEYRPQRECSPEKKMARHPXTSYRETKERAAMXEKKRLXWXGKVCWTRSGSGWPVVLT

SEQ ID NO: 189897 - protein, 106 aa, Triticum aestivum
  unsure (1)..(106): unsure at all Xaa locations
  Clone ID: PAT_TA_84315.pep
QQMTQQIQQQQQSLYQQHQQMQHQQQLWQQIQQQKHQLQHMDPQQQQLLSQMVGTELGSDDDTREDWVTGAGAACLGNPGRVNEGYTHSLXGLRCFLSVLSVKSFN

SEQ ID NO: 189898 - protein, 193 aa, Triticum aestivum
  unsure (1)..(193): unsure at all Xaa locations
  Clone ID: PAT_TA_84316.pep
MASIIVIAAVLVLDVLAFVLAIGAERRRSYVNYVSVDPAGXSYCVYSSDASTAYGVSALLLLLAAQAVAMVATRCFCCGRASPPGRWRAWPASASSVCWXVRSVIAELCLLAGSVXRDAYHTKYFPKGRRPAAVRHLARLFAARRLTSRRVFADCILSTQGARRAVARHVDRIPIWKMLCVSVAGHLPQLVLV

SEQ ID NO: 189899 - protein, 132 aa, Triticum aestivum
  unsure (1)..(132): unsure at all Xaa locations
  Clone ID: PAT_TA_84317.pep
EGRILPAGXIGVXTRPVSSHYYVLAIRRTCLDSPPVXLSPSSLARTQADRRPRRNRXFSGGHQAEDVVEIGRSGDSSAVGRRGMEQDREGAMKPGGRRHPFLSDRSSCRRQCGETESPTSNQSPRVIKAAGG

SEQ ID NO: 189900 - protein, 154 aa, Triticum aestivum
  unsure (1)..(154): unsure at all Xaa locations
  Clone ID: PAT_TA_84318.pep
MAAPSAAVIGVLVLLVVGASGARLPGRGSTTRGAALPRGGAPATAVFALGSFWRSEAAFGCLHGVIRTSVGYAGGSKSNPEYRNLADHAECVKVEYDPRLIHYRQLLDVFWASHDPREVXFGQGQDVGNXYRSVIFTNGNIKARLAXLSKEKTS

SEQ ID NO: 189901 - protein, 138 aa, Triticum aestivum
  unsure (1)..(138): unsure at all Xaa locations
  Clone ID: PAT_TA_84319.pep
AARPLLLPPPVLLLLVVLAASSAAHGYGAYGYGDAAAELRVGFYKDSCPDAEAVVRRXVAKAVQEDPTXNAPLLKLHXQXDAFVRGCEGPVLRQLQQGGNTXEXDXKPKXTLDAFDVIRXXQRKRWXKXCPGTSPWAE

SEQ ID NO: 189902 - protein, 127 aa, Triticum aestivum
  unsure (1)..(127): unsure at all Xaa locations
  Clone ID: PAT_TA_84320.pep
VPLLLLLLLSVFTASXAAFCVCXPGMSDQMMQSAIXYACSTXADCASTTXGAPCYGXGNKVAVCSYICXSYYQSRXXMGXXCDFNGVXTLTGTXPXSGXCXVRLRQGTGAGMTACAGVCAGTSGGTA

SEQ ID NO: 189903 - protein, 159 aa, Triticum aestivum
  unsure (1)..(159): unsure at all Xaa locations
  Clone ID: PAT_TA_84321.pep
KLGALPEGLKDAEKCIELDPTFSKGYTRKGAIQFFMKEYDKALETYQAGLKHDPKNQELLDGVRRCVEQINKASRGELSEEELKERQNKAMQDPEIQNILTDPIMQQVLTDLQENPRAAQAHLKNPGVMQKXQKLVSAGIVXMKTVVECPGQWDCAGML

SEQ ID NO: 189904 - protein, 72 aa, Triticum aestivum
  Clone ID: PAT_TA_84322.pep
WIGLKTLDEAGRVKFVSVPGGHLGISKGDMKKYIVPYLTNKKASVTVSDLLVAIWHAVLGLALAEGDDAVLI

SEQ ID NO: 189905 - protein, 51 aa, Triticum aestivum
  Clone ID: PAT_TA_84323.pep
ATHAGSFKCRLHRTNSQGHGHGHPHPSPPASPAAPAQGVSSSASSRTVEAL

SEQ ID NO: 189906 - protein, 117 aa, Triticum aestivum
  unsure (1)..(117): unsure at all Xaa locations
  Clone ID: PAT_TA_84324.pep
XPPVHLPPPVHLPPPVHLPPPXHVPPPVHLPXPPCHYSTQPPRPXPHPQPHXCPCQQXAXXARAKLQXTCXVGSXSXLXQFLEXLXHQXSPTXDXYCXAQCNXFXXMFXXXRQVEPH

SEQ ID NO: 189907 - protein, 160 aa, Triticum aestivum
  unsure (1)..(160): unsure at all Xaa locations
  Clone ID: PAT_TA_84325.pep
MASHHSEPLDPADADDPSDNNPELPCPSYHIVTKPGQLPVEFLEPSAAQKLVIGFDCEGVDLCRNGALCIMQLAFPDAVYLVDAIEGGKELIQACKPHLSXYITKVIHDCKRDSEALYFQVWIKXHNVMDTQXAYSLIEXRRGRKKDASDDTLILALIWF

SEQ ID NO: 189908 - protein, 137 aa, Triticum aestivum
  unsure (1)..(137): unsure at all Xaa locations
  Clone ID: PAT_TA_84326.pep
MDASAEVDHLAAERSAARFDVEAMKVAWAGSRHAVEVGDRMARLVASDPVFRKDNRTMLSRKDLFKDTLRKAAHAWKRIVELRLTEEEAGMLRLYVDQPGYVDLHWGMFVPAIKXQGTEEQQKKGYNGYSSNGCMLN

SEQ ID NO: 189909 - protein, 75 aa, Triticum aestivum
  Clone ID: PAT_TA_84327.pep
MSHAQPLRLQAQWKHVDIQDNQANAMKEPGTSGGYGSPMKDDKNKDVDTIASNFIKLKHRAWALQKSTTMYQPST

SEQ ID NO: 189910 - protein, 62 aa, Triticum aestivum
  Clone ID: PAT_TA_84328.pep
MSGRVAGMVSGAAPSLKCEGAVCFFLSSLIMSGFCIIAFGLSLILVYRTKIVYTSLYGKPRT

SEQ ID NO: 189911 - protein, 108 aa, Triticum aestivum
  unsure (1)..(108): unsure at all Xaa locations
  Clone ID: PAT_TA_84329.pep
MAAAREEDEARPLLLLPRTVQEDQKWWRRWAREAGXVGYLALPMVVVNLSQYAVQVSSNMMVGHLPXVLSLSSAXIXNSLAXSPXFKLLMXMVHGALCAKPTGEDHKL

SEQ ID NO: 189912 - protein, 51 aa, Triticum aestivum
  Clone ID: PAT_TA_84330.pep
TKLHPQLINTSIFVPDRKFCASLSTCRSGLRCRRHFIAYHEVLVSRRWYMI

SEQ ID NO: 189913 - protein, 59 aa, Triticum aestivum
  Clone ID: PAT_TA_84331.pep
NFIRHRASALLFRAGGESLRSPGGVGALQEVKTSEFLGVLLFSLLRFERRREAGVVASP

SEQ ID NO: 189914 - protein, 101 aa, Triticum aestivum
  unsure (1)..(101): unsure at all Xaa locations
  Clone ID: PAT_TA_84332.pep
MGGKDLTEDQIASMREAFSLFDTDGDGRIAPSELGVLMRSLGGNPTXAQSRDIRGARRSQPHPSIPAXLDLMRAHLKARPXXRPFRDAFRSPSRTSLRLRH

SEQ ID NO: 189915 - protein, 102 aa, Triticum aestivum
  unsure (1)..(102): unsure at all Xaa locations
  Clone ID: PAT_TA_84333.pep
GRIGTGPPRVLPNTHQSSTHPQQLGXCCGGXCGCGSAXKCGNAAAXCNMYPGAGAAGPTLLVSATATHKGTPGGMEMAAENGAAAAPQCKCGTSCGCSCCSC

SEQ ID NO: 189916 - protein, 167 aa, Triticum aestivum
  unsure (1)..(167): unsure at all Xaa locations
  Clone ID: PAT_TA_84334.pep
GGRGXRTPRGGRGGGGRGGRGGGMKGGSKAVVVAHKHAGVFISKSKEDALCTKNMVPGESVYGEKRVSVQNEDGTKVEYRVWXNPFRSKLAAAVLGGVDNIWIAPGTRVLYLXAAPGTTVSHVXDIXRPDGLVYLLSLSQDGRDFXNMAKXGQSNIEQASKRWLDVM

SEQ ID NO: 189917 - protein, 189 aa, Triticum aestivum
  unsure (1)..(189): unsure at all Xaa locations
  Clone ID: PAT_TA_84335.pep
GSLDGFNELKRGPRSGMYTNQLGLGATTEVPAKEQDLLSANGSHPAMKDQYNPXDFAETYSRRKIFIIKSXYSEDDVHKSVKYNVWXASTPNGVIKKLGCCLSKRLKENPSEXWFPSFSXXGSKWQFVGXAEMVVLLIFNKTVVHWQQDKWXGCSPVKWDIVKSKTVAEHTSRGGGRYQAYSVYGATVV

SEQ ID NO: 189918 - protein, 117 aa, Triticum aestivum
  unsure (1)..(117): unsure at all Xaa locations
  Clone ID: PAT_TA_84336.pep
LAYLTRQELPEDQNEARCIVRRSKAYRVHEGELYKKAXTGVLQRCISEEEGCNLLAEIHARTWAVITPQPKVFGKQRLPVPGSYWANGPGKMHKALAQRCAGAPLQTKAHATHRPPK

SEQ ID NO: 189919 - protein, 103 aa, Triticum aestivum
  unsure (1)..(103): unsure at all Xaa locations
  Clone ID: PAT_TA_84337.pep
VDGGIETICLDLPAVITTDLRLNQPRYATLPNIMKAKSKVIKKVAAEDLGRXDLDXDMEVIEVXEPPKRKAGVILQCVXDDSLDKLKNGTRVPLTFGIYPPPE

SEQ ID NO: 189920 - protein, 99 aa, Triticum aestivum
  unsure (1)..(99): unsure at all Xaa locations
  Clone ID: PAT_TA_84338.pep
IPAASFTVFAMLAQTLWIPFYDRLLLPKLRKITAKEGGXTLLQRQGIGIALSTVAMVISGHPSEDRRPCHPRSASRRSGTTITGRGRSPACPWWMGAQS

SEQ ID NO: 189921 - protein, 169 aa, Triticum aestivum
  unsure (1)..(169): unsure at all Xaa locations
  Clone ID: PAT_TA_84339.pep
RARGESRARPAPRGESPPTRDESPTRTSRHHRGEPRANLSATPILVQICRHHHPLRPLSTTSASIAVRLGHPSTLRFTPLSKNPRLKKPCSQRRYWQTARXPWVTQNRASSIGYSXXAAPPXVXLTRXNXGSAXXIGFPQXSXKXQIPCTVXKXAFYXXNSXVXRHXGK

SEQ ID NO: 189922 - protein, 73 aa, Triticum aestivum
  unsure (1)..(73): unsure at all Xaa locations
  Clone ID: PAT_TA_84340.pep
SGSISKNPKALLNYYGRNIAITELKMQWKSVLNVTSSILGSLGQDTWVLGEXTLILYRTRXLLSHFLLGQRGG

SEQ ID NO: 189923 - protein, 99 aa, Triticum aestivum
  unsure (1)..(99): unsure at all Xaa locations
  Clone ID: PAT_TA_84341.pep
FXHGXLGXQLIFXWXXLXXXXSXKXXGXGXDSAVAXNAGDMXSKPLYFXFSTQLLRGCNPHXGGKRXLCKIQGWXLLLDNTXIHSNIMEYRIYPIQFMD

SEQ ID NO: 189924 - protein, 97 aa, Triticum aestivum
  unsure (1)..(97): unsure at all Xaa locations
  Clone ID: PAT_TA_84342.pep
MADPAEHRPAEEDEEAAAAGEDEDTGVKVXRPSVKLEEAPLQPGEEDEDXXSTLKAXSYXFDKEANXWXKERGXSTVELLXAQRNRXXXLXMRQXKP

SEQ ID NO: 189925 - protein, 48 aa, Triticum aestivum
  Clone ID: PAT_TA_84343.pep
INPNLPQELRPDSGLYPKIIPLARTPTQTQNMTGSHLPSATDCYINTW

SEQ ID NO: 189926 - protein, 185 aa, Triticum aestivum
  unsure (1)..(185): unsure at all Xaa locations
  Clone ID: PAT_TA_84344.pep
GVSRALVQFRANRPVPAXGLLRLLVAPSVLGVPHACPCGRAGLAAAARQRVHLADPFPKNQWQXWLFRLXXPRXPXKNPTPRKKRAFLGGLVXSLXXQRVWVXFXNXTXNKTXSAVGVLLRRGREFXAANMGQAGALXWXNXHXPSTKRSSYKMSPAPRSXCGVACVSXLXQXEAXHSREGNPXX

SEQ ID NO: 189927 - protein, 101 aa, Triticum aestivum
  unsure (1)..(101): unsure at all Xaa locations
  Clone ID: PAT_TA_84345.pep
RGTGLFPTGKDPFDSPGGGSIGRSSAYLLPVSQMSIXRKHLQPRNGYNWSGQIDFNPAPRRRRQEAPRRSGTGLGAXRRRXGAEAAXXAXTAGNGRXMRXR

SEQ ID NO: 189928 - protein, 115 aa, Triticum aestivum
  unsure (1)..(115): unsure at all Xaa locations
  Clone ID: PAT_TA_84346.pep
XFLARFGEXXVCYNXPRGFSPAXQLXXLTNVMXFPSFRVFXPXDETPAXKXQXXESDSQVGSXFLQXSXXSRIQXPKGDXGPXPPGXGAFXCGSXXRGXRTWVDGQCAGXEGRSG

SEQ ID NO: 189929 - protein, 116 aa, Triticum aestivum
  unsure (1)..(116): unsure at all Xaa locations
  Clone ID: PAT_TA_84347.pep
GXRXIEPXEXHRIXXLLXQXIPIPEYHSILYSAIVDRLRSAFLGSSLSNGRKRSPSIPSQSWIQCWAMGERNPAAXWHTAXETKCSIPSNNXXGASLPPTSPADPXWPAVYLSPDX

SEQ ID NO: 189930 - protein, 90 aa, Triticum aestivum
  unsure (1)..(90): unsure at all Xaa locations
  Clone ID: PAT_TA_84348.pep
GQXKSGWVSNIRVQPPXFCRPSKSRECFXKXSLAECQLDLWRHFTXEARESLAELVVLVEEVAPARGGGSRADEEGGEPHPQHEPHPLRP

SEQ ID NO: 189931 - protein, 120 aa, Triticum aestivum
  unsure (1)..(120): unsure at all Xaa locations
  Clone ID: PAT_TA_84349.pep
EQSRLQIFKACLRKSPVAKDVDLHALAKYTQGFSGADITEICQRACKYAIKGRTSRRTSEREKXKKGQPEAMEKDEXDDIAEIMVXTFXXXMKXYPRXMSMDADIRXYQXRXNIQAXRGF

SEQ ID NO: 189932 - protein, 81 aa, Triticum aestivum
  unsure (1)..(81): unsure at all Xaa locations
  Clone ID: PAT_TA_84350.pep
HPDIXISSKAMSXXNXFINXIXEKLAGEAAKLAXYNKKXXITSREIKTXVRLVLXGEXXKHAVSEGTKAVTNALEQPATVC

SEQ ID NO: 189933 - protein, 86 aa, Triticum aestivum
  unsure (1)..(86): unsure at all Xaa locations
  Clone ID: PAT_TA_84351.pep
PLLADGMLATKSPCPRVSTLDTEITHELKNDLTGXLVTQLXQXTTXTDCSGPANYTATXYXLESCHVLQLKXVREVFRPSLXXSXA

SEQ ID NO: 189934 - protein, 66 aa, Triticum aestivum
  Clone ID: PAT_TA_84352.pep
PTGFGKKHRNLLVQGQCRVKRKPEGQGEVQLRQHVLENGAEDSHLSLKCFLNSARRVASEGRMSFP

SEQ ID NO: 189935 - protein, 192 aa, Triticum aestivum
  unsure (1)..(192): unsure at all Xaa locations
  Clone ID: PAT_TA_84353.pep
VVPCRLLLACSAGLAVAGLPRPCVHLFPPWILDKQWPWRRSRHHPSCATSPGLGQHLHVRRRCRGPLPVGQEQPLXCPLGLYAEXSPGPPXTTPXAPGNLRTWLYRIXAVGDXTTFYPGDXTNXAPSXXLTAQHRXNXTQLRWEPAEVPSTGARFNRRIXTFWXRXHLRXGTTNVKMMVKRSMSGVLQPCVG

SEQ ID NO: 189936 - protein, 114 aa, Triticum aestivum
  unsure (1)..(114): unsure at all Xaa locations
  Clone ID: PAT_TA_84354.pep
XLIDPSIXYPCASSXVDXXESFATQFGGNXPEAQQQETFNAHSRXFSPARSYLCSRGGWHGXGSGRARGAXAVRCYRVPVGAGTPAHAQRPWRPKWGAGPKLSAPRDXXRSGWS

SEQ ID NO: 189937 - protein, 160 aa, Triticum aestivum
  unsure (1)..(160): unsure at all Xaa locations
  Clone ID: PAT_TA_84355.pep
MAPRLACLLALAMAAIVVAPCTAQNSPQDYVDPHNAARADVGVGPVSWDDTVAAYAQSYAAQRQGDCKXIHSGGAYGEELFWGSAGADWXASDAVXPGCPEKQYYDHDTNXCAEGQVCGTTRKXVWARSTPSXCPLXCDTTPXLIICKYNPPGXLETLLT

SEQ ID NO: 189938 - protein, 155 aa, Triticum aestivum
  unsure (1)..(155): unsure at all Xaa locations
  Clone ID: PAT_TA_84356.pep
APIGDWVPAPPESSSFRRELVEALSPPGPGLCVLQGSPKAPWSSQDTLSLEKLPIVDQQXPTRINVISAPKLKVVRYSSVKYYTIMYNSRLIPLLLDINVISSCEDVCLSVIQRSFTQTLGTVKVLALESVGPNLDQVVNCLRCFLCLKKLYIEV

SEQ ID NO: 189939 - protein, 70 aa, Triticum aestivum
  Clone ID: PAT_TA_84357.pep
GLGRRRCPGEGMALRLLSLTLAALLQCFDWEVGGCVDMAEGVGLSMPMAKPLAAVCRPREFVQTVLSAST

SEQ ID NO: 189940 - protein, 107 aa, Triticum aestivum
  unsure (1)..(107): unsure at all Xaa locations
  Clone ID: PAT_TA_84358.pep
AQYVRLGXPXGITGSLWIPRXFSNVXAYVVEXXPIPXFVFIXGGGCLXRRIRRQXDAGRSGLXSALLWRFPFXLKVGVLPLATDGGRRQPIRPPTGAKFVQFHRSLT

SEQ ID NO: 189941 - protein, 159 aa, Triticum aestivum
  unsure (1)..(159): unsure at all Xaa locations
  Clone ID: PAT_TA_84359.pep
PPPSALRCPLASAPERQSLLAPAPPPPRGVGQTLAHRTRRPARSHSPPPPXRRSPRPSAPSPPDPASPRPTPSRSPCVRSTGLSSLPGCAFPYIRASSSGCEEPRALRAIARRRPLAMPQYPSGGEDKDGINGLGRLGSWPGELQPAEMILKCGVKTFH

SEQ ID NO: 189942 - protein, 131 aa, Triticum aestivum
  unsure (1)..(131): unsure at all Xaa locations
  Clone ID: PAT_TA_84360.pep
GRAGYAQPQVEQSVRHLRKIMADDRHXKGVTPKRKLLLGISTTEVIDPILTRRIIRPIQPGPTHLMAAVEQLLTPHISQDMIYTSSWTKRVVRPGPSMDLEDVLRRKIVATKTIILIKYQFGINPGHNNRK

SEQ ID NO: 189943 - protein, 59 aa, Triticum aestivum
  Clone ID: PAT_TA_84361.pep
QKSALREAYKKKKLLPLDLRPKKTRAIRRRLTKHQLSLKTEREKKREKYFPMRKYAIKA

SEQ ID NO: 189944 - protein, 155 aa, Triticum aestivum
  unsure (1)..(155): unsure at all Xaa locations
  Clone ID: PAT_TA_84362.pep
CXCIALHAQVAPXISSGRRHAETRARPRGAGRGRRGVGXRSDGXXXRRPRPRRXPPRRPRPRRRPXXSRXCWPRPXQFXTFIRMLXXHGRGVSXLQPXXQXAGXVSRCSRXRXACSKSLPSXXANSAVRXRSXXGXCXXMXVXRXPXXVXRIXRN

SEQ ID NO: 189945 - protein, 62 aa, Triticum aestivum
  Clone ID: PAT_TA_84363.pep
LRDWLMRGFLWKHGGTYTFCICTSVQPLALSLRVKYTPCTCADLVIFTCLVAGNKSNSSHLS

SEQ ID NO: 189946 - protein, 69 aa, Triticum aestivum
  Clone ID: PAT_TA_84364.pep
AAQLLGSRVVHTSSVRFVASVNYRVVGDQIGSCRVSILPIFSALGVEKHSSEKVHHWTLTTFTFCLKKK

SEQ ID NO: 189947 - protein, 187 aa, Triticum aestivum
  unsure (1)..(187): unsure at all Xaa locations
  Clone ID: PAT_TA_84365.pep
GIQPHVTIYHFDLPQALQDEYNGLLSPRIIDDFTAYADVCFRSFGDRVKHWITVNEPNIEPIGGYDQGYLXPRRCSYPFGTGXVTCTHGNXTTEPYAVAHHSWSAHASVCPSTDAKYQGEQGXRXGLTLLGXWYEPTTXDPRMECQRNILWMVMIPWGTIPPVKGLGRRLPYGQIGMGPVLNWITGL

SEQ ID NO: 189948 - protein, 202 aa, Triticum aestivum
  unsure (1)..(202): unsure at all Xaa locations
  Clone ID: PAT_TA_84366.pep
FPLAELLLPLECSPVEYFRLWPSLPAMVECTGTYTYEGSGFKATAAQQYDSSPFLSGLKSISSKPFHQXCSHFIRTVAGIQVCYAAKTWVGWFXWGMMIFGXASEASRNVDFGVMRPPHDLAILMRASXXPTTKRVKSAPRAGWDDXTDGAVXYMPEDEVXECGRRAXEVSRRGCLXKEPAKXNRKRGGRDETGLMWPGLKY

SEQ ID NO: 189949 - protein, 201 aa, Triticum aestivum
  unsure (1)..(201): unsure at all Xaa locations
  Clone ID: PAT_TA_84367.pep
XKRIIXSFRHXTHPVVAVXRLXVRVSRLLRXTPRRRGGVXGHRGGVRKXKRTXRHAARVRXGAACAYTCLWCPQHSXAVPAPCGRPWPGRQRLGARXGPPCSRSSGHGAHXPSASCRIRHGAGHCAAAECGDTQSHTHTPSTALGPVRVAAGRRRQWRRAGMAPAGTPGRPSRGSTRRSRRSCSPTRPSSSPRSHASGSTA

SEQ ID NO: 189950 - protein, 165 aa, Triticum aestivum
  unsure (1)..(165): unsure at all Xaa locations
  Clone ID: PAT_TA_84368.pep
PPTSSAMSFSSNGGKKPAPGGGRRGPAIRTLADISRGPAGFPGAGGGDSGSDDDEPQEYYTGGEKSGMLVQDPTRRNXXDAIXFEQARQAGIKGMPPPLXGRASKSRSFTXGTGPILYRGRHTSAXPQGTNTNSSTPQYNLWDNXFXVDDGPXRYYDDLKCRSRA

SEQ ID NO: 189951 - protein, 114 aa, Triticum aestivum
  unsure (1)..(114): unsure at all Xaa locations
  Clone ID: PAT_TA_84369.pep
TXXEINNTVLGIQVKYGLHCRNSNXEXGNDPIRYLSVAFNXGPQTAGRMETPYVPINLITARYSCMHYMLSLXLLSSLGFLEVALSVRHQRAVRGSSFLTTTSAAAEAATAARK

SEQ ID NO: 189952 - protein, 94 aa, Triticum aestivum
  unsure (1)..(94): unsure at all Xaa locations
  Clone ID: PAT_TA_84370.pep
TMIKDSFELQKQALATNAVEKLSNHLLAKPLETRQAVAILLALSELCSKXRSNRVGLIXSFRREAWRPEXTQXYLXRXGVRGNXRXXEVPQARS

SEQ ID NO: 189953 - protein, 139 aa, Triticum aestivum
  unsure (1)..(139): unsure at all Xaa locations
  Clone ID: PAT_TA_84371.pep
TLHLVLRLRGGMQIFVKTLTGKTITLEVESSDTIDNVKAKIQDKEGIPPDQQRLIFAGKQLEDGRTLADYNIQXERLSTWVLPPPRWSSHGSFNCCCTWVSASSWCLLGYPYGCPNLWFVFLVVFPGLMTVVPCCSKIS

SEQ ID NO: 189954 - protein, 161 aa, Triticum aestivum
  unsure (1)..(161): unsure at all Xaa locations
  Clone ID: PAT_TA_84372.pep
NDILVEDWLKTHGPNDRTLAQGLKGDPTYLVVESDKTLATYGINAVCTHLGCVXVPWNAAENXFLCPCHGSQYNNQGKVFRXACTLSLALXHADVDDGSLFLRWVGTDXXTGDTRWWEISTSRISSCDIPPASLRTCYINTPAIITFLVPLYYTSMEENFN

SEQ ID NO: 189955 - protein, 82 aa, Triticum aestivum
  unsure (1)..(82): unsure at all Xaa locations
  Clone ID: PAT_TA_84373.pep
VVGLPXKPLQVPAFSLVXXGKXVXGSAGGXVXECQXMLDFAGXHGITXXVEVVXMDYXNTAITAPREERCXVXXRCTSPSKI

SEQ ID NO: 189956 - protein, 121 aa, Triticum aestivum
  unsure (1)..(121): unsure at all Xaa locations
  Clone ID: PAT_TA_84374.pep
MLSADIPPNQTIYLNNLNEKVKKEELKRSLYALCSQYGRILDVVALKTQKLRGQAWVRVXAEITAATNAFPWDCKTFDFLPQKNASXFAXXKSDCYGKRNGTITKEKRKKQEEKLLRKTTT

SEQ ID NO: 189957 - protein, 52 aa, Triticum aestivum
  unsure (1)..(52): unsure at all Xaa locations
  Clone ID: PAT_TA_84375.pep
CKLHLRFLHTPSTPLQQKPTEEQLTDQASLAQEINPERTLQSTGISPCXLAS

SEQ ID NO: 189958 - protein, 51 aa, Triticum aestivum
  Clone ID: PAT_TA_84376.pep
TLVSNLSISSHQLPLTTHNVVNPLYMIIVMSKYSFTWINTFHICTCLSVQV

SEQ ID NO: 189959 - protein, 99 aa, Triticum aestivum
  unsure (1)..(99): unsure at all Xaa locations
  Clone ID: PAT_TA_84377.pep
SLMVTESXASVLRFXXLMLVXLRXECPKVXSFCXXRGMCMTLHXXSXVRQDXFEVASGTIYCFLNHXKLPAKXFLTIMATPFLXYNSEQGYRFFLGGWG

SEQ ID NO: 189960 - protein, 62 aa, Triticum aestivum
  Clone ID: PAT_TA_84378.pep
AAFILCKRYADLCLDPIGNPLTLISPLFPVSYRCSPLCFLMSPWSKQTQNKIWVPSMCGQKK

SEQ ID NO: 189961 - protein, 89 aa, Triticum aestivum
  unsure (1)..(89): unsure at all Xaa locations
  Clone ID: PAT_TA_84379.pep
MQASDRFNINSQLEHLQAKYVGTGHADLSRFEWAVNIQRDSYASXIGHYPMLTYLPIAENDXFGRXXYNXMQKMLLXXASPXKXEXELL

SEQ ID NO: 189962 - protein, 175 aa, Triticum aestivum
  unsure (1)..(175): unsure at all Xaa locations
  Clone ID: PAT_TA_84380.pep
RFPSSSFSGNGSSAIYQNKSSTTQQMGMQNRRPTTTSAAPTYPNRMYPSPRPYTQYGNSVKTGLPYGSNGYDSKDIWSMWSWXMGMDNRYRPRACSXGYYGYGNESQDGTIELNRGPRSGRFKXNQKLYGHTVTIAVKGXSLPSSESKNDSAVPDRXKYNRDDXPVQYDAAKSCH

SEQ ID NO: 189963 - protein, 70 aa, Triticum aestivum
  unsure (1)..(70): unsure at all Xaa locations
  Clone ID: PAT_TA_84381.pep
PPPXRVIRDAVTYTEHARRKTVTAMESSNALXAPGSHPLTDSAVERRYRRLVAVGKVFGSRSKKSESILG

SEQ ID NO: 189964 - protein, 154 aa, Triticum aestivum
  Clone ID: PAT_TA_84382.pep
MASSKREYEDFVPPHKTEREPATHTLTVNLSGQGFKKEHVRVQMVHSQRRLIVRGERPVDGNRWETLRLELLRPRRLRRQGIHAKVRKRVFRVTCLPSRREQSRRQRCEQDVVTRRKTTSTNRGTRNPGDSQPYTHGPWTLVSRSQQMHKGFGP

SEQ ID NO: 189965 - protein, 68 aa, Triticum aestivum
  unsure (1)..(68): unsure at all Xaa locations
  Clone ID: PAT_TA_84383.pep
LNVDGYYNSLLTFIDKAVEEGFINPSARRIIVLAPTAQELMDKLEEYEPYHDMVASTLNWEMGNLXGY

SEQ ID NO: 189966 - protein, 71 aa, Triticum aestivum
  Clone ID: PAT_TA_84384.pep
STKVSSSTYISPVIDSFCSCNCGTTRSVSLRVWVLLDMFHLLVYEETRPASFRLRRVLSLQPVFFSGKKKK

SEQ ID NO: 189967 - protein, 147 aa, Triticum aestivum
  unsure (1)..(147): unsure at all Xaa locations
  Clone ID: PAT_TA_84385.pep
MNSRSSSGGVRSESSLSLGERLCAVFFPVIAIAEAVFFAFTDCLADLCTDSGSSHSRRFGAGASSSAARNSRSNHCQPHHRPFLRRATAGGWTSXQLRQLAXLADESRCFSVNXVEALFELYKKITAHNQHGSSKGWTGQNQTGDLF

SEQ ID NO: 189968 - protein, 106 aa, Triticum aestivum
  unsure (1)..(106): unsure at all Xaa locations
  Clone ID: PAT_TA_84386.pep
MASTFGATSTVGLMAAPTGKECAPSRGGLTSRVKAAKELYFNKDGSXAIKELPDWESNKLCRXXFXLXSGPKGRMSFLGNNYXPKIVNDGVTXQESXTGDLXENLD

SEQ ID NO: 189969 - protein, 67 aa, Triticum aestivum
  unsure (1)..(67): unsure at all Xaa locations
  Clone ID: PAT_TA_84387.pep
FXXQPRAXFTDQXRAKFTDQPRXDFXDQPIPEFRRSAMSRXSPXSLLAEYTDQPRAEFTDQPTXEFT

SEQ ID NO: 189970 - protein, 87 aa, Triticum aestivum
  unsure (1)..(87): unsure at all Xaa locations
  Clone ID: PAT_TA_84388.pep
VSXLXFPTFXILVMLXGLXRFSXGAXPFPCYRGXVTNHXVALYPXTAYHVSRAPTSPLAEIRRSSEDTGRMRTRSSVNXFYPAERRL

SEQ ID NO: 189971 - protein, 104 aa, Triticum aestivum
  unsure (1)..(104): unsure at all Xaa locations
  Clone ID: PAT_TA_84389.pep
EPRRGVGGHRVNRRRRCLAASGKCSQGGSSVRRTKREQSTVGTTTTLGAXHGRGREXAATQXRXDKHRDFDISGGIPSRXPRRHNXGHPSVIXPTPKXLTYXTX

SEQ ID NO: 189972 - protein, 140 aa, Triticum aestivum
  unsure (1)..(140): unsure at all Xaa locations
  Clone ID: PAT_TA_84390.pep
MTVEKVDAGLSDFDAHFDRLFASPDAASDGKVKLLLFLADRKPGSSLSWCPDCNVAEPVIYERLEALEGKDRCSCAXLGDKPTWRDPAHXLRVDXKFGLKGXPTLIAGAPPRPPRHKTQGQGPPRAGTNMIGSFGSNGIK

SEQ ID NO: 189973 - protein, 97 aa, Triticum aestivum
  Clone ID: PAT_TA_84391.pep
RGRLPCVHPVSCGVSAPARQPDVPREYGQQEHPSGVPQHLHPLRCRLLGGRDDKILANYFLLVLKPNVRSWLMHLLDNSISSRADLCHQFVGAFTGD

SEQ ID NO: 189974 - protein, 107 aa, Triticum aestivum
  unsure (1)..(107): unsure at all Xaa locations
  Clone ID: PAT_TA_84392.pep
GVCSSAPRATKRSCPEVKHVHADPRRHVASPSPSACYCCSELYMLAKRCPCFPQYYALLYLCGCLCVHLILKPTENSILLSGWXXCXXTLLSXLPVPXFQLPLLPAH

SEQ ID NO: 189975 - protein, 188 aa, Triticum aestivum
  unsure (1)..(188): unsure at all Xaa locations
  Clone ID: PAT_TA_84393.pep
XFPRXPXIXAAGXXDRDQSQAELWXXIXLRFCCXCMXCSSCRRGHLFRRRRPKPTRAWRVVAAVLLLVSSCPGGGDALRRPWLRTRSWVARLGGNALALRFREGRRRCVRVLSYVGVRTIPKRRRRASTAIYILLSCVDERMPSQAWRARRPRRGGGCLVEMATRVALPGTSQQPLASGKRLAEVATK

SEQ ID NO: 189976 - protein, 77 aa, Triticum aestivum
  unsure (1)..(77): unsure at all Xaa locations
  Clone ID: PAT_TA_84394.pep
RMHTSLLHHLFIRTRICPKSSVDTHMQQIDVQQHHNGTRIHGLPRSKYVRTEPEKKRPTLCPCPXGMLLRHRYPHXH

SEQ ID NO: 189977 - protein, 112 aa, Triticum aestivum
  unsure (1)..(112): unsure at all Xaa locations
  Clone ID: PAT_TA_84395.pep
VEVHPLDFSTNCGKIXFYCWDTAGQXXFGGLRDGYYIHGXCAIIMFDVTSRLTYKNVPTWHXDLCKVCXNIPIVLCGNKVDXKNXXXKAKQVTFHKKKXLQYYEFLAKSNSL

SEQ ID NO: 189978 - protein, 189 aa, Triticum aestivum
  unsure (1)..(189): unsure at all Xaa locations
  Clone ID: PAT_TA_84396.pep
XXTSVTXXVSRAGTKXXSAXAVRRPRXIPKAAFAKLPARXGXQSXXAAQGPEXRRPRRHRRCPWVCRTLACVASAAPPQDGGCAARGVLAFRALRCSADAFHGGLGEAASVCDGGVRGWCEARHPPEFVVEALGAVVGISPEWFSVHEYRPEDFLVVFARQEHRNSVARPSIDHKGVKLFFRQWNRQAQ

SEQ ID NO: 189979 - protein, 74 aa, Triticum aestivum
  Clone ID: PAT_TA_84397.pep
RIRVPSASLHPSRCAHHRQFDRSQRIESWKEGVATRPSTAATAPHSPPTLLLLLLLLLRMGHRKGTGRLPSMPR

SEQ ID NO: 189980 - protein, 58 aa, Triticum aestivum
  Clone ID: PAT_TA_84398.pep
CRRPSVLCPCRYDHTTMTTGHTYTRYLHVLCTRENMLQFELLAHGNCQKRGEEAHTQG

SEQ ID NO: 189981 - protein, 192 aa, Triticum aestivum
  unsure (1)..(192): unsure at all Xaa locations
  Clone ID: PAT_TA_84399.pep
LWASPFVLRARIALSLKGLTYAYSEENLDDKSELLLSSNPVLKKVPVLIHHGKPVCESQIIVQYVDEAFPAAAPNFLPSDPYDRAIARFWASYVDDKFYSAWIPVFKGKTAEEMAEAAKQAVXALETXEQAFKECSXGKXFFRGETLGXXTPAPRLVXWLYATRHLRVKASREDPSAWRTFPLRVGLSDLKW

SEQ ID NO: 189982 - protein, 182 aa, Triticum aestivum
  unsure (1)..(182): unsure at all Xaa locations
  Clone ID: PAT_TA_84400.pep
TXFRSXLGPRNLNLXXVEFIFLLXXSALREQXYNQQPATNTHFHRXRIQXMLXLSVMXLPCWSLSLGSLNYLSXAKXTPDXRGHYHRXALLYCRRPNGXPPLPAAALVAXLRSLRTFSAEEEDVDGAASLRRLWRRRTRRSLPEEEEEPEESVPEEEEEEELADGAMARGSWRWRRRRGKGV

SEQ ID NO: 189983 - protein, 59 aa, Triticum aestivum
  Clone ID: PAT_TA_84401.pep
PKLCFYLERNMAHNDEAGVRAARHSGSCPRRWRNNLTCMRPPPSTPILRPLMVPPRMAR

SEQ ID NO: 189984 - protein, 109 aa, Triticum aestivum
  unsure (1)..(109): unsure at all Xaa locations
  Clone ID: PAT_TA_84402.pep
KKTTPTTKAAVDNTACYTCLPACLHNPQQGRRREREXEXXRQXXSAXXSSKGLLXPVXXQWXYRSXXEXXXGRCRXXSNGSXGGRXXRXIEXGGXPGGXWXXRXFRNWG

SEQ ID NO: 189985 - protein, 215 aa, Triticum aestivum
  unsure (1)..(215): unsure at all Xaa locations
  Clone ID: PAT_TA_84403.pep
TVQHHIEPSRENGNPAQISLVSLRRGEPPAGDVCPVAFPSLRRPGHLLASHGSASCQASKSLSPGGPAPRRLYRADXRDXRQSGNPLHPASTSLAQPHPWSGMPCASPRIPSSLVXTPLXSTINXQRRAFXQIDAKGGEQXXXTMHILXKIVFQXTDISCKFXIXAQTXXXFAKFXNSXFQXQLXXLTXXWKXXLLNXDVXXKXSRLXQLKXDIG

SEQ ID NO: 189986 - protein, 162 aa, Triticum aestivum
  Clone ID: PAT_TA_84404.pep
TVGASTVNRRFSANVVLGSGDTFAGTSLYAGTPLGPSKIPLVYGGDVGSSVCEAGKLIASKVAGKIVVCDPGVNGRAAKGEAVKLAGGAGAILVSAKAFGEQPITPHTSTQQRRDFAVPKKSRVHKNKRPVTWNVLGPSRGSFGQTPARLNRPRVLRDKTPR

SEQ ID NO: 189987 - protein, 115 aa, Triticum aestivum
  unsure (1)..(115): unsure at all Xaa locations
  Clone ID: PAT_TA_84405.pep
EQRYXVKTKRRASKLAFYLVKSFTRRYPIFSALHTRHLEAVAXLLQAHKXAVKXLLEGVXAFKLKLLSXSSQSMPXFSXXXIHFXLXXLHNXLKRXWXXCCXLAXPXDFKXXKVT

SEQ ID NO: 189988 - protein, 153 aa, Triticum aestivum
  unsure (1)..(153): unsure at all Xaa locations
  Clone ID: PAT_TA_84406.pep
METSAPPNAPAPPAQXHGGGCXDFQQSVRLKYVKLGYHYLISHGMYLLLSPLMALVAVQLSTVSPHDLADLWEQLRFNXLSVVACSTLLVFLSNVYFLTARAPCTARLACYKPEXERNARARXHXCSKLTDTDKTQANLVGSGGTTSPRLGAL

SEQ ID NO: 189989 - protein, 73 aa, Triticum aestivum
  unsure (1)..(73): unsure at all Xaa locations
  Clone ID: PAT_TA_84407.pep
NVPDXGSXYFVSQGNRQXNKISFLXXIXINKXPVRSNNRYSIQDRRCEHERLKXHKIVKATQTSLNIDILSQI

SEQ ID NO: 189990 - protein, 202 aa, Triticum aestivum
  Clone ID: PAT_TA_84408.pep
LYGGSIGAAVQQPAYKQKGAASKTNGSRQKVYGYGEAVNTAGAGYGAHHGVVGAGAGQQHGYHQKDAYGTGYGAVAVVGKEKNGYQYQEAYGGTDAGGYGGAHYGGGGAVQQHGYGGVTAGGKVKQSGYQYQEAAYGGTDAGGYGAHYVVAPPPPFRTRYRKDVKARKRGHESTAGFRRAGRIRRVKSDGTDTVPHLKPRTR

SEQ ID NO: 189991 - protein, 186 aa, Triticum aestivum
  unsure (1)..(186): unsure at all Xaa locations
  Clone ID: PAT_TA_84409.pep
VNRNKRISRKGRDDNGDDGDDSDDNSNENGDSSSQKKPRVVWSVELHRKLWLLSTSLGIDKXVPKKILXSMNVXENITRENVSXHPAEXIRCFLKRLXXRFKQAXNLTAAFXGKNXLYXNIGLXXFKXXMHMGEPAFXTTNHLQPNTPKEPPHFVSRPAPSNHWPTLTGIRGMTLGQTRYKSRPEP

SEQ ID NO: 189992 - protein, 85 aa, Triticum aestivum
  unsure (1)..(85): unsure at all Xaa locations
  Clone ID: PAT_TA_84410.pep
GTWGFVYXWXGXLXIVGXXVSRXRVXTPWRGIXSYRRLVPAPPXGCKCKXGFLMWVLFIHVISYSFLHSMDFVFYVFXSNSLVLI

SEQ ID NO: 189993 - protein, 122 aa, Triticum aestivum
  unsure (1)..(122): unsure at all Xaa locations
  Clone ID: PAT_TA_84411.pep
SVLVEINERAYEARTGGALEGVPPRRRGEGQDNMGKWQDNFVSSQGRQGGGNRFGYSSRGAVSGQSGGGHQXRDRGNQGYRGGYGGVSRFQDARGRNQSNPSXRGGDGGAXMVNLNKVGKVK

SEQ ID NO: 189994 - protein, 90 aa, Triticum aestivum
  Clone ID: PAT_TA_84412.pep
GIEQGRPVPNQMMANVGLPDGGVPPQAPPQQSQFPPQQSQFPQQPGIPMDSIGLPDGGVPPQSQPLPSQGFFLQKKAFNLGILNKISPGP

SEQ ID NO: 189995 - protein, 104 aa, Triticum aestivum
  unsure (1)..(104): unsure at all Xaa locations
  Clone ID: PAT_TA_84413.pep
MRPSLCCAPLFLLLLLHLAFARPLFPLPSKTKNEEKKPIQTFRPYNIAHRGXNGEIPRKQLLHTXRAIEEGAVLIDPDTLPTKDGALIXFKDVTLDDTXDVSKR

SEQ ID NO: 189996 - protein, 106 aa, Triticum aestivum
  unsure (1)..(106): unsure at all Xaa locations
  Clone ID: PAT_TA_84414.pep
NKSKQEREIAAAAEKLAECQETILILGRQLQAMRPPAESLGSSPNRQRMEEFXKDAAGTTAGEYFQETFKPTWIQTKDMLGTRNVXPIXGYKTHMIPSXCXXNLFP

SEQ ID NO: 189997 - protein, 97 aa, Triticum aestivum
  unsure (1)..(97): unsure at all Xaa locations
  Clone ID: PAT_TA_84415.pep
RTLLKVIVLGDSGVGKTSLMNQYVHKKFSQQYKATIGADFVTKEVLIEDRLVTLQIWDTAGQERXDLGVAFYRGADCCVPVYMLTPNKSFDTLNTWH

SEQ ID NO: 189998 - protein, 149 aa, Triticum aestivum
  unsure (1)..(149): unsure at all Xaa locations
  Clone ID: PAT_TA_84416.pep
PFASLERLEEMFAAKGLDVEDMVTLSGAHTVGRSHCSSFSDRLPPHVSDMNDTLSGTLATQCSSGGGDTTVPQGLXTPGGWDSQYYRNVXNHEVSSRXDAALLAXDQTADMVSANAFTRGCXETXSKXHVXMGXFGSRQHHVNLECWWQ

SEQ ID NO: 189999 - protein, 77 aa, Triticum aestivum
  unsure (1)..(77): unsure at all Xaa locations
  Clone ID: PAT_TA_84417.pep
NKHHHLFHRHXDGGEEEASAGGKVXXYKIDKHHKHLGQLGGLGAIAXGAYAIHEXAXGDXTTPFNAHGTSEGGGRLV

SEQ ID NO: 190000 - protein, 103 aa, Triticum aestivum
  unsure (1)..(103): unsure at all Xaa locations
  Clone ID: PAT_TA_84418.pep
MPSSSLAFLMALLLLSCSTTMSSAARXLEEETKPAPHPTTTTVPELPKPELPPHPTVPELPKPDYNKTLQLCRAQARQRNPAPSQLNANLFRGSKPEPTGVQT

SEQ ID NO: 190001 - protein, 69 aa, Triticum aestivum
  unsure (1)..(69): unsure at all Xaa locations
  Clone ID: PAT_TA_84419.pep
PKRQLSSRKCLRPRKKAALENEIRLDQCTPAFKWAYNYXGALNPXKVIHCQYFSKGXFPTXCEVXXSAN

SEQ ID NO: 190002 - protein, 69 aa, Triticum aestivum
  unsure (1)..(69): unsure at all Xaa locations
  Clone ID: PAT_TA_84420.pep
RDKFLSYKDLKKRLKLIGAGNGAERQPKRARRDDSGEADXAAAAAAMTPEEAEFMQLLEAELDNSLFFV

SEQ ID NO: 190003 - protein, 45 aa, Triticum aestivum
  unsure (1)..(45): unsure at all Xaa locations
  Clone ID: PAT_TA_84421.pep
MTVDELKLQARASGGHGAKDXFPVGMRVLAXVDDDPTCLKXSEGG

SEQ ID NO: 190004 - protein, 111 aa, Triticum aestivum
  unsure (1)..(111): unsure at all Xaa locations
  Clone ID: PAT_TA_84422.pep
ETLSLDGNSYNGSLHISSRTLRSICFSNCHMGKSELVIEDTPHLXRLLCPWLDGEAIRVSRAPKLGHIGPFVTLHLQIFKIANLIFXGLXQPASNNLDMHSEGPGPXFSLR

SEQ ID NO: 190005 - protein, 70 aa, Triticum aestivum
  unsure (1)..(70): unsure at all Xaa locations
  Clone ID: PAT_TA_84423.pep
YHFPPSFSVVNHVSERDLSVVVGMILFTTHLFNHEMLQYSSSIIXFLDCKNVAVXKGKLLCXXXLAYLXG

SEQ ID NO: 190006 - protein, 119 aa, Triticum aestivum
  unsure (1)..(119): unsure at all Xaa locations
  Clone ID: PAT_TA_84424.pep
DNDRRDAAYAFTATSLSMRSSGVFKRWXIVCALDSSNANVXMLPKGQSXSQPCPSKPAPIQEISNSPTNSXVXQEKQLLLQNFXNLXTYLLGXXRNXSXALVQGGXSVTFXRGKXXKLS

SEQ ID NO: 190007 - protein, 104 aa, Triticum aestivum
  unsure (1)..(104): unsure at all Xaa locations
  Clone ID: PAT_TA_84425.pep
AGMVGTQAVVAFQRSDGSLVAYPTLLDSYAPSMAPAAPGDLAFPVSDVAAEYXDGKEMVLYATLALPAGNGQQGNLTNFCKGMPVVNEFPRNPTTGKNTFRISF

SEQ ID NO: 190008 - protein, 127 aa, Triticum aestivum
  unsure (1)..(127): unsure at all Xaa locations
  Clone ID: PAT_TA_84426.pep
SPAVNRSHAXQEXXIAWSDPMYRXGRGXTGXNLVRXFRQRVVXXTLTIXNTXDGDDAGRXTXRTAVGXCRYTVSWKKKWRCVGAVAAFAPRXRPTAAAVGSSCSCASTAATSSTRKSRSVTSFLXIC

SEQ ID NO: 190009 - protein, 129 aa, Triticum aestivum
  unsure (1)..(129): unsure at all Xaa locations
  Clone ID: PAT_TA_84427.pep
FKNSCIATSIDTSPTRSITSNVNDQYSVTIEIIRPVXSXGALXPIXNRSVALVLKTPIYDINAQFGXPFXXFGNFXILQGLXGFKGXYXTVXSELXXAXGGXQLWPKXCXSWGWXXTXTGLRVLSRHPP

SEQ ID NO: 190010 - protein, 109 aa, Triticum aestivum
  unsure (1)..(109): unsure at all Xaa locations
  Clone ID: PAT_TA_84428.pep
HADTIISNASCTTNCLAPFVKVLDQKFGIIKGTMTTTHSYTGDQRLLDASHRDLRRARAAALNIVPTPTGAGQRXLXLVLPNLKGXXXXFXPGXPTXXXVXLPRESPRR

SEQ ID NO: 190011 - protein, 97 aa, Triticum aestivum
  Clone ID: PAT_TA_84429.pep
RRGAERTFIGGRGFFFSGRGLARRQVRLRAAGASWRDPAMEHAARAPLRLRGSGIHEEGIGTLGGGGGGVLAPLACHGCRGRGVRRAALDPEGWWCE

SEQ ID NO: 190012 - protein, 157 aa, Triticum aestivum
  unsure (1)..(157): unsure at all Xaa locations
  Clone ID: PAT_TA_84430.pep
VRIQXLWXLXEXLGSNFXLPFVNNYHXXXRAQDXLKATVYSLLTGIXNLFQWTXASKTFYGSWEFVXAXXPXRXXDRLRRXTRFCSXTLVVGDXXDTVVLPHTDARVGRAEIDADCRPITLAGHLFSLSAEVAEDGRGLAVAENGRGLAAAGEVTED

SEQ ID NO: 190013 - protein, 44 aa, Triticum aestivum
  Clone ID: PAT_TA_84431.pep
TTTRLLDYFNDYYPNLLITIRNSCLDPAQSPHFHPKVEELYLPI

SEQ ID NO: 190014 - protein, 61 aa, Triticum aestivum
  unsure (1)..(61): unsure at all Xaa locations
  Clone ID: PAT_TA_84432.pep
FFFXANRSLSXXNPNTLFKNDSRSRECGTESQTTLISHGGSTESSTKTLFVCAELVGRNDS

SEQ ID NO: 190015 - protein, 157 aa, Triticum aestivum
  unsure (1)..(157): unsure at all Xaa locations
  Clone ID: PAT_TA_84433.pep
TNGGSGSGGGSGYGSGSSSTAASGPSSGNYADAEGKGAGGGMGGGANGAYGSGAGGGVGKGEGXSGVALAPSSNGYYNGGAADATGGGSGAGGGHGGGAAGXNYGTGGGLXGGKVKPXTMVLGVKLSQGIXAXXSGVGGGXPRXSGGVELVRGTVNH

SEQ ID NO: 190016 - protein, 85 aa, Triticum aestivum
  unsure (1)..(85): unsure at all Xaa locations
  Clone ID: PAT_TA_84434.pep
MSSQLIEEHRSGAEVHVGHELCERKSREFMVELGSPTGXSPLPSLDXVGYNRSTGCCCGKAAGTKISFNNKCGKGFLEPRLKLSR

SEQ ID NO: 190017 - protein, 50 aa, Triticum aestivum
  Clone ID: PAT_TA_84435.pep
FLHDPVSFTAVLHPEYFTFKKGVVRVETQGICTGHTLMDQGLKKYVFFSL

SEQ ID NO: 190018 - protein, 57 aa, Triticum aestivum
  unsure (1)..(57): unsure at all Xaa locations
  Clone ID: PAT_TA_84436.pep
MAGKEILHKVKDKVKDAFSSSRTKKQGKARQSYQGKRVKHGYHLXVXGKSNHPMEDY

SEQ ID NO: 190019 - protein, 191 aa, Triticum aestivum
  Clone ID: PAT_TA_84437.pep
KRGLHFPPWRKREYMRAKWLSPHARSSSSADRTPAPATPVSAAAAAFSGEFELWFDEKEKPKAADYDGGIPGGEDDGAGKKSRSWCRRRRPVACGRTRGRLASCARKPSSGDRAGVPAAATDHQTKRIRPVQKFSFSNTPNSIPPILRPSSVYFPSDKMKKEERTSFSSNFPCCKKFISPGNEDRNWSRPF

SEQ ID NO: 190020 - protein, 113 aa, Triticum aestivum
  unsure (1)..(113): unsure at all Xaa locations
  Clone ID: PAT_TA_84438.pep
NFLEIFFHFXLQXHQXISSNFSVLLCXSCPCRXIFLXDNLXAARLRXXDXSGRRSGSNPAPGDHLRVGVGVVAAAEHYDEVVGEGEDVVHLQPTPRIRLHRNGRHRPRRTPEP

SEQ ID NO: 190021 - protein, 172 aa, Triticum aestivum
  unsure (1)..(172): unsure at all Xaa locations
  Clone ID: PAT_TA_84439.pep
QTRDELKAAHTELAEDGAIEIIIIKTTGDMILDKPLADIGGKGLFTKEIDDALLXGSIDIAVHSXMKDVPTYLPXEGMILPCNLPREDVXRDAFICLDCKTLGGLPCWVVLSGSASPGGSISNSPNNILQLKFVNFXRNFKHGLRNFKEXDXHATLLALGGTKTLNMPRTQR

SEQ ID NO: 190022 - protein, 108 aa, Triticum aestivum
  unsure (1)..(108): unsure at all Xaa locations
  Clone ID: PAT_TA_84440.pep
MEVDDGSRATPPLDAVAAAFKSQVMELQDLVLARSMFPATALPDLANVDALVTAXMDRKVENISRRLQEXELDAIPKGQRXXVKRSLKGGKKKLXHMLANLPSGNAQE

SEQ ID NO: 190023 - protein, 191 aa, Triticum aestivum
  unsure (1)..(191): unsure at all Xaa locations
  Clone ID: PAT_TA_84441.pep
PGRGRQRRPPACHVHPKRWHGPPHPILPLHRGSRWAERRHLCGDCPSYRFCRRGGLLHQPLPLPSPVSAAFXLHSCRSTRPSSQSNDRDRSFSGWEALRRSTHSWARLMPXPPHALRPSLQTXPDSKXSHRQGLRVQCTLFPQXNNLSSLLNPVKSKEGXKECIGSQSRCVXNXSVPRAXTQXFTTLXXRX

SEQ ID NO: 190024 - protein, 123 aa, Triticum aestivum
  unsure (1)..(123): unsure at all Xaa locations
  Clone ID: PAT_TA_84442.pep
NVGRVPINVSHLCFMGDTRRFKIKXTLTWLGHYLLQAXFPAQLCLIIRVWYLLSQFNTDPHPFKSIPCLHFQXQHSILALKPPRLWRHRYARTRLNPGSNDXSLHLXTRDNINXXWXSQXITT

SEQ ID NO: 190025 - protein, 132 aa, Triticum aestivum
  unsure (1)..(132): unsure at all Xaa locations
  Clone ID: PAT_TA_84443.pep
RXCQNMSMLRYLXIQNHPGNLSVPCYPSRDDAKHPGAFGTLERIWASEILADVEGGSIYGICPEFFLSAQNLVSDWMVDWSGCGGARSALTPALMPKRMVSWASLISLFMLLLCIFSATPPLSVATREKPRT

SEQ ID NO: 190026 - protein, 98 aa, Triticum aestivum
  Clone ID: PAT_TA_84444.pep
FSPNMSRLRYNVAASLDGFIASPDGSTPWIIEDPTIDFPALYSEFEYFIMGRKTYETMQSFGADNPLSESPKESVIVVIRTMTPDHFPRYYSHKRKRA

SEQ ID NO: 190027 - protein, 186 aa, Triticum aestivum
  unsure (1)..(186): unsure at all Xaa locations
  Clone ID: PAT_TA_84445.pep
LPPQQAPPDRKGRGGAGGGVMESGSRSSGAAGFDDDDGLTTRREVSSSLQDLTVRVDRKGGSCSDGGTDQRPNTPRSKHSATEQRRRSKINDRFQXLXELLPHSDQKRDKATFLLEVIEYIRFLQXEKVQKYXATFQEWDQENAKDASWVIAFKLQCLVLLLQGKINSDCRECNISSIVFHYRKIQ

SEQ ID NO: 190028 - protein, 92 aa, Triticum aestivum
  unsure (1)..(92): unsure at all Xaa locations
  Clone ID: PAT_TA_84446.pep
RGARLRAQATYKVKLVTPEGEVELEVPDDVYILDSRRKXGIXLPYSCRAGSCSSCAXKFGSGXIQPIPXKSXXNXNKLKXGWLXTCKPXPNS

SEQ ID NO: 190029 - protein, 114 aa, Triticum aestivum
  unsure (1)..(114): unsure at all Xaa locations
  Clone ID: PAT_TA_84447.pep
MAAPSPSPVEATLPPEAAAAAEEDQWDADGYVIPNLPTQDNDVAEPSVPKEKDPEPLQANDEKIYLGPHGXPPSQAKQQELNTVCRKQXSRNKLKEQXEFPXNAQGEQVENLRD

SEQ ID NO: 190030 - protein, 123 aa, Triticum aestivum
  unsure (1)..(123): unsure at all Xaa locations
  Clone ID: PAT_TA_84448.pep
RKLLNNLGVSPAAATTMISILAQERLLGFALGSVSMGGFVLHQRRSIYRSLADADAASGGASFSYQTSATTGXEEFQAEMAHVWNKAVDETLXRLVVYLNSPWDNSSIESEALLPGSRVVVLN

SEQ ID NO: 190031 - protein, 93 aa, Triticum aestivum
  unsure (1)..(93): unsure at all Xaa locations
  Clone ID: PAT_TA_84449.pep
KCRAFMQHXDIKPAPMFLPSTSYTVIHKKMNFXVQLAEGHIGTPNCHDGLLXCHDLKLHLXPWTTFCXNGHXIAWRKNALHAXNTVQVXQCIA

SEQ ID NO: 190032 - protein, 98 aa, Triticum aestivum
  Clone ID: PAT_TA_84450.pep
PTNTLARYRFMAVCFVSTVVDHFSGKVVSVAHLSQQGRLPMRCFCQACCAEMKSTESHIHISGNHRFLHHHPTGPRRLFQTPLSQKAPFHMYLSTELS

SEQ ID NO: 190033 - protein, 92 aa, Triticum aestivum
  unsure (1)..(92): unsure at all Xaa locations
  Clone ID: PAT_TA_84451.pep
VACREAPSAWRTAAKRKAXXEATRAAAKGXDXATAAETGLGAGASAAAATEKETAARTAATARAFDPTPAIACFASTGCGLWCGGGEMVPEG

SEQ ID NO: 190034 - protein, 65 aa, Triticum aestivum
  Clone ID: PAT_TA_84452.pep
RNQGRVDDNIETIKKRFKTFVDSTLPVIEHYNSKDKVKKIDAAKPIPEVFEDVKAIFAPYSLKAE

SEQ ID NO: 190035 - protein, 47 aa, Triticum aestivum
  Clone ID: PAT_TA_84453.pep
HRTNPIAPRLHWGLGNNITAQNRFDTTLVLKCSLVYTVLVSLFCLAQ

SEQ ID NO: 190036 - protein, 111 aa, Triticum aestivum
  unsure (1)..(111): unsure at all Xaa locations
  Clone ID: PAT_TA_84454.pep
HLVLRLRGGMQIFVKTLTGKTITLEVESSDTIDNVKAKIQDKEGIPPDQQRLXIFAGKQLEDGSHPXADYNIQKXPPSPGCSAPVANSLSLHLLLLLLFSCGPLFKCCPFV

SEQ ID NO: 190037 - protein, 132 aa, Triticum aestivum
  unsure (1)..(132): unsure at all Xaa locations
  Clone ID: PAT_TA_84455.pep
EGRLSDSVASLLLFLEAFGWWCSQLLLTRSGRTRTTAAAAYPKMARPPILSVALPSDTGRVLSIQSHTVQGYVGNKSAVFPLQLLGFDVDPINSVQFSNHTXYXTFRVKFLMANSLGLXEGLEENHCSIYQL

SEQ ID NO: 190038 - protein, 56 aa, Triticum aestivum
  Clone ID: PAT_TA_84456.pep
MGLFRGSFTLLVGMGCGVYIAQNYNVPNVKKLFNTYVFLAKHIEETYRKPKKKDDD

SEQ ID NO: 190039 - protein, 32 aa, Triticum aestivum
  Clone ID: PAT_TA_84457.pep
RKLPYILYIIHDKISRAHPCLIKFKMYSQGTY

SEQ ID NO: 190040 - protein, 70 aa, Triticum aestivum
  unsure (1)..(70): unsure at all Xaa locations
  Clone ID: PAT_TA_84458.pep
QMVACSTPYNAKGLMKAAIRSENPVVLFEHVLLYNLKEKIPDEEYVLCFGGRPKWCRPGXNLXILKXSAH

SEQ ID NO: 190041 - protein, 167 aa, Triticum aestivum
  unsure (1)..(167): unsure at all Xaa locations
  Clone ID: PAT_TA_84459.pep
MATRSLELTLISGKDLKDVNLMSRMEVYAVVSLSGDPRSRQRVXADRTGGRNPXWNATLRFAVPTTXAGPSNSSSRAERALRRRDFGEVXIPLXXXLSGXPEGLSRQFVAYKVRNFLRQGSTLKGKSPTGPRFAGNSLSHLNGATALKKVTLLRRYRSSEGYPTRTF

SEQ ID NO: 190042 - protein, 49 aa, Triticum aestivum
  Clone ID: PAT_TA_84460.pep
STKAGEGSVKKDAISPHGGTSSSSNQLVQHGVYNQGMGYMQPQYHNGET

SEQ ID NO: 190043 - protein, 76 aa, Triticum aestivum
  unsure (1)..(76): unsure at all Xaa locations
  Clone ID: PAT_TA_84461.pep
MAVHGGEAVSVALLFSLAFFCARLLLDRLXVYKPLAVYLFNTKXSKLMNNEXRQAKIVXFSRSIWELTYXLCSSMP

SEQ ID NO: 190044 - protein, 127 aa, Triticum aestivum
  unsure (1)..(127): unsure at all Xaa locations
  Clone ID: PAT_TA_84462.pep
GNHQRYLATGIRVGLASASACSDACDAHDSDHHAPPKATIEPPHAAVSAAVQQVPSPPQFLPQGWAVDEXLHSXTTSPSDKLHKERRSXQRSGWSPDIDSSTSKRPKQQDFAEVPDFFGIQAANTRV

SEQ ID NO: 190045 - protein, 186 aa, Triticum aestivum
  unsure (1)..(186): unsure at all Xaa locations
  Clone ID: PAT_TA_84463.pep
MASEKSKILVVGGTGYLGRHVVAASARLGHPTSALVRDTAPSDPAKAALLKDXSKDAGVTLLKGRPVRPRLAWVSAVKXADVGISVLXDSMQIADQSRSSTPSKEAGXSSCPACSKLLACSSIFLSLAALLQICNCMPNLVPLLPGKSPVGFGWTGRTALERQSSRKWDRQQARILTSVSVQLPES

SEQ ID NO: 190046 - protein, 56 aa, Triticum aestivum
  Clone ID: PAT_TA_84464.pep
EGDWCIVRLSSHRHHLQSLLHHPLARTCPAGRLRTCLVHLSHSQLLVTVGLHAYDL

SEQ ID NO: 190047 - protein, 141 aa, Triticum aestivum
  unsure (1)..(141): unsure at all Xaa locations
  Clone ID: PAT_TA_84465.pep
VAVTASALDKPVGASGCRWEGTAPYCDGECEPGWTERGRSQCGDGSCCWTGSKALCCEDEDASRNWVQQQDKVWRFWXSMGXXTTSLXAKSQFQPCLIKRDPINLRMXTAFDLXXRPFXXNTIXPVSKIFPILGNNPSXKK

SEQ ID NO: 190048 - protein, 147 aa, Triticum aestivum
  unsure (1)..(147): unsure at all Xaa locations
  Clone ID: PAT_TA_84466.pep
MGFDVGLVPYNPDGWGPPEVAAAPPSLGGGSSSVPFAPFSRSDKLGRIADWTRNPPGPGAFAAARDAVFDFAGLEDSIGLASADDSSFRLVDGKPPPRXPRFGLAGRFNNXPTPQRRDXSQRVRSKPATHGTKRDTNAPSKRLNNWP

SEQ ID NO: 190049 - protein, 57 aa, Triticum aestivum
  Clone ID: PAT_TA_84467.pep
PKTAAARSTRDSSNQPWPQPMDPSSICMLSSVRPPSLLQAGANKLASCCCCLKKRGG

SEQ ID NO: 190050 - protein, 128 aa, Triticum aestivum
  unsure (1)..(128): unsure at all Xaa locations
  Clone ID: PAT_TA_84468.pep
AREELRKAKEHDKEKLCNISRALAVLASASSVSKERQEFLSLVNKEIELYNSMLKKEGTEGEEAAKKAYIAAREDPDNDAEAAAXRKVSSALIEKVDAMLQELEXEXDDVDAQIGNRWNCLITTLQDS

SEQ ID NO: 190051 - protein, 94 aa, Triticum aestivum
  Clone ID: PAT_TA_84469.pep
RQLLGLRLEVAQLAELRQVVVPGVDGGGFREGVHRRVAARRLGRAPRRDAVEVAPNLGLHPCRLLGWQVWVAARRPLHRHGRFFVSLLGSQLWL

SEQ ID NO: 190052 - protein, 106 aa, Triticum aestivum
  unsure (1)..(106): unsure at all Xaa locations
  Clone ID: PAT_TA_84470.pep
MSGRGKGGKGLGKGGAKRHRKVLRDNIQGITKPAIRRLARRGGVKRISGLIYEXETRGVLKIFLENVIRDAVTYTEHARRKTVTAMDVVYALKRQGRTXYGFXGLS

SEQ ID NO: 190053 - protein, 64 aa, Triticum aestivum
  Clone ID: PAT_TA_84471.pep
KHRKTNLRSIYSNITDHAAANIQRNITNGRTRSSVITNNRTLIHSNEAKNNVIISNNTQRVKLH

SEQ ID NO: 190054 - protein, 70 aa, Triticum aestivum
  unsure (1)..(70): unsure at all Xaa locations
  Clone ID: PAT_TA_84472.pep
KHSGCXYHSSSCXCXFXFQLMTGMDSLLXYXXRWLVYSFFSPXXNNLXVVAITVLLSLRKXYFTAXNXEK

SEQ ID NO: 190055 - protein, 154 aa, Triticum aestivum
  unsure (1)..(154): unsure at all Xaa locations
  Clone ID: PAT_TA_84473.pep
LESAKEEVASAMDQLKEAESETKALRSMTQRTVLTQEEMEEVVLKRCWLARYWGLAVQYGVYPEIAVSKHEHWSSLAPLPLEVVLSAGQKAKEEPRKQGDNVQGRNKLAREMSDVMGRXNIESMLSIEMGLKRAFSMXVENAVVVQLGNIAXLT

SEQ ID NO: 190056 - protein, 88 aa, Triticum aestivum
  unsure (1)..(88): unsure at all Xaa locations
  Clone ID: PAT_TA_84474.pep
EERGVIVIRAQGCEEQACFLXAAVCXGISNWKACGDKNKEHGRGSIKLHKCLQDKDEQLHQSQVATEQEPTEPSXCLXWEICXQXXSS

SEQ ID NO: 190057 - protein, 171 aa, Triticum aestivum
  unsure (1)..(171): unsure at all Xaa locations
  Clone ID: PAT_TA_84475.pep
EDADYAIKTLNMIKLYGKPIRVNKASQDKKSLDVGANLFIXGNLDPDVDEKLLYDTFXSAFGVIVTNPKIMRDPETGNSRGFGLXAMSPFESSDQAIEAMNNQHXXNRPITVSLCFTRKARKGERHGTPXERLLATNIQDLKKNRXHTMFASGPPTKASKWGPVHGLWNGS

SEQ ID NO: 190058 - protein, 181 aa, Triticum aestivum
  unsure (1)..(181): unsure at all Xaa locations
  Clone ID: PAT_TA_84476.pep
DLVYDCGQSLNPAVDLGQIEGCFVQGIGFFTNEDYKTNSDGLVIHDGTWTYKIPTVDNIPKEFNVEMFNSAPDKKRVLSSKAXGEPPLXVLAASVHCAMRXAIXAAXKXSRSTQXREIRRQFXMDVPATMPSXKELCGSTRGEVLNCLPQCRPNRIQQAQRMQNIVCIKIGNKTQINFKYL

SEQ ID NO: 190059 - protein, 81 aa, Triticum aestivum
  unsure (1)..(81): unsure at all Xaa locations
  Clone ID: PAT_TA_84477.pep
NLAARPGRVVGPVLPFESASVTDQHIARRVARNPAVPPATNTSSVYCYHLKSDSSDRQEHHLEXEKVRRQYRPGQXFMDAK

SEQ ID NO: 190060 - protein, 136 aa, Triticum aestivum
  unsure (1)..(136): unsure at all Xaa locations
  Clone ID: PAT_TA_84478.pep
SPLSGHXSWPVRMDVACGGSWSVLGGGRXLLGQVSRPLWPWRAXPLPLLALPASPAPAAARNPSSNSFPAISRVLGSDLKRVSISARLLSPILGGWSSGNNIGCGGGAASGVGSGRWRLEEAEASREMACVLCTGR

SEQ ID NO: 190061 - protein, 86 aa, Triticum aestivum
  Clone ID: PAT_TA_84479.pep
VMDTRLGGQYPKRQAQDMAALALRCLQNDPKSRPSMADDVLPSLELLLQPSAAKSFSSSSTTTTSRSPAASAALGAQRPPFETKPS

SEQ ID NO: 190062 - protein, 80 aa, Triticum aestivum
  Clone ID: PAT_TA_84480.pep
MMILAIIVLLFSTITVMTSLVALSFYGASQIKFHWVERYDKILVGTVLCLVGVLTYVFHHHDGDEHVHQETPYLPKMHIY

SEQ ID NO: 190063 - protein, 101 aa, Triticum aestivum
  unsure (1)..(101): unsure at all Xaa locations
  Clone ID: PAT_TA_84481.pep
GVWSRTEIEKAKTQCLEFPRSGGGEXGXKGLLXAKTTAAKSAXXDXGKKAPISRSSRAXLXFPVGRIHRQLXQRTXANGXVSXXXSXYSAAIXXYLTAXVL

SEQ ID NO: 190064 - protein, 150 aa, Triticum aestivum
  unsure (1)..(150): unsure at all Xaa locations
  Clone ID: PAT_TA_84482.pep
LLPDTRERIVATEVTAWWRYPFEHVSQLPSKPFCFTQRYQDVKKVLAETFFGPPDVGVYSPSVQNTLYLMAKESLQGSQDISVIQLRMPNLHFLPVNLGEQRTPLVKFADDVYLPTDEXHGTIEQLYKRPQSCKKMYPQAGINSLPTPQA

SEQ ID NO: 190065 - protein, 149 aa, Triticum aestivum
  unsure (1)..(149): unsure at all Xaa locations
  Clone ID: PAT_TA_84483.pep
STSPRRSSGGDSASPSAPLIPSPPTSPASGPSGGPLGRLTSLRGAARFIRRTGSRRLMREPSVACREXTAAEHLXEERQTDWGLLRSPSSVLRHALGTSPSVAVAAAXSPASXGEAATVPSXFWXVGTAPCLLNYQAHRLKPPTDKKER

SEQ ID NO: 190066 - protein, 82 aa, Triticum aestivum
  unsure (1)..(82): unsure at all Xaa locations
  Clone ID: PAT_TA_84484.pep
DPXVXXIRSXRXNXDLELSRQXPXXRGXHXTXXPHXXYSRRIXSXXXNMSSVXSGDLXXPFFGFLGXSSLSFSHDMXGRIRD

SEQ ID NO: 190067 - protein, 80 aa, Triticum aestivum
  unsure (1)..(80): unsure at all Xaa locations
  Clone ID: PAT_TA_84485.pep
GPAPRCWLVGGGGDSNQSRLVKTKLGKKKTIQRNKXXVTXHRRGLXAGIXXLXESLXLQKXAXXXIIXHEVXLFFXHIXF

SEQ ID NO: 190068 - protein, 76 aa, Triticum aestivum
  unsure (1)..(76): unsure at all Xaa locations
  Clone ID: PAT_TA_84486.pep
WDADFVKVDQATLFDLILAANYLNIKGLLDLTCQTVADMIKGKTPEEIRKTFNIKNDFTPXEEEEEIRRENQWAFE

SEQ ID NO: 190069 - protein, 74 aa, Triticum aestivum
  Clone ID: PAT_TA_84487.pep
EFMVHSLLLAVSPSESMQGMLSEFIVPEEVQGHRSMELGKTFGVAKELIADRCSTVVIQYTALSYHCPSKNSII

SEQ ID NO: 190070 - protein, 94 aa, Triticum aestivum
  Clone ID: PAT_TA_84488.pep
FFFLPINSLPFIWKLAQMRKKTARVFLKDWAKIVADHLNWVTDPCSPQAPWKSTQWPAIVSPCLASPRAGLCSSRTAAEGSPSGSEPLVPAPAL

SEQ ID NO: 190071 - protein, 121 aa, Triticum aestivum
  unsure (1)..(121): unsure at all Xaa locations
  Clone ID: PAT_TA_84489.pep
DPNFGQSCLGKLSPCILRLNGXHLIGPSQGXRWILVSKVVDVSSNVCAGTIXPTSGPFEHIPLXSNFEKXPRLEGPRVQGLAIYGHPTARGHPRKKRMLESNGANKVTQKLGDIDLLGLDL

SEQ ID NO: 190072 - protein, 91 aa, Triticum aestivum
  unsure (1)..(91): unsure at all Xaa locations
  Clone ID: PAT_TA_84490.pep
MFLWDWFYGVLASLGLWQKEAKILFLGLDNAXKTTLLHMLKDERLVQHQPTQHPTSEELXIGKIXFKAFDSAAQXARRVWKDTTKVDAYTR

SEQ ID NO: 190073 - protein, 147 aa, Triticum aestivum
  unsure (1)..(147): unsure at all Xaa locations
  Clone ID: PAT_TA_84491.pep
APVSPPPPTSVGPHPRVDGARASLLQVRRRHQAPLPHRAISSPAALASLEIEQIHHPAPSPHHALTLAPHPCAAIPSARPRLILPCPRTASKRVNSSVVAAIPAHATXXKPPRAVRKLRXISQPGPVLLTSSVPRHPYPXGISGDKX

SEQ ID NO: 190074 - protein, 72 aa, Triticum aestivum
  unsure (1)..(72): unsure at all Xaa locations
  Clone ID: PAT_TA_84492.pep
MEGLTESEVAGFAVGAFLLGASIAAXRVDGFVAASQEKSLNMXKRCXDLXDGGCSXCXGXAPXXKGELQFRR

SEQ ID NO: 190075 - protein, 100 aa, Triticum aestivum
  Clone ID: PAT_TA_84493.pep
RCPSVMKCRTQIVQPVTWMISNSEVCITHGNGTIEIHSYKTLVSHRTRTQQIELGNNRCLMQHLDDSDFVGHIKSIIVGSQLHVSLLLPIRPDQGVDLLC

SEQ ID NO: 190076 - protein, 88 aa, Triticum aestivum
  unsure (1)..(88): unsure at all Xaa locations
  Clone ID: PAT_TA_84494.pep
PDXXLPPGXPXTGPXPXXXRXIXWMGGLSSRACLCLVTGKTGSDNQELQSSARASGLRSQDGRAVTVMQCRELERGVKQRRLPVGCGS

SEQ ID NO: 190077 - protein, 117 aa, Triticum aestivum
  unsure (1)..(117): unsure at all Xaa locations
  Clone ID: PAT_TA_84495.pep
SRYXQRTYXSXKVTDIRKPVXNQGVASXXPKQFKYLKGFKGLHWXXPPWEPLLQRKGAKLAKEXRNRDLGSQTPXADSPSRRSVIPXGPGTVGTPVKKFTETTPVITEFMRCWYFSF

SEQ ID NO: 190078 - protein, 164 aa, Triticum aestivum
  unsure (1)..(164): unsure at all Xaa locations
  Clone ID: PAT_TA_84496.pep
MAIPNAFDSPLAARSAVGAALAAVIAVRAVRRRSLDASGGVAGFVVMAVHISCGYRYGALLLAFFFSSSKVTKIGEDHKRRIEENFKEGGQRNWXILANSTIATVLXVVIFALNDWEGKIKCMDSNGSKLITGIISGIIGTTLLQWNTCHLNRVLIMNNQGYNP

SEQ ID NO: 190079 - protein, 67 aa, Triticum aestivum
  Clone ID: PAT_TA_84497.pep
SMTDSEPDESRGKRDERETWAVGFQVCETNPRGKRDFTCHTNLLPQSYPRFRYTGFQASRPRYLLKL

SEQ ID NO: 190080 - protein, 123 aa, Triticum aestivum
  unsure (1)..(123): unsure at all Xaa locations
  Clone ID: PAT_TA_84498.pep
ALIAEVKKASPSRGVLRENFNPVEIAQAYEKNGAACLSILTDEKYFQGSFDNLEKVRSQGVKCPLLCKXLSLDKWQXYNARSKGADAILLIAAVLPNSLTXRISFXIXXRXXMTVLIEVHDER

SEQ ID NO: 190081 - protein, 165 aa, Triticum aestivum
  unsure (1)..(165): unsure at all Xaa locations
  Clone ID: PAT_TA_84499.pep
LSQSFEYNYGDFIPVLRPFLRGYLNRCHDLKTRRMKVFEDNFVQERKKVMAQXLGEIRCAMDXILEARRXXRRFNHDNVLYIVXNINVAAIXRRPVVHXKLGIAELXEQPGIHTVREXLAPCWGXGVPXTEPTSXLPYFXGIXXETSRLRMHPAXAPKMTQQRNP

SEQ ID NO: 190082 - protein, 110 aa, Triticum aestivum
  unsure (1)..(110): unsure at all Xaa locations
  Clone ID: PAT_TA_84500.pep
QFGLPLSSLISGSKIAQRTTEKRARRPQTCSNTWELGPASVRSCNLHVRNLLLLGAQHSGKVKPIRREPRKLCSSTLYRKPTPAPPRCGIVPLPLEHQXSHQPTEFFEPS

SEQ ID NO: 190083 - protein, 78 aa, Triticum aestivum
  unsure (1)..(78): unsure at all Xaa locations
  Clone ID: PAT_TA_84501.pep
KINSLXLWAGPACXXRXXRPSXXTLVXXHDLXGGIHFKXDLXSRGFXPTXXPTXGXPXICXRPFGPXTXPXLGWEEXX

SEQ ID NO: 190084 - protein, 129 aa, Triticum aestivum
  unsure (1)..(129): unsure at all Xaa locations
  Clone ID: PAT_TA_84502.pep
QDGQLSXRERVKPWQTGSNPLXSGQPTGLPPARPDRRRVRVCPPVDKMDGGDAKRSAGWIARRSGAGGVCGGWSEMTPTSEPAAAGARREGRRTYGARQGPVLVVFGSWELGEHGGMLKNGWGRLWPRQ

SEQ ID NO: 190085 - protein, 154 aa, Triticum aestivum
  unsure (1)..(154): unsure at all Xaa locations
  Clone ID: PAT_TA_84503.pep
TGDTVYAFGDGLSYTSFAHHLVSAPKQLALQLAEGHACLTEQCPSVEAEGAHCEXLAFDVHLRVADAGRXSGGHTVFLFSSPPGGCTTRPANTWLGFQKVSPGAPASGVVAFXVDVLQDSTSXDNLQEVASAANLTRTQPQSMPKGNVNFDVDV

SEQ ID NO: 190086 - protein, 126 aa, Triticum aestivum
  unsure (1)..(126): unsure at all Xaa locations
  Clone ID: PAT_TA_84504.pep
GRVPYEKSAFTDQQAEQRSWDINLGWFLEPVVRGDYPFSMRSLXARERLPFFTDKEQEKLSGSYDMLGLNYYTSRSLKTSDISXPNYSXIAPTLDDAYAXQETNGPDGTPLGPWDGNSWFNLXPEG

SEQ ID NO: 190087 - protein, 124 aa, Triticum aestivum
  unsure (1)..(124): unsure at all Xaa locations
  Clone ID: PAT_TA_84505.pep
EGGLDYLGNPSLVHAQSILAIWACQVVLMGAVEGYRVAGGPLGEXVDPLYPGGSSTPWGLARGPPRLRGVKVKEDXRTALAXLQXRFFXASIFNGKGPFXNSPKLXXPFXKXXWLXQNXFPXIL

SEQ ID NO: 190088 - protein, 89 aa, Triticum aestivum
  unsure (1)..(89): unsure at all Xaa locations
  Clone ID: PAT_TA_84506.pep
LGXGXXFKGKLXPKGRXPXLAPXKVGFPVVALFGKXXSSXNXLVYVCIHACRQADAETDVVVKRVALLEMNKTQHVASCNCRKHSYYCY

SEQ ID NO: 190089 - protein, 102 aa, Triticum aestivum
  Clone ID: PAT_TA_84507.pep
SKSSGSRRGAAGAPKGWQRQAPCDFSRPRPSLRPSASRWVGRASARRAPRPLFAVARLRLLTPPTGMPCSKPSRREQGLKDNSRPSKLLTRALLHPVFTTAD

SEQ ID NO: 190090 - protein, 60 aa, Triticum aestivum
  unsure (1)..(60): unsure at all Xaa locations
  Clone ID: PAT_TA_84508.pep
RESIACGAVLFADCHYLSSGSRFLKGIRPSICSGCPXPXQVLGNWIKKPELICLPLPKKK

SEQ ID NO: 190091 - protein, 75 aa, Triticum aestivum
  unsure (1)..(75): unsure at all Xaa locations
  Clone ID: PAT_TA_84509.pep
ITGMNVAVPCLILXGKKSTYXGNGMEHLKXVTRYGSVTSSYTYNYLVTNHYIKPVTAQGYKLRXQCXPQHEQSWQ

SEQ ID NO: 190092 - protein, 131 aa, Triticum aestivum
  unsure (1)..(131): unsure at all Xaa locations
  Clone ID: PAT_TA_84510.pep
SLHHYFKPLFGLREEILCLWMSXRVEDVXQLETDENEILTAPFMEKEVFEAIAQMKNNKAXPGPDGFPAEFYKKCWHFIKGDLMPIFHEFFDGQLHLFQLNFGTITLLPKKTEAIRIEQFRPICLLNVSFK

SEQ ID NO: 190093 - protein, 159 aa, Triticum aestivum
  unsure (1)..(159): unsure at all Xaa locations
  Clone ID: PAT_TA_84511.pep
GQHKAINDEGMPQHGRPFMKGRLFVEFNVVFPEPGALSPAQCRSLEKILPPKPGSQLSDMELDQCEETTLHDVNIEEEMRRRQQXKKQEAYDEDXEEDAQPRXVQCAQQLNPCSGLSPKSTDFLTLIPIFWQKYNLLKTTVSPQMFGKIKPRMVPGLQA

SEQ ID NO: 190094 - protein, 33 aa, Triticum aestivum
  Clone ID: PAT_TA_84512.pep
PQAAAHAIPAAKDKEKVDEDDLSRRLAELKARG

SEQ ID NO: 190095 - protein, 174 aa, Triticum aestivum
  unsure (1)..(174): unsure at all Xaa locations
  Clone ID: PAT_TA_84513.pep
AAPTFLANLQIAWKREKERSATEHGQEGVVHLLARAHQHPTRSGRPRRSGDEGHVRGGGWAFAADTAVLRHLMTTXLEDGVCAGLTVGVELHRASLARXFSLNQNXLIPXXXGFXXSFPTXGRXXNXXGCITXTIPPXXLHSXXYSPPKGIHXXLLLPXVLSFPVXPHXFWXQL

SEQ ID NO: 190096 - protein, 136 aa, Triticum aestivum
  unsure (1)..(136): unsure at all Xaa locations
  Clone ID: PAT_TA_84514.pep
MKAATGSSSVSRALALLLAACLLWKEAACFSASGLNKRSPPSNGGKXDLQXTMGXGFVGNGNLLLXRGNGTDTAAXNXXSXNDGPXXGNSNRISLRIXKRPPVLIRGSXXTITQQLCLPNKRCQXXXGXXNPXGKF

SEQ ID NO: 190097 - protein, 127 aa, Triticum aestivum
  Clone ID: PAT_TA_84515.pep
AFDERWMSELHGIDAAVLSAGHWFRIPSVYHRGGRVVGCHGCDDYAAEFNRTVAEEYQQFFSVFGTPVKTDAPRSPPRRILTNIWPRKKNPQLMAFNTSPFALKGTGTKGRPQERKPTRSFRIHPTG

SEQ ID NO: 190098 - protein, 119 aa, Triticum aestivum
  unsure (1)..(119): unsure at all Xaa locations
  Clone ID: PAT_TA_84516.pep
DFEWIANKGTQYGNNMEPNVLEIICHXVDVCFCXDTKHSGGIADPVLLIGDATPDVLAAGRRSPQQPEPPYSSTRPPEPSEIAPPLAAASSHTSAGKMQWAIGSGRRRARTAVAAELGE

SEQ ID NO: 190099 - protein, 78 aa, Triticum aestivum
  Clone ID: PAT_TA_84517.pep
ALTLRGSSQSQPVPALSPCLNPFSHLITCCLYSVCSSMWLIIIPRHVDSLRENRIIPNQQLSRSAEERRSQGRLAAVD

SEQ ID NO: 190100 - protein, 61 aa, Triticum aestivum
  unsure (1)..(61): unsure at all Xaa locations
  Clone ID: PAT_TA_84518.pep
VXXFDIPPLSKSSHIXLSQIKEGGRMXNDLXISKFVSXPVLTDTLNXSTXSKMFHINTRXP

SEQ ID NO: 190101 - protein, 94 aa, Triticum aestivum
  unsure (1)..(94): unsure at all Xaa locations
  Clone ID: PAT_TA_84519.pep
FFLKLIXQIIKYXSDXYRGFGNYILNLMQREIXNGGKRVTWGTWPTXLLLVXSXREAVNPXXPSIRLAGVEAKVTPXNQSSLRGTCHSLMESFF

SEQ ID NO: 190102 - protein, 65 aa, Triticum aestivum
  Clone ID: PAT_TA_84520.pep
QAPYLCSIVGTRVSRARRDSAGMARWRARRLLPLATFVTLGMILGSLLQLALLHPTRWYQLHADS

SEQ ID NO: 190103 - protein, 70 aa, Triticum aestivum
  unsure (1)..(70): unsure at all Xaa locations
  Clone ID: PAT_TA_84521.pep
IGRAIRHINDYAAMLLVDSRYAQTSSTKSFSCPADKLPQWDKSTTLLCSKXYGEIHSPLHQFLQQIKKNV

SEQ ID NO: 190104 - protein, 73 aa, Triticum aestivum
  Clone ID: PAT_TA_84522.pep
TPFSSLFALGAVMSFSTGLANISLKHNSVGFYQMAKIAVTPTIVVAEFILFKKKVSLRKGGPGYPIRPISDPY

SEQ ID NO: 190105 - protein, 96 aa, Triticum aestivum
  unsure (1)..(96): unsure at all Xaa locations
  Clone ID: PAT_TA_84523.pep
RQSLPPVKGGIPRCHGPKQMXTSQWDDYKGEHGRFGGQLFGCHNPNALDAYFXRVXNPKTAXWTTGSPKNVXRPWVCXXXRXXTXLKXXXSPELXG

SEQ ID NO: 190106 - protein, 81 aa, Triticum aestivum
  unsure (1)..(81): unsure at all Xaa locations
  Clone ID: PAT_TA_84524.pep
QIPPANPQFLRVRATMSGRGKGGKGLGKGGAKRHRKVLRDNIQGITKPAIPELAKXGXRXSASXGLIYEGDPLNSQGGGGA

SEQ ID NO: 190107 - protein, 183 aa, Triticum aestivum
  unsure (1)..(183): unsure at all Xaa locations
  Clone ID: PAT_TA_84525.pep
SLGSVSNGGRIRCMQVWPIEGIKKFETLSYLPPLSTEALLKQVDYLIRSKWVPCLEFSKVGFIFXREHKRIPLGLLTMAVSGTMXEAAYFXGATDATKGDXTRLEXVKKDYPDPYFGXIXXNTXAKCXXLTLXPFXXPGCKDSXKASTTGIKHCGFRSLVPNLLSCPKFFPSKFPKKSLKSGD

SEQ ID NO: 190108 - protein, 92 aa, Triticum aestivum
  Clone ID: PAT_TA_84526.pep
KVMVGQEINIYNTHTWECKTYHLQSKLSMPPTSGGLDLDVSGADLVSAKCFVLCAVATTSSVCLIFNIAIRYPANRSSSISHAHSLCWCMIA

SEQ ID NO: 190109 - protein, 51 aa, Triticum aestivum
  unsure (1)..(51): unsure at all Xaa locations
  Clone ID: PAT_TA_84527.pep
FFFFXLFGTLLXFFGKSFTSWXFKTPDPGFHLKMKRYSNSVGGPNKLSKIQ

SEQ ID NO: 190110 - protein, 153 aa, Triticum aestivum
  unsure (1)..(153): unsure at all Xaa locations
  Clone ID: PAT_TA_84528.pep
PWXSMIPFQVSXSFSXKGIFPHKLLSFXXTQGFXTVKXXSGXXSIGXXLGDXKQLPTQFVSXKTPQFXPREIFXEKCNXTQRDNPHXKKIGDGLVLLPKTHLELSPDSLXALSGRPAPLAPPPARCAXRPVSHGGLALKAAGVFXRRRRRAEP

SEQ ID NO: 190111 - protein, 119 aa, Triticum aestivum
  unsure (1)..(119): unsure at all Xaa locations
  Clone ID: PAT_TA_84529.pep
NCGFNWRXSCAFLRVVIIXQKPPIENPKNQPIYFXTFKGSDGMQSPTLKIIQTVSERDGRFSQPGSXXIPPDSPEEPTRGAPDLEPNRAESPGNRRPRRRGGGPAVGLGGGKRREGAEV

SEQ ID NO: 190112 - protein, 70 aa, Triticum aestivum
  unsure (1)..(70): unsure at all Xaa locations
  Clone ID: PAT_TA_84530.pep
VEPARHAAPAPLLVRRPRPSLAVARAVSPDAATGSSRSPASGGXMLVFVPPHPLIKHWVSVLRNEXTPCA

SEQ ID NO: 190113 - protein, 103 aa, Triticum aestivum
  unsure (1)..(103): unsure at all Xaa locations
  Clone ID: PAT_TA_84531.pep
AXSPXXXKIRARIGRIXLASXFNAXXPXKGGTRFXXFRXGFXXVXAXXSXDXXILKXMPLPKLMXXGXXPXETDQGFQFECECPLEINKCNWXSXIVLHLXAL

SEQ ID NO: 190114 - protein, 165 aa, Triticum aestivum
  unsure (1)..(165): unsure at all Xaa locations
  Clone ID: PAT_TA_84532.pep
SGGGGGPVIYSSPPPPAASGGGGGLGGGGFYYPPPTGGGGGSGGGASXQGGGVYPTAXPPPNPFLPYFPFYFYSPPPPLHSGARAVTAASLLPVLLLTSMLLLLCQDPRVQDFARASINQCLLHLHSCVPITRRDHSGINLVGGGFGTNGMCFLRHSRSSLLILN

SEQ ID NO: 190115 - protein, 160 aa, Triticum aestivum
  unsure (1)..(160): unsure at all Xaa locations
  Clone ID: PAT_TA_84533.pep
HGAHHDHDHDHDHHDEQKKHEQTFNEEAEKMIKSVKQALGNGEGCRVYGMLDVQRVAXGNFHISVHGLNIFVAEKIFEGSNHVNSSCYPRLSFGPKYQESIXPLDETXKVLHDTSGTFKYYIKVFPTDYNIXKEXCQQSFSXHGYFSHXSNXQAWQRYSR

SEQ ID NO: 190116 - protein, 143 aa, Triticum aestivum
  unsure (1)..(143): unsure at all Xaa locations
  Clone ID: PAT_TA_84534.pep
KXYYPXNVPLRYDDANLLLXNSIIXXPGYXLQNLDSGGIKTPQHXRKFTXIENGQLNGXAGXLGLSRSVGRRRREXSLVTSASMGSSEERGEHGLKPRLLGLFALGKPPPPQASRNSDPSLPPPLRTIPFRSHSGVRRRKSTP

SEQ ID NO: 190117 - protein, 81 aa, Triticum aestivum
  unsure (1)..(81): unsure at all Xaa locations
  Clone ID: PAT_TA_84535.pep
SHLIREWMDVQIDEHWSSRFFSLQISLLLLLLLNDHAPCTRYHCCQVRYAFLQHSPASPFISVNKTKKYILQKKXKKPXGG

SEQ ID NO: 190118 - protein, 94 aa, Triticum aestivum
  unsure (1)..(94): unsure at all Xaa locations
  Clone ID: PAT_TA_84536.pep
PSIRRQGARSLASPGNXRTVPWTHVSGRRAEEALGRSQRSQRTARAGHAHRRPRPDPRCAFHWYRSRPTDSSCFPSPIRVSRGLLLVSRFERHE

SEQ ID NO: 190119 - protein, 55 aa, Triticum aestivum
  Clone ID: PAT_TA_84537.pep
SLREKLLVPESSSALGVGGRLIDALMLQLGLDSPLLQLPRCSSDSEAYSSTVRFL

SEQ ID NO: 190120 - protein, 153 aa, Triticum aestivum
  unsure (1)..(153): unsure at all Xaa locations
  Clone ID: PAT_TA_84538.pep
LLNCTGXMFPFEPFRXRQKFGNLLLKPLXKVCSGKRRETTSRIPPFDQAPSPQGKSQKLQRCPTVVCPEYVXIFSKSQGILYLGMPPKFPLTSTXRLRRTXATDRNSGTHARQAAVTPSPSPSLILVGARRRRDAQRSLAAAAPVVVAKGEER

SEQ ID NO: 190121 - protein, 46 aa, Triticum aestivum
  unsure (1)..(46): unsure at all Xaa locations
  Clone ID: PAT_TA_84539.pep
HTXNTLKLLGPGPRSLIVISYLSLCEINLNPHTHICSKIVANEEKP

SEQ ID NO: 190122 - protein, 141 aa, Triticum aestivum
  unsure (1)..(141): unsure at all Xaa locations
  Clone ID: PAT_TA_84540.pep
GARRPAALLRAPWPSLRHWRRSSHLLEPSEPIPLGGCGPMHPGRFRGVLLAPSRRRGDAPSRERTPGHLRRWEKHNVHPXGLLLINIXKALIQIAFKXPTYDKFDWVIVTPLRTDXLQGWKXWIXXGILXLXRXRFSRXAQ

SEQ ID NO: 190123 - protein, 109 aa, Triticum aestivum
  unsure (1)..(109): unsure at all Xaa locations
  Clone ID: PAT_TA_84541.pep
MAPKAEKKPAAKKPAEEEPAAEKTTAGKKPKAEKRVPAGKSAGKGGRRRASXGKKKGKKSVGDVQDLHLSRLLKQXHPGHSDLPXKACPXMNPFIRHPSQKLARRRPPF

SEQ ID NO: 190124 - protein, 108 aa, Triticum aestivum
  unsure (1)..(108): unsure at all Xaa locations
  Clone ID: PAT_TA_84542.pep
DATAPVAGAXAVVAGAGXQAGISAXIPXWFSEISPMLPXXAHSLKVXNVLFXGKSXDYQNVMVFNPSTYXKVXSSHXLFQVXXKDXFAVTKEMIXHLPLLLPLKTPRW

SEQ ID NO: 190125 - protein, 72 aa, Triticum aestivum
  unsure (1)..(72): unsure at all Xaa locations
  Clone ID: PAT_TA_84543.pep
RCEXXGGRSVRGEGXXGXLGGCGGXHERGGHXGXGDELHPEAGHLRVCSAASESGFYWAAGISLREYEAVEV

SEQ ID NO: 190126 - protein, 153 aa, Triticum aestivum
  unsure (1)..(153): unsure at all Xaa locations
  Clone ID: PAT_TA_84544.pep
GLFGGSSKQSGHAVSFLLGAALPTALLFFLASDRLGEGLSTISSSWRGNGSISTAQQPAAAKPATTDAHALRFRGLAELLAXVATEDKTLLISSXNEYGRGQFACPLPSAAFRAAKDTGLRSHFSHVAVLRCKPPCTGPVHISILLLNSETGT

SEQ ID NO: 190127 - protein, 173 aa, Triticum aestivum
  unsure (1)..(173): unsure at all Xaa locations
  Clone ID: PAT_TA_84545.pep
QQGCRLFPGGRTWPLRPAHLLGRRQPWCLPGNCPFLSMVPKLCSTPLPARVLAPFVAAPHRAECPAPSAESLNASSMGSQRPFSLQAPPHGFPHFVTSAAPWXRSQSQRDTPTPGNNGIPXLXSRGCSVXSTXPXXVPTQPRFLRVXAHQXEPVRHCDPKSXLLAGCNSCPVD

SEQ ID NO: 190128 - protein, 88 aa, Triticum aestivum
  unsure (1)..(88): unsure at all Xaa locations
  Clone ID: PAT_TA_84546.pep
TPQQPLPPPPPLPPMQQIHHAYXXYNPXXMXPLLPQXAMQYILNXQQQLPLVQQXQLQPSQTWQQQQQPGCLXXRRXRXRLGXXXPAL

SEQ ID NO: 190129 - protein, 164 aa, Triticum aestivum
  unsure (1)..(164): unsure at all Xaa locations
  Clone ID: PAT_TA_84547.pep
QIXIXLTSNGWXSLTHXLCPKGGGTHRRGRXRXGGXERXNGRRXEAXWSPACSIRDXGRSRDAAPPGGAAANVHKLLEAXTVRGRGGESXTGGSRRGVLQQLVADVDVGRVEVDRGAGRVPETAAAAPGTGTGLGEHIPEARVLDTAVAPAAAPARRPGRRQRR

SEQ ID NO: 190130 - protein, 45 aa, Triticum aestivum
  unsure (1)..(45): unsure at all Xaa locations
  Clone ID: PAT_TA_84548.pep
MRECISIHIGQAGIQVGNACWELYCLEHGXIQADGQMPGDKTLGK

SEQ ID NO: 190131 - protein, 155 aa, Triticum aestivum
  unsure (1)..(155): unsure at all Xaa locations
  Clone ID: PAT_TA_84549.pep
LTNKLARLSFRVPYMASAHKIVFVLLLLTASSSSMLQARTMAPSHDRQHAQTVHQAAXXGKGKXALPSPSSQATGPXIRRRSTTPPPAPPASNTESPSPSPRWGKAMAHPXPTVLPNPRIXITXATITAPTNCXXXFHILDQIKLDYFLIKXLRR

SEQ ID NO: 190132 - protein, 83 aa, Triticum aestivum
  unsure (1)..(83): unsure at all Xaa locations
  Clone ID: PAT_TA_84550.pep
SCCTARACSWARPLRQLGCAIDRSKYRTAVAKTPIRSSISXXAAKEAGRRPAQAQAXMAMGATFXRGPXTRXDFXCXCAPXAS

SEQ ID NO: 190133 - protein, 90 aa, Triticum aestivum
  unsure (1)..(90): unsure at all Xaa locations
  Clone ID: PAT_TA_84551.pep
XLLGQIKINIWNNQMCINXTQCXMSLXRWSWRRNRGWAVDGVVRYVXTLNSXXRLLLTGAGRGLLPXGREQEGFLPFYSCLTLFLHSLIT

SEQ ID NO: 190134 - protein, 74 aa, Triticum aestivum
  unsure (1)..(74): unsure at all Xaa locations
  Clone ID: PAT_TA_84552.pep
AXTRPVRDQHEYAVKCYNPVTSPSFQXRMFXXDXSCISYFSCISFRDPLNXKQLKDPRRELGISQFSYLXFINY

SEQ ID NO: 190135 - protein, 134 aa, Triticum aestivum
  unsure (1)..(134): unsure at all Xaa locations
  Clone ID: PAT_TA_84553.pep
EINGGFLAAGGPRQHRGGLGCGRCFQMRCRDARLCSAGGVRVVLTDFHRSNRTDFLLAGPAFAGLAKPGMAQQLNKRDXLSVEYKRIPCDYXXKTVHSGLEKSXDKDPGKLVXKLXLQRRGNRLLAVEVXPXGP

SEQ ID NO: 190136 - protein, 95 aa, Triticum aestivum
  unsure (1)..(95): unsure at all Xaa locations
  Clone ID: PAT_TA_84554.pep
DDESLTSCPAFGGVPNYMTPTMSASAKARARAHLQEQQKNKAAQEKPRFSFGLGQXSIGSWAKSPFWKAAVPXPSRVGTPAASMAGGRHRFDAVD

SEQ ID NO: 190137 - protein, 147 aa, Triticum aestivum
  unsure (1)..(147): unsure at all Xaa locations
  Clone ID: PAT_TA_84555.pep
MQIFVKTLTGKTITLEVESSDTIDNVKAKIQDKEGIPPDQQRLIFAGKQLEDGRTLADYNIQXKESTLHLVLRLRXGAKKRKKKTYTKPKKXKAQSTRSELSVLQFYKVDXATXKVTASXKDAQHXXRAGVFMANNXNAIRKFGSLN

SEQ ID NO: 190138 - protein, 63 aa, Triticum aestivum
  unsure (1)..(63): unsure at all Xaa locations
  Clone ID: PAT_TA_84556.pep
ENVHAETHTPHIRLPNTPLRSTMHTHHQVTTHDIHRPAIKPPLLSFAXHACPFWAXGXXLXXQ

SEQ ID NO: 190139 - protein, 113 aa, Triticum aestivum
  unsure (1)..(113): unsure at all Xaa locations
  Clone ID: PAT_TA_84557.pep
MAKSGGESTVEVPIPASASATRPKAKHRIEIEGYPVDGVSIGGQETCVIFPTLSLAFDIGRCPQRAVSQEFLFVSHGHLDHIGGLPMYVATRGLXKLRSPTSSSPRASGTGVF

SEQ ID NO: 190140 - protein, 147 aa, Triticum aestivum
  unsure (1)..(147): unsure at all Xaa locations
  Clone ID: PAT_TA_84558.pep
TAYMYDGTSDVMQAGGTVKAADAFDVGAGHVDPLRALDPGLVYDAGARDHVVFLCSLGYTEAAIRNMVLPQPALDTSCPRGGGGGGGPEADLNYPXIVLPDXWRTVTVKRXVTNFGPTGTRVRAAXCNPQXAPPQVLPWLLPGAQAL

SEQ ID NO: 190141 - protein, 135 aa, Triticum aestivum
  Clone ID: PAT_TA_84559.pep
LISSVEGLQLQSTPESFQINLLRLRAVQSQFQQVIVIATSMLVLRQVLMSENSRATPLELENAISELVKALADILHSSPDSGTEEIVQGDVNAQQLAQHRRKVKGKMQMRVFLELQTRYLSLKKDPFVQAFLGNN

SEQ ID NO: 190142 - protein, 179 aa, Triticum aestivum
  unsure (1)..(179): unsure at all Xaa locations
  Clone ID: PAT_TA_84560.pep
EDTTKRRASKSKSFKDAENFEVLVLEKSCGCKFKSLRILLIAIISATVLTLVTPTLYERQLQSASRYVDVGWMLGQSEFPIPRYASFCRCWVGRIXSKALGKXKEXGKPPXSSQXFGSLNFKNNXLXSLDQLLPNXESNXTPTXXVQXPXGXVTWKNPXPEWVTGGKNGXTPFPFRGQT

SEQ ID NO: 190143 - protein, 102 aa, Triticum aestivum
  Clone ID: PAT_TA_84561.pep
LPSRLVSCVTACSLSFSLRSSRYLCQRSPLPAGPPSFLSLSSRRPKPLRARACDDVVGGGGHLLPQGRRPRRPGAGGAGQGSGAARGALRHGAQRQVRAAAG

SEQ ID NO: 190144 - protein, 74 aa, Triticum aestivum
  unsure (1)..(74): unsure at all Xaa locations
  Clone ID: PAT_TA_84562.pep
SKREPNPKFPIPQRKEDSSASRLPAPNRSRRPDPRKQVVVLLHRPPAAMSFIFRQEEDPAELLRENKRMLDXPR

SEQ ID NO: 190145 - protein, 103 aa, Triticum aestivum
  unsure (1)..(103): unsure at all Xaa locations
  Clone ID: PAT_TA_84563.pep
THSKGAGNVCYFEWAATKFKPLGTTRLAQNIILGRQHSNGDHIANIATFAXQPERYLTSTIAVACTAIXQSTLGITPENWTFHVNFQWGXSCTIQRNXAXTIX

SEQ ID NO: 190146 - protein, 106 aa, Triticum aestivum
  Clone ID: PAT_TA_84564.pep
MMIDNKYGQFLRSFNLLVCLVFSVTQKWADQTAYSLGRPSVSLDDDDREERRKPFAGDSYPCPKKKRCHLESDVNSGWESNCKDVPLPHCNNYPIFEYPLLKYPPK

SEQ ID NO: 190147 - protein, 103 aa, Triticum aestivum
  unsure (1)..(103): unsure at all Xaa locations
  Clone ID: PAT_TA_84565.pep
CCLVWXMGLYGFLIGTTINLASKDRKRGWARRGRRSADASYSDEKVADLPXFSXHSWPCAAPSAHTMGMVVAGSSEQGRALTRQPCQWRWRGRAEAICRRRRH

SEQ ID NO: 190148 - protein, 146 aa, Triticum aestivum
  unsure (1)..(146): unsure at all Xaa locations
  Clone ID: PAT_TA_84566.pep
MSPPLEPHDYIGLSAVAAAAPPTPTPTSSSSSSSSPAPRLTLRLGLPGSESPDRDRDCCEXVAATLSLGPLPAAAAVSAKRAFPDXAQRPGASKLTTXATXSPAAPPAAKXQVVGWPPXRNYXKIPRRRNAQEQPAEEASDWPLLK

SEQ ID NO: 190149 - protein, 149 aa, Triticum aestivum
  unsure (1)..(149): unsure at all Xaa locations
  Clone ID: PAT_TA_84567.pep
PQQVPRRPEPEPSSPCNLISSPATHLRPPRHGIEEEGRAHRDGGCGGDAAGDDDDVVGRGRRLRGGPGGVLGAAGGAGDVPDVRAFPAPAWVDNNYFTRGQRPSPGGLVGAARCRLWCASXCVXXVWWGTFTLYWKRXITFNEKKCIVX

SEQ ID NO: 190150 - protein, 134 aa, Triticum aestivum
  unsure (1)..(134): unsure at all Xaa locations
  Clone ID: PAT_TA_84568.pep
GDWNGAGAHTNYSTESMRKEGGYEVIKAAIEKLKLRHREHIAAYGEGNERRLTGRHEXTADINTFSWGVANRGAXVRVGXETEQNGKGYFXDRRPASTWTLLVTPRSPRHIIWXPEPALLSPTQMVLPSAIWYN

SEQ ID NO: 190151 - protein, 74 aa, Triticum aestivum
  Clone ID: PAT_TA_84569.pep
HSAFVPCIPIPLEEMELRTYYIYSTLFCTHQFLLACDDQFYSHLDDLGTRMGRRFRGSKELDCQVLGRNGLREP

SEQ ID NO: 190152 - protein, 101 aa, Triticum aestivum
  unsure (1)..(101): unsure at all Xaa locations
  Clone ID: PAT_TA_84570.pep
GVSNFRHNGNSCFRTTEFNKNYGRCSPIPNILSANVVSDRQETIRHHINARRTPDRVQEKXCCLXREFLRXSRXNCPSSDLGPAYLDPAXXNTGNLXSHRP

SEQ ID NO: 190153 - protein, 139 aa, Triticum aestivum
  unsure (1)..(139): unsure at all Xaa locations
  Clone ID: PAT_TA_84571.pep
NKKRATLKRAGLCSALELALHVLRRLFLLCAAGMLKQTPRACCGAPGVGEYNFNLTSKCGXRGRYAXPGPSNHWELGRIHLTEAAXRHIAKGGLRPXRRPPSRRQSNFSSTSSKGRPPIKSSRSPSSAPYYRLHVLYKV

SEQ ID NO: 190154 - protein, 175 aa, Triticum aestivum
  unsure (1)..(175): unsure at all Xaa locations
  Clone ID: PAT_TA_84572.pep
PTYTNLNRLVSQVISSLTASLRFDGALNVDVNEFQTNLXVPYPRIHFMLSSYAPVISAXEKAYHEQSLSLEITNSXFRPSSMDGKCYPRHGXYMAGCSCTVGDVXVPKDVNAAVGTIKTXRTSILVDWXPTGSSXGINYQPPXSPKRDSPSPKGVCFQTTFALTNLSPSSHGLVG

SEQ ID NO: 190155 - protein, 54 aa, Triticum aestivum
  unsure (1)..(54): unsure at all Xaa locations
  Clone ID: PAT_TA_84573.pep
TNVRYPLRHGRRRQPRXXPRELGIAHLLMVALICFGGMRADLELLVTVPVKSPL

SEQ ID NO: 190156 - protein, 91 aa, Triticum aestivum
  unsure (1)..(91): unsure at all Xaa locations
  Clone ID: PAT_TA_84574.pep
TLSPRRRPCGLRCALTGCAFRRRSCGGQRPIRPWLPRYPXGRTTGELGVFSKAGQMLTVRVTIGGQETSTVPFKAELANAIPVGQNSIGWH

SEQ ID NO: 190157 - protein, 106 aa, Triticum aestivum
  unsure (1)..(106): unsure at all Xaa locations
  Clone ID: PAT_TA_84575.pep
LDRETQRSRGFGFVTFSTEDAMRSAIEGMNGKELDGRNITVNEAQSRGGRGXAAGGGYGGGRRXGGGTAVGGGGYGGGLEYGXAXGDTVXANRGGXYXNNDXNWRN

SEQ ID NO: 190158 - protein, 106 aa, Triticum aestivum
  unsure (1)..(106): unsure at all Xaa locations
  Clone ID: PAT_TA_84576.pep
XLGVYXPLKLMIVLXKXFKIPGXDMERLLCXGYWKXXNFGSXXGKISXVGSLKFWSRMVPLESDMSLXLTSIXKRTSLWKFAFRTSNLVQELLQRRRTIPFGSIPL

SEQ ID NO: 190159 - protein, 94 aa, Triticum aestivum
  Clone ID: PAT_TA_84577.pep
FTGAPGKYVELKEGVQSFQGVLDGKYDDLSEQAFYMVGGIEEVIAKAEKIAKENAWIRNSSLQATCNLTFSVVNLLCFYCLLTKILFKNKSPAC

SEQ ID NO: 190160 - protein, 80 aa, Triticum aestivum
  unsure (1)..(80): unsure at all Xaa locations
  Clone ID: PAT_TA_84578.pep
PPGGPSDVAKXCREPGRSXGHARCARRAQGSPVRRXQDSXRGEXWIXRRGDERRGDGAXKRRREGEXRXSGTRLEGGAVA

SEQ ID NO: 190161 - protein, 84 aa, Triticum aestivum
  unsure (1)..(84): unsure at all Xaa locations
  Clone ID: PAT_TA_84579.pep
AAIIVLLVFALIQILFPLGKLSQMIYGGLASLIFSGYIVYDTNNIIKRYTYDQYVWAAXSLYLDVINLFLSLDDPLQGQPTRLL

SEQ ID NO: 190162 - protein, 120 aa, Triticum aestivum
  unsure (1)..(120): unsure at all Xaa locations
  Clone ID: PAT_TA_84580.pep
GFGRPETKQVSPGDGEGXISDXIXRSLLLSAVPNPSLRKCYRWRPAARRXNRLXQQXSPLSQRWPXIXGTSRXPXXQQIIPXXPIXXIQKXGSXXCSWPXITRVTXNLWQVIKLVKLVFN

SEQ ID NO: 190163 - protein, 122 aa, Triticum aestivum
  unsure (1)..(122): unsure at all Xaa locations
  Clone ID: PAT_TA_84581.pep
LVPNRHELHGASIVATILRDSEMFNEWTLELKAMADRIINMRQQLFNALKSRGTPXXDXSHIIKQIGDVYFXTGLNSEQXAFMRXXYHIYMTSDGRIQHGGFSIKTVPHLADAIHAALLQLK

SEQ ID NO: 190164 - protein, 178 aa, Triticum aestivum
  unsure (1)..(178): unsure at all Xaa locations
  Clone ID: PAT_TA_84582.pep
GNLRSKQSQGSLVLLLKMQIFVKTLTGKTITLEVESSDTIDNVKAKIQDKEGIPPDQXQRLIFAGKQLEDGRTLADYNIQKESTLHLXVLKLRGGMQIFVKDPHWARPLPRXRSSDTXDNSRRKIXDKEGFPXDQQRLIFAGKQLXMAHLADYNIQKDXNLNXVLKLLXECNFIIPET

SEQ ID NO: 190165 - protein, 107 aa, Triticum aestivum
  unsure (1)..(107): unsure at all Xaa locations
  Clone ID: PAT_TA_84583.pep
PPQRWKAAVMQHMLXAANRYGVDRLRLLCERKLSDAIDVETVSTTXALAEQHHCSQLRGACIRFMASPDMLGPVMLTDGFKHLVASCPLILKEVLDEVSRIWRDKSS

SEQ ID NO: 190166 - protein, 112 aa, Triticum aestivum
  unsure (1)..(112): unsure at all Xaa locations
  Clone ID: PAT_TA_84584.pep
MPKIVPTDAQVFAFGGTSCFPSPVVKGAPEEGVSSCLAGRLLXGXVLLWFLACVXXCLGLLVQSVFLLRLARPSXTQRIDRIALYEHLGGYLGEYVPLQEQYPRWRTFEIGA

SEQ ID NO: 190167 - protein, 47 aa, Triticum aestivum
  Clone ID: PAT_TA_84585.pep
DVTQFGYFKVLGKGMLPSRPIVVKAKLISKVAEKKIKAAGGAVLLTA

SEQ ID NO: 190168 - protein, 154 aa, Triticum aestivum
  unsure (1)..(154): unsure at all Xaa locations
  Clone ID: PAT_TA_84586.pep
ERGELARRLGDEARAWFLAFVERFLDADVAAAAPWDRDRAARMLPQLKRVNDWAERDSGSXAEMAPASRHRKRXAKXGGTNCQTAAPPAAFPXGDIERSRRRXYDTPHNVDPAPPFFRGSKLARPDXXKKGXHNXPQGKAIWXLLXXPKIAAXI

SEQ ID NO: 190169 - protein, 102 aa, Triticum aestivum
  Clone ID: PAT_TA_84587.pep
ILADHFGLEWAGYEGEENRFKLEEAMAGKEAVWAEIVRENDLIATELDEITNWWFVDAMFAVETQLLDSMNKSKEHGFLGFRNTVSSFNTWIEKLKVFKIVP

SEQ ID NO: 190170 - protein, 108 aa, Triticum aestivum
  unsure (1)..(108): unsure at all Xaa locations
  Clone ID: PAT_TA_84588.pep
MADAEDIQPLVCDNGTGMVKAGFAGDDAPRAVFPSIVGRPRHTGVMVGIGARKDAYVGDEAQSKRGILTLKYPSSTESSSNWDDMEKXWXHHTFYNEXRXAPEEXPSS

SEQ ID NO: 190171 - protein, 111 aa, Triticum aestivum
  unsure (1)..(111): unsure at all Xaa locations
  Clone ID: PAT_TA_84589.pep
VYNPFFKKYDCFSFWELRCNRISIPKTEDQDHGSRCTRLSAVQARSLWWTLSWGYGFTPYSXXQYNWVSVXSGLGXPVXKRXXWSXRHLNLTXFXXLQRNAXRASRGPYIP

SEQ ID NO: 190172 - protein, 128 aa, Triticum aestivum
  unsure (1)..(128): unsure at all Xaa locations
  Clone ID: PAT_TA_84590.pep
MGSMTWLAAVLAALVVAASSSVASHASPPGKLEVGFYEHSCPQAEDIVRNAVRRGIAREPGVGAGLIRMHFHDCFVRGCDGSILINSTPGQQXRERLRWQQPNMRASRRTPRRLQHCRARSCKRVRPL

SEQ ID NO: 190173 - protein, 105 aa, Triticum aestivum
  unsure (1)..(105): unsure at all Xaa locations
  Clone ID: PAT_TA_84591.pep
VFVSFWNTKXQTFFQAXWKHILAFCAIVLGGRGCKXAERIIGPTKPWFLTXAPIRGEFXLDIGRECHFIGSDSIGGVNXKGVAXWFXGGXXLDWQSSQHPWIYGE

SEQ ID NO: 190174 - protein, 113 aa, Triticum aestivum
  unsure (1)..(113): unsure at all Xaa locations
  Clone ID: PAT_TA_84592.pep
DCAPPRMGVWDSTTTCRGGTRPTPPCPASRHPGAASFTKVRCRWLVXWQLEHNVRVRQVNXPAAVNDPEXFCTAVYXIRPRXXRXCRXIWWQXPRXXXTFLXPKXGRGYLANG

SEQ ID NO: 190175 - protein, 110 aa, Triticum aestivum
  unsure (1)..(110): unsure at all Xaa locations
  Clone ID: PAT_TA_84593.pep
WIQLPATGLYQTQGXVTISRGIISKVVTLSPXFNLEVFKISLLLKXFFNLGNFTSSLGHXXIHGDRFPSLXAGGLXPGXLXSISKHXVXXNGGLXPGGFGAXTGKPRGAS

SEQ ID NO: 190176 - protein, 51 aa, Triticum aestivum
  Clone ID: PAT_TA_84594.pep
FCVSHRQIMDRTFMLRFIELLKLMMYSHFCIELCSFGCLVDLIFCFLLALT

SEQ ID NO: 190177 - protein, 143 aa, Triticum aestivum
  unsure (1)..(143): unsure at all Xaa locations
  Clone ID: PAT_TA_84595.pep
MSGSGSGSGVWVFKNGVMQLQPEQPAAGRKALLYVPTGERMTTLELLERRLXGAHGWERYYEKRTSSXPTAANXGIXLXFLPQRXLTXFRSNXNLQXSPSKNLXXFKAFNKFNPIHKSFYFPIDCFAKNPNSFSFLKGSRGER

SEQ ID NO: 190178 - protein, 185 aa, Triticum aestivum
  unsure (1)..(185): unsure at all Xaa locations
  Clone ID: PAT_TA_84596.pep
HSCPAPPTPTLPTELERTHTRTSRSSCPARSQTVSCPRAFGVARRNHRMAMFARPLLATLLLLPAFLLSAASAADSKSNPADELVALXNSNRTAGKASSVSDXQGLGCIALQYIKSIRRXCDKWDDKKPMDQAXRHFAXTVGSKXNLSXLRKXWLQSNTXSTKAWVCCERXKAQIXATRQTSRAX

SEQ ID NO: 190179 - protein, 115 aa, Triticum aestivum
  unsure (1)..(115): unsure at all Xaa locations
  Clone ID: PAT_TA_84597.pep
PNRKQKTLNPPHHTISSHGQHLRKDRARGFFATWQSLGFRSRSSRGHSACSKKGGGRQGLGKLARLWKLQGDTDDPGRKPRNCRRRAXXHPXSKXKFADTTSTXXEXHXQNPPXR

SEQ ID NO: 190180 - protein, 69 aa, Triticum aestivum
  Clone ID: PAT_TA_84598.pep
KVEPPFAWRQSKNIDRRAIAISQPRTWLFIHLYIKYGPSSPGVYRYRIHMLKKKKKKKKKKNLVPIRHE

SEQ ID NO: 190181 - protein, 118 aa, Triticum aestivum
  unsure (1)..(118): unsure at all Xaa locations
  Clone ID: PAT_TA_84599.pep
CRRRRRQTPGAEAFASVFDGDEHVPAPSIMSERGRLAGRLIDNRSRGYHVVPLVEDPRGHPEVLVDGDRRGYSDIRGVQQRRGYPDTICLRNLRATWCSCGXHRGYPGXLGLXNARLS

SEQ ID NO: 190182 - protein, 77 aa, Triticum aestivum
  unsure (1)..(77): unsure at all Xaa locations
  Clone ID: PAT_TA_84600.pep
WXXFXKGXEXYFWAXKGIXQXLXLEILVSFKDVVAFSLRLLAVAIKXAFETLLFERDPQARTNSSSSRLASSSEGGV

SEQ ID NO: 190183 - protein, 195 aa, Triticum aestivum
  unsure (1)..(195): unsure at all Xaa locations
  Clone ID: PAT_TA_84601.pep
PCPSSSTHTQTRTELVDRIKAVMASTTTTMSSLAMALALLLLSGGIGGAARQLQESRSLTCRRLPKPEVPPKPDLPPLPKPKEQHVAQPXLPGATAAIPVPPXPLPIPXCRCTELSPSNGXXPSAXRCQSHCRHRTLPFNXPCRTDNXVHXPPNPIRPXTIQTXFVTNLRTESVXSLQPVRQDLQLLLQXXTGAA

SEQ ID NO: 190184 - protein, 113 aa, Triticum aestivum
  unsure (1)..(113): unsure at all Xaa locations
  Clone ID: PAT_TA_84602.pep
AVASMLHAPSLLAVQPFGGQRNAASANRSPRAAAFRVXAAKLPAGVQVPKAQPKLSEPSWGSPKTAEVXWNSQGLHDGLIXTSSLELIFNKGFFENIRFQXGKAXLCICLLLA

SEQ ID NO: 190185 - protein, 88 aa, Triticum aestivum
  unsure (1)..(88): unsure at all Xaa locations
  Clone ID: PAT_TA_84603.pep
MDSFSSSPSSSGPGANPDVVMEQIKTQLAQAYAQEFLRDRREQXCLEKCVTKPGSSLXGSESSCIXTCVDRYIEALGIVSRALFTSQR

SEQ ID NO: 190186 - protein, 175 aa, Triticum aestivum
  unsure (1)..(175): unsure at all Xaa locations
  Clone ID: PAT_TA_84604.pep
WNIHPVYCSNVVIRNVTILAPHDSPNTDGIDPDSSSNICIEDCYISTGDDSIAIKSGWXDEYGXAYGRAXLGITVRRFTGPXPVCWFPAGSETSXGVGNSLXRHFNSSTQGFGFNVQDQHKQGRXIKXSLSPDLPGNSRYGCGLRCPNHPTTHRIPFPLKVPKKLKEVAKQAPSV

SEQ ID NO: 190187 - protein, 85 aa, Triticum aestivum
  Clone ID: PAT_TA_84605.pep
AIHGTSRQGKVVRSRSCWACSEAGMIDSEDGIPIICRRIARAADRAGRWVAVSHHTEGAAIGSLHFDKACPSRVMLLVDAYEAIV

SEQ ID NO: 190188 - protein, 47 aa, Triticum aestivum
  Clone ID: PAT_TA_84606.pep
SYLIPLSFLLLKSPKTMLGLRAAHVSKQIRFVSLKTITDSISSKSTN

SEQ ID NO: 190189 - protein, 111 aa, Triticum aestivum
  unsure (1)..(111): unsure at all Xaa locations
  Clone ID: PAT_TA_84607.pep
MVAFRFHQYQVVGRALPTPGDEHPKIYRMKLWATNEVRAKSXFWVLLRIEEVKKXNGNPGINEFFEPNPTTIKNYGSGSLPKQNRYHTFXKXYRHTTLECAFKFQRALPTP

SEQ ID NO: 190190 - protein, 188 aa, Triticum aestivum
  unsure (1)..(188): unsure at all Xaa locations
  Clone ID: PAT_TA_84608.pep
VLDSITTHLGIGSYAEWSEEKRQDWLLSELRGKRPLFXQDLPQTEETADVLGTFHVLAELPADCFXXYIISMATAPSXDVLXVXLLQALSAMXKHPLESVPLFXKLADLLSNSNNCXTXFSIXXXMDXINGNRRHDWYSNPXKNPXXLCMMFKHKPPKWQTYFTSSGVDNCKVATTGKYAQHIMVIRN

SEQ ID NO: 190191 - protein, 79 aa, Triticum aestivum
  unsure (1)..(79): unsure at all Xaa locations
  Clone ID: PAT_TA_84609.pep
NXSSISQGKKVMSESQVSVVRXXPCKIGLNXXXDRXQCSWQWHXIMYNXALFXIKKRRXPSXMPEWYYKYXIHRRYITA

SEQ ID NO: 190192 - protein, 79 aa, Triticum aestivum
  unsure (1)..(79): unsure at all Xaa locations
  Clone ID: PAT_TA_84610.pep
KNSVGEVLDERERLFVFIISLLFYFFPALPRSVXLPYMXSAPFFSLLSFNRRVLDLPNTMSKCKHLRPFRLLRKGXWIK

SEQ ID NO: 190193 - protein, 98 aa, Triticum aestivum
  unsure (1)..(98): unsure at all Xaa locations
  Clone ID: PAT_TA_84611.pep
VYXXXPYXXXHKFVWMYCPKGXLLVGXLLWISCSSHVXXSLVXWGFGFCSFREMCIGVRXGITCLPIRWLPKRMFIFLFGRVRTLTMLGVCAVKWSPS

SEQ ID NO: 190194 - protein, 101 aa, Triticum aestivum
  unsure (1)..(101): unsure at all Xaa locations
  Clone ID: PAT_TA_84612.pep
IVXDEVPYSVCPVRIHCVQCSPNHTQRGGDISWTQMMVXVYSTXSLICTVICILGVDVPSACACSTASCIAQRQLERSVQPCLRIFSWELKPFAVYKSLAC

SEQ ID NO: 190195 - protein, 113 aa, Triticum aestivum
  unsure (1)..(113): unsure at all Xaa locations
  Clone ID: PAT_TA_84613.pep
SISSSALRVYGGRRQQYYGAPSQPQVAAAAAGGQVAAAAPWGPGSADPAPMLGVTVLLSTFSXSXVQAFQRHAAVAPQXVFQRSRXPLXYPTFXHEESXXSFQLNFXHXGAHI

SEQ ID NO: 190196 - protein, 105 aa, Triticum aestivum
  unsure (1)..(105): unsure at all Xaa locations
  Clone ID: PAT_TA_84614.pep
APGVRRGALPWHALFGLFVYVLALATAELGFLEKLTFLESGGLDKYGAEAFLXNFTALVVRAAPAPSSVRRRIIPAHARDAGGYPRIKGGKLGQSRRRQLFLFLN

SEQ ID NO: 190197 - protein, 121 aa, Triticum aestivum
  Clone ID: PAT_TA_84615.pep
TNKRRRVEKESQATPTGLDFISNLLDDMLTVIISLLSVKYGARTTGLFQWWRPLWILTPVDLLDAHGLCHSYCKSSDRSPRSSAVTMAQQEAYHGQHSNGKDRAKLTSGLIPRHNHSRQCQ

SEQ ID NO: 190198 - protein, 146 aa, Triticum aestivum
  unsure (1)..(146): unsure at all Xaa locations
  Clone ID: PAT_TA_84616.pep
ENEFYVKYLEPRHPGMEAYDVSYTTKVRDFRDLLAAARAARAKECRPVQNLLFSECRLAINDLPNDLYDVAWDVGPHPTGRPGWEPQLRPGRMPSIFNTAVLARSRRQPRAXGPTDFSCTLQFQGGQVLSRIPRRDASPEDPSGIF

SEQ ID NO: 190199 - protein, 75 aa, Triticum aestivum
  Clone ID: PAT_TA_84617.pep
KIPHLSFVFRGCLPARFFGSWLISFSASGLGTAEQEVPRWTLDGACLSTAVDSSRRPDARQPECRLEPAIRSLAE

SEQ ID NO: 190200 - protein, 106 aa, Triticum aestivum
  unsure (1)..(106): unsure at all Xaa locations
  Clone ID: PAT_TA_84618.pep
PXXHVEVNPKLLVESRSSCPARRRPGSGSGTARRRGALTEGSAARVDGDAAPPGRRAEEHEHQRDDGGDQQPQEVEPGLLLRLVAAAQLTHLPNPQAAGTWLLGCT

SEQ ID NO: 190201 - protein, 111 aa, Triticum aestivum
  unsure (1)..(111): unsure at all Xaa locations
  Clone ID: PAT_TA_84619.pep
RRRRRIRSIAWSRRRSRRTNIRGHIPASPCTFDAACNGGQRRRSRPRRXTQVIWPTNLXNFQFQLSLXIGTILXXRTYIQXLRFPLPIWIGLXLVXTXLKTTXNHERRXXY

SEQ ID NO: 190202 - protein, 71 aa, Triticum aestivum
  unsure (1)..(71): unsure at all Xaa locations
  Clone ID: PAT_TA_84620.pep
GEHPFSXKVTGHFAGVPFEHVLSDAPLVYSNCSPVSVWGTVSSPGGSPSQFEVFSWKFKPSLTMTTVATDY

SEQ ID NO: 190203 - protein, 183 aa, Triticum aestivum
  unsure (1)..(183): unsure at all Xaa locations
  Clone ID: PAT_TA_84621.pep
TGAGPLDNGGACGFKGTNQYPFSSMTSCGNEPIFKDGKGCGSCYQXIRCLKSNHPACSGVXKTVIITDMNYYPVAKXPLXTXSGTXSGPMANXGPERQLPXPGIIDIISXRXPSTSXGLDITFASTRSNPMYWPHPTKQDGTCQGDNIQWNHILGIWGPNAALGPIKQSELWKNIRNNKPQKL

SEQ ID NO: 190204 - protein, 151 aa, Triticum aestivum
  unsure (1)..(151): unsure at all Xaa locations
  Clone ID: PAT_TA_84622.pep
QQRVEEDGSFMNEIRFQFEVSRHKNLVQLLGCCLETDIPILVFEFVANGSLEDILHSAKKHVPSRCRSGWDIRHWVRGSIAYMHPLDNQKRVHGDISXQNLLDDDSIQXPDFGSSXSWDPYYTLGCKYRYMANYYETFTLGSFRDSKRQLV

SEQ ID NO: 190205 - protein, 100 aa, Triticum aestivum
  unsure (1)..(100): unsure at all Xaa locations
  Clone ID: PAT_TA_84623.pep
SEALKRMHMLACDPGVIAIMKKHKWRVGIMTEMAPVGYVGISPKCILGFNKNMGEEISLPPANWMILKGSRKYESIKKILLNDLHIWXTPEHGCNFFALK

SEQ ID NO: 190206 - protein, 79 aa, Triticum aestivum
  unsure (1)..(79): unsure at all Xaa locations
  Clone ID: PAT_TA_84624.pep
KRSGTWKRLVLHCISSRLEGIKAKKYGPKLTMLANLFYACRTRKRTNLTQVGRPFIIRAXLTGGAYCLCNASNIPRGGG

SEQ ID NO: 190207 - protein, 72 aa, Triticum aestivum
  Clone ID: PAT_TA_84625.pep
LCSLLSYTYLSMRKKTRNDRGPKTEHFHTWLLSIAVLKMVMLDHRSLARLLGQAQIRVGDLRSQPKPWLTIR

SEQ ID NO: 190208 - protein, 156 aa, Triticum aestivum
  unsure (1)..(156): unsure at all Xaa locations
  Clone ID: PAT_TA_84626.pep
LACAPSPVCPSLSLSWRRLGRRRCCPTRLHPRLLRALSRDERHQGVEEVNLLGWETMYFRRLWLPWEVLPSKTYPLLSCVFQSDKHNXEAGGQNYNATIXPWIXWHLLHMNTYAIXXQXGXXKTXSIVXSXIHCXRXMIYMPYWMMQLLLQEEMGQ

SEQ ID NO: 190209 - protein, 136 aa, Triticum aestivum
  unsure (1)..(136): unsure at all Xaa locations
  Clone ID: PAT_TA_84627.pep
AKMKSVVVASSDPRPPRRRPRPTGPSSTYECILCACCSTSCPSYWVEPGGVPRPGRAAPRQQVNRASAGTLVSNGRRXIPYLLQNQLSNGDFNQSFNDSTKKGKIRXQGNLKVIXLHGNPRHLIHKNXTPPXLRXX

SEQ ID NO: 190210 - protein, 76 aa, Triticum aestivum
  Clone ID: PAT_TA_84628.pep
EVVAFCRGRLPRYMAPRTVVVVEELPKTATGKVQKFALRDKAKAMGNLSTKQALNLLSPDLFYGDCNHVWVGNNGS

SEQ ID NO: 190211 - protein, 132 aa, Triticum aestivum
  unsure (1)..(132): unsure at all Xaa locations
  Clone ID: PAT_TA_84629.pep
QVEASRTVSPSSSEKQQLFPFPLRAAPDGRDQALLRQEPEPQPTSLGHPIKQHPLAQPRRRQAPCTAPVPAPRXRPSPYNASTXQSXAHSLPPALLQGPTSPAKPLATVGTCPQCMIKKRNINVNIEGLVLK

SEQ ID NO: 190212 - protein, 110 aa, Triticum aestivum
  Clone ID: PAT_TA_84630.pep
KLLDPSLTPMEQLDYKFHEKYTALKKRKLLDEGLERKREAELNELYDAMKDWVSELRKDNAELNEKLVEKQDELEKARQEFLEDIRTRDAEILKLKQLLEEKNSATGFPA

SEQ ID NO: 190213 - protein, 163 aa, Triticum aestivum
  unsure (1)..(163): unsure at all Xaa locations
  Clone ID: PAT_TA_84631.pep
MESSPLLQLPAARVEALSLSGLSAIPPEYVRPADERAGLGDAFDLARTHANDHTAPRIPVVDISPFLDSSSQQQQRDECVEAVRAAAADWGVMHIAGHGIPAELMDRLRAARTAFFASRQDKEXYANDPPPAAARLRKRLPTLRQSGYSPLVNPTPKNLGWYP

SEQ ID NO: 190214 - protein, 131 aa, Triticum aestivum
  unsure (1)..(131): unsure at all Xaa locations
  Clone ID: PAT_TA_84632.pep
RVLFFPSWPVVPLLRSHQCLLLPSVWVLMSSRTTPSTLPTPNTRPASKLLGLSRTVFLLLVVSTLLPLLILQLSWLAHAVMDAATLLLLTQVCSNYLXDEXLRTLSIQAYGIRXCLKXTQMYXXVWWXGGL

SEQ ID NO: 190215 - protein, 91 aa, Triticum aestivum
  Clone ID: PAT_TA_84633.pep
MAAAAPTRAEVLSLFRSLLRTAKQFSDYNIREYTRRRAADAFRENSALSDAPSAAALFAVGKQQLEVAKRQAVIYSIYAPKGKSVMELKVQ

SEQ ID NO: 190216 - protein, 73 aa, Triticum aestivum
  Clone ID: PAT_TA_84634.pep
QQVRTCQTYTDKEGLRQQQMMGAARRHHNHYIVPYAGNKRMQAFSVTQADADFDPTPRPFSSARTLEWSTGFG

SEQ ID NO: 190217 - protein, 99 aa, Triticum aestivum
  unsure (1)..(99): unsure at all Xaa locations
  Clone ID: PAT_TA_84635.pep
LISRLXRFHXQXWAAXAXRGAMDAAXAAAXDPCWKTGTRLAWATAXXAFAGYRCRLRAVSLPLSLSLACGPAEGCAGRQASRCSTPCYRQLLWSLAWFS

SEQ ID NO: 190218 - protein, 140 aa, Triticum aestivum
  unsure (1)..(140): unsure at all Xaa locations
  Clone ID: PAT_TA_84636.pep
MASGGAAISAGPTPPSATASSVEWHQRPPNPKNPVVFFDVTIGSIAAGRIKMELFADIAPKTAENFRQFCTGEHRKNALPQGYKGCQFHRVIKDFMIQXGDFLKNDGTGMHIIYGXKFDDENXXTKHTGLDALNGNMGLI

SEQ ID NO: 190219 - protein, 183 aa, Triticum aestivum
  unsure (1)..(183): unsure at all Xaa locations
  Clone ID: PAT_TA_84637.pep
RANEIPDEYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFVSHGNTARHAKEYGDLKLXQICGTIXTDEKRHETTYTRYXETLRDGPDYTXLAXADMMRKKXHAAIHT

SEQ ID NO: 190220 - protein, 92 aa, Triticum aestivum; identical to SEQ ID NO: 108506
  Clone ID: PAT_TA_84638.pep

SEQ ID NO: 190221 - protein, 101 aa, Triticum aestivum
  Clone ID: PAT_TA_84639.pep
TIILGMLVILVLQSKGQIPGDSPPDPSHFVRNGSSPGSNFTGKLDDNHTSAAASGALDQAETNHVASGCYRSSETPANITNNAISQSQPQWTSPSLWMTLQ

SEQ ID NO: 190222 - protein, 143 aa, Triticum aestivum
  Clone ID: PAT_TA_84640.pep
DFLCRLNDDRNVRALFERALSLLPPEESTEVWRRFAQFEQNYGDLSSMLKVEQRRKEALSRTSEDALSASENTLHDIVSRYSYMDLWPCSSKELDYLARQEWLAKNIVKKVEKPAMLNSGSMLDKVLDLVRVRYYTICQSCSS

SEQ ID NO: 190223 - protein, 79 aa, Triticum aestivum
  unsure (1)..(79): unsure at all Xaa locations
  Clone ID: PAT_TA_84641.pep
ADXPXLDXXFWXQTLXXPXACSXAMLXXFGLPLXPGPSPSRLXXDAVRVVAHARRRRPEAGLSSATVVWPLSYKLALPR

SEQ ID NO: 190224 - protein, 155 aa, Triticum aestivum
  unsure (1)..(155): unsure at all Xaa locations
  Clone ID: PAT_TA_84642.pep
MMSGSSPPPPSLPAGSGGFFRGYTKLCKGLAVILLIVHLVVQLFPSAVTYLALIPGRTIPFAWNLITAGYVEQTIPGMVVSIXGLLLFGKLLEPLWGSKELSKFIFIVNLSTSACVFKTAIVLYYITXQEIYLLYXFSGFXGXTXLLVGIKHFYR

SEQ ID NO: 190225 - protein, 147 aa, Triticum aestivum
  unsure (1)..(147): unsure at all Xaa locations
  Clone ID: PAT_TA_84643.pep
AVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAXADKNDKSVKDXXMLLFXTALLTPA

SEQ ID NO: 190226 - protein, 103 aa, Triticum aestivum
  unsure (1)..(103): unsure at all Xaa locations
  Clone ID: PAT_TA_84644.pep
EAXMCQAXGRDDVEGQXIXPPPFDQVPQSTXSVNPMPGGHLXSRQQRGGGARGANLARGGADWSRFATKAGRGLLSSGHGPRTVCATILSKKIKQRKVQKDDT

SEQ ID NO: 190227 - protein, 155 aa, Triticum aestivum
  unsure (1)..(155): unsure at all Xaa locations
  Clone ID: PAT_TA_84645.pep
VIFSIINVLSGLMLFTLLIGNIQVFLHAVLARKRKMQLRFRDMEWWMRRRQLPSRLRQRVRKYERERWAAVTGDEEMEMIKDLPEGLRRDIKRYLCLELVKQVPLFHGMDDLILDNICDRLRALVFSXGEKXIRXGDPXXRMXFILQGKLRSTNR

SEQ ID NO: 190228 - protein, 108 aa, Triticum aestivum
  Clone ID: PAT_TA_84646.pep
IELLRPEMLRLKAMEPVLLAGRSRFKDIDMRIRVRGGGKTSQIYAIRQAVAKGLVAYYQKYVDEAAKKEIKDIFMRYERTLLVADPRRCEPKKFGGRGARARFQKSYR

SEQ ID NO: 190229 - protein, 50 aa, Triticum aestivum
  unsure (1)..(50): unsure at all Xaa locations
  Clone ID: PAT_TA_84647.pep
EIRMTFLVHLYSNKTLNAARVHEHSDLAPHRLKRXXXLXLXAXNARVXXX

SEQ ID NO: 190230 - protein, 79 aa, Triticum aestivum
  unsure (1)..(79): unsure at all Xaa locations
  Clone ID: PAT_TA_84648.pep
REFNKILTLTIXVALFGGNVRGPLLVIFQNTFKYVSAHETITLDNASIILKKEDRDQIPCPLILFCXFASRFATXNLVK

SEQ ID NO: 190231 - protein, 172 aa, Triticum aestivum
  unsure (1)..(172): unsure at all Xaa locations
  Clone ID: PAT_TA_84649.pep
PSPTAQAREAGERERRGAKQWEGKEEDVRLGANKFSERQPIGTAAQGAADDKDYKEPPPAPLFEPGELKSWXSFYRAGIAEFVATFLFLYITILTVMGVSKSTSNAPPSGIQGIAWSXFGGMIFXALVYCTAGISGRNIXPTVTFRLFLXRTVLTKASSTXXQCLGAICXAG

SEQ ID NO: 190232 - protein, 88 aa, Triticum aestivum
  unsure (1)..(88): unsure at all Xaa locations
  Clone ID: PAT_TA_84650.pep
MARTSFKMEHDLEKRQSESARIRDKYPDRIPVIVEKAXKTDVPEIDKKXYLVPADLTVGXFVYVGEEENKLTQEKHFXFVKKLATNAL

SEQ ID NO: 190233 - protein, 142 aa, Triticum aestivum
  unsure (1)..(142): unsure at all Xaa locations
  Clone ID: PAT_TA_84651.pep
DIYNTWGPWACWLLWRSPRWCWSSPQPTPGTAAAPRSTAAAMPPALWVGXAPSKVGIRSPFNGILXRPAAHQERXAXXGDLNAVXVXRSXDGMARPIXHNLGAQLENGPFWDGKVSFQSTXTTATXLRKXPPWMTTQTNXTI

SEQ ID NO: 190234 - protein, 128 aa, Triticum aestivum
  unsure (1)..(128): unsure at all Xaa locations
  Clone ID: PAT_TA_84652.pep
EERRSLAVRTGELFLGLAALLLRGTGAERSGGAAVEEMEARDGVVWXEQRPQDVDAERRRRELTSPGFSFSAAGLLFPYHLGAAQCLMDRGYITETTPVNWVNQLGAIXCAVIPSGXTMQDALQVTKF

SEQ ID NO: 190235 - protein, 78 aa, Triticum aestivum
  Clone ID: PAT_TA_84653.pep
AASPPSPPSRQLHRRRTNFVAAAREMRVRPREPPRRRGDGVGERGGVLERRERRADTVARASARSGGEAIHAGVCARQ

SEQ ID NO: 190236 - protein, 60 aa, Triticum aestivum
  Clone ID: PAT_TA_84654.pep
WELSEVVGSQQLGSPFSRRYSCGEPSALDLPTSSSRIHYFMTPLNDMKVTPFPDPLHPVQ

SEQ ID NO: 190237 - protein, 132 aa, Triticum aestivum
  unsure (1)..(132): unsure at all Xaa locations
  Clone ID: PAT_TA_84655.pep
MASKAVLFLALNLLFFTVANACGSCPTPTPPVEPPPPPPATPPPSSSGKCPLNALKFGVCADVLGLVKGEVGKVPAEPCCTLIKGLADFEAAVCLCTAXGNVLGVVVDXPIKLNALVNYCGKCVPKGYCARK

SEQ ID NO: 190238 - protein, 179 aa, Triticum aestivum
  unsure (1)..(179): unsure at all Xaa locations
  Clone ID: PAT_TA_84656.pep
MTGPMEIPVIDLGGLNGGGEERSRTLAELHDACKDWGFFWVENHGVDAPLMDEVKRFVYGHYEEHLEXKFYASALAMDLXAATXSDTDXEASDXVDWESNYXIQXQPKDKXXHFQXLXRDTKNLDXYXRKMVSSRTSGQLITSNWAPGAKSRNFGRVWAQVAPSAPNCVAPETGDTVQT

SEQ ID NO: 190239 - protein, 120 aa, Triticum aestivum
  unsure (1)..(120): unsure at all Xaa locations
  Clone ID: PAT_TA_84657.pep
GFSLLLCVLYRPHHTRPHGKLFQFRVPLPLGRTVWVFGRRRRGGGASTLSSSVSVCSFILGFGFRFNLRASVVLSRLSRDSSIHEHGTCCVLFXCIKXKNTIRSXLFLXKKRGAGTXXPX

SEQ ID NO: 190240 - protein, 54 aa, Triticum aestivum
  Clone ID: PAT_TA_84658.pep
NPRKKGESTAVLPIIYDPKTFILLVTALLLDKIFKTSLSCCLQEGGKTIQIYKS

SEQ ID NO: 190241 - protein, 106 aa, Triticum aestivum
  unsure (1)..(106): unsure at all Xaa locations
  Clone ID: PAT_TA_84659.pep
VAGGGDDLAAAECQVATMTADCAVMTPAKRAAMRRFRRRYLLYTVCXXMYRXNGTVFPDCXANGSERXNFKNWGXSNRFPGGNNNNPAKAPPRLAGPKGQPDITHQ

SEQ ID NO: 190242 - protein, 140 aa, Triticum aestivum
  unsure (1)..(140): unsure at all Xaa locations
  Clone ID: PAT_TA_84660.pep
MNPFAKKPTPREVMRSSKRDLTNATRGIERDIASLQQEEKKLVAEIKRTAKTGNEAATKILARQLIRLRQQISNLQGSRAQXIRGIATHTQXAMHANTSXAXGLQSASKAMGAFXIKQMELPSKMKIMQRIPNQSAQWVQ

SEQ ID NO: 190243 - protein, 68 aa, Triticum aestivum
  Clone ID: PAT_TA_84661.pep
FFFLISSTAPKRDISLESFQFLPLLDSRQRHTRKWRSTLTLPKQQGTPQQSLTVHNNSNNRIQNFGME

SEQ ID NO: 190244 - protein, 172 aa, Triticum aestivum
  unsure (1)..(172): unsure at all Xaa locations
  Clone ID: PAT_TA_84662.pep
RHGDVLVLDGCAENMNDGKTYAYLSSVPRLFAAEPYDYVMKADDDTYLRVAALAGELRGKPRHDVYLGYGYAMGGQPMPFMHGMGYVVSWDXAAWVAGAREILERNDNLGXEGLKVRKWXNLAGKGQEPLQLKPRMYDSTGTWTTGRVAQLKTNGGRRVKYSHGILVQLTTA

SEQ ID NO: 190245 - protein, 163 aa, Triticum aestivum
  unsure (1)..(163): unsure at all Xaa locations
  Clone ID: PAT_TA_84663.pep
XVPQRATAHVVYVLVGAARRRSFIXSAXPGXERVQPXVEPRMRRVXDGLGAFPDFXXPLHSSXHPLAVAVAGARQRRRQERRHGGHQQREQHHRHGYGRAPLRRSRLPVFGDVAAAAAAALVVGRGPGVDFGLGHGLRRFRCGDSRLTGGRFGDQRIAGLAAR

SEQ ID NO: 190246 - protein, 69 aa, Triticum aestivum
  unsure (1)..(69): unsure at all Xaa locations
  Clone ID: PAT_TA_84664.pep
MYFVSEALAACDNHVDATMLCSDGLHFTPVGNKILFEEVVKTLETSIGFSQERLPSDLPLFHEXDPKDP

SEQ ID NO: 190247 - protein, 149 aa, Triticum aestivum
  unsure (1)..(149): unsure at all Xaa locations
  Clone ID: PAT_TA_84665.pep
MDPPNPNPNDAPSLPAESAARLAALSLCGTRDLPPDFHTAEILDDDEGYLTSASRGGSSTSADSTTNDKDGDDVSQPSPRSSGYAGERGSSLDDDXRPDPTRQDWARGKKHPTXTSSLRWRKXKKHFFILTIWQAIYPSMGMTQLPDFS

SEQ ID NO: 190248 - protein, 35 aa, Triticum aestivum
  Clone ID: PAT_TA_84666.pep
KIEPASLALIRNGFYYLYYVVSMNCNCSNANIVNK

SEQ ID NO: 190249 - protein, 164 aa, Triticum aestivum
  unsure (1)..(164): unsure at all Xaa locations
  Clone ID: PAT_TA_84667.pep
EKARKYAIIKELDEPVTLKDGTVVLQFEVRLQNGLECGGAYIKYIRPQDAGWDAKEFDNETPYTIMFGPDKCGSTNKVHFILKHKNPKTGKYVEHHLKFPPSVPYDKLSHVYTAILKPDNEVKILEXGKEKKKXNFLSADXFEPTLIPSKDNPXPDDKKPEDWE

SEQ ID NO: 190250 - protein, 92 aa, Triticum aestivum
  Clone ID: PAT_TA_84668.pep
MLGDLLSRILLLLFGYAMPAFECFKTVEARPNDARMLRFWCQYWIIVAMVIAVESVISWMPMYSEMKLAFFVYLWYPKTKGSDVVYDTFLRP

SEQ ID NO: 190251 - protein, 108 aa, Triticum aestivum
  unsure (1)..(108): unsure at all Xaa locations
  Clone ID: PAT_TA_84669.pep
EIKEKKSSGKKVTKGKGESAEAVLPSKDDLRKTITEILKKVDFNTATFSDILKKLDNHYKMDLTPKKEAIKVMIQDELTKLSEEVKKGXGDEDAGKKQQQPQAQEIEA

SEQ ID NO: 190252 - protein, 114 aa, Triticum aestivum
  unsure (1)..(114): unsure at all Xaa locations
  Clone ID: PAT_TA_84670.pep
MPPXKXQTXHXDXAHXIXMAYNXKRLXTASSDNTXXIIXVXXTSQQQLATLSXXQXXXWQISWAHPKYGSMLASCTXXGRVXIWXQKXGKPDEWTHAHTXTEXKXSVNPMLGCL

SEQ ID NO: 190253 - protein, 169 aa, Triticum aestivum
  unsure (1)..(169): unsure at all Xaa locations
  Clone ID: PAT_TA_84671.pep
SGDSKGTIIDSGTTLAYLPREVYRTLLAAVFDKYQDLPLHNYQDFVCFQFSGSIDDGFPVITFSFEGDLTLNVYPDDYXFPRTGMIYTVWDSWDGGVQTKDGKDMLLLRRPGSSQNKLSSLXTWEKELLGWTDYNCSXXSIKIEDDKTGSVYTVDAQNISAGWEIQWNS

SEQ ID NO: 190254 - protein, 157 aa, Triticum aestivum
  unsure (1)..(157): unsure at all Xaa locations
  Clone ID: PAT_TA_84672.pep
MQSRWGSVRQESAFTDRFKPRRGISSRVVYDNAFGDPVNVEKMSSEEGYKYYQHEAYSSFVQAVVGAVYTHSGQDAARDFVKAHVLARQVDVSTMFEFSLPTRELSMLCAREGFEAPIARLXSETXXHSRTPVFNVGIYSGSEKLGESGGLTWCKWK

SEQ ID NO: 190255 - protein, 130 aa, Triticum aestivum
  unsure (1)..(130): unsure at all Xaa locations
  Clone ID: PAT_TA_84673.pep
PPLLSRQRKHGHVGVCIVCPLLAKVGLRECPSAAPVPFRFRDASDPEAGIFALDQVCASLRKQIRKMEVSQHSKYFCEFCGXFAVKRKAVGIWGCKDCGKVKAGGAYTMNTASAVTVRSTIRRLREQTEA

SEQ ID NO: 190256 - protein, 88 aa, Triticum aestivum
  Clone ID: PAT_TA_84674.pep
YRASCITDQNIATVKKQFLSPQHGQQVICLNDEQYTPRTTTVSISSPAAPPALLAAAAAASIHRRLALQSLHHHRAVGALTAGPVPDA

SEQ ID NO: 190257 - protein, 57 aa, Triticum aestivum
  Clone ID: PAT_TA_84675.pep
KCSEESFAHQVKIRDPLKIGFPNLWALRLARQLLVWHPEDRLSVDEALNHPYFQEPM

SEQ ID NO: 190258 - protein, 111 aa, Triticum aestivum
  unsure (1)..(111): unsure at all Xaa locations
  Clone ID: PAT_TA_84676.pep
DPSIPAAFLSELKARCAPGDFNTRVPLDRGSQGTFDDSILRNIRAGLVPIASDAALEASNATGALVGAYLGAASSSFSQDFVAAMIKMGTIGAITGDAGEXKRXCSAFNTN

SEQ ID NO: 190259 - protein, 114 aa, Triticum aestivum
  unsure (1)..(114): unsure at all Xaa locations
  Clone ID: PAT_TA_84677.pep
ECLRVAMXXTXYQKAQRXYHSXRVHXXYFEEGGLVLRRVXSVEGTNKLSPKWEGPYHVLRVTRPGTVRLETGDGTXLQNSWNIEHLHKCYLLGARLLGQCPTTTLLYRSCLSCM

SEQ ID NO: 190260 - protein, 162 aa, Triticum aestivum
  unsure (1)..(162): unsure at all Xaa locations
  Clone ID: PAT_TA_84678.pep
SYIINYYKQLFDLRKESFVSLDESXFXDVSQLETDEYEILTAPFTKKEVFEAIAHMKNNKALGTDGFPAEFYKNCXHFIKGDLMPMLHEFFIGQLHFFKLNFGTITLLPKKTEAIHIEQFRPICLLTVSFKIFTKVGTNRLTQIAHSVVQPSQTTFMPDRNI

SEQ ID NO: 190261 - protein, 50 aa, Triticum aestivum
  Clone ID: PAT_TA_84679.pep
FTNYNRDFLISTSNIILPTLSISLQQHPLPPNPFVRLNSPSIHNKINSTS

SEQ ID NO: 190262 - protein, 58 aa, Triticum aestivum
  unsure (1)..(58): unsure at all Xaa locations
  Clone ID: PAT_TA_84680.pep
GLXRRRWXAAGRXRRGGXGEEGEHGEHGEVRSGHCXXLCAAVRQPVRQRESVWESRRR

SEQ ID NO: 190263 - protein, 81 aa, Triticum aestivum
  Clone ID: PAT_TA_84681.pep
GAYRSVLHRVAAGDQGRRLSVATFYNPGTDAVVAPAPRRDQDAGAAAYPGPYRFGDYLDYYQGTKFGDKDARFQAVKKLLG

SEQ ID NO: 190264 - protein, 130 aa, Triticum aestivum
  unsure (1)..(130): unsure at all Xaa locations
  Clone ID: PAT_TA_84682.pep
MSSSRRSSSPDSNDTTDERKRKRMLSNRESARRSRARKQQRLEELVAEVARLQAENAATQARTAALERELGKVDGDNAVLRAAKPTGRPPESLGXVSSAQMAGAAVXSGMATTTHRPGTVSPDPTGLKSS

SEQ ID NO: 190265 - protein, 115 aa, Triticum aestivum
  unsure (1)..(115): unsure at all Xaa locations
  Clone ID: PAT_TA_84683.pep
RDPEEAKEQEEEAAAAPEFAAVTDYQGADQWGGDQWTSDVAAPPVAPTGADWGAAPAPVPTGDGWDQTVAPVPVDGTVPPVVAPTXGWESAAQPTAQGWEALRHHFETLVRDYSV

SEQ ID NO: 190266 - protein, 194 aa, Triticum aestivum
  unsure (1)..(194): unsure at all Xaa locations
  Clone ID: PAT_TA_84684.pep
GRQVISTARTCNVILIVLDAIKPITHKRLIEKELEGFGIRLNKTPPNLTFRRKDKGGINFTSTVTNTHLDLDTVKAICSEYRIHNADVSLRYDATADDLIDVIEGSRIYTPCVYVVNKIDQXITLXELEILDKLPHYCPVSAHPEWDPDGLLEKVWEYXDWVDIHKTKGLNQIMRFCYRSSRRNEDSRTTHGNN

SEQ ID NO: 190267 - protein, 72 aa, Triticum aestivum
  Clone ID: PAT_TA_84685.pep
GPLLRLRHHVIHCPVTRPQPTTPVSVISSCRAVPCLPYNRRTDSSYTHTHSYYIYIHSIMYTVRTSVPVPSP

SEQ ID NO: 190268 - protein, 103 aa, Triticum aestivum
  Clone ID: PAT_TA_84686.pep
LEELRPEGFLNETSCSIILRTALVASTVCIAFLLPFFGLVMALIGSLLSILVAVIMPALCFLKIAQNKATCPQVIASVGIVILGVVSAALGTYSSVKKIAENY

SEQ ID NO: 190269 - protein, 78 aa, Triticum aestivum
  Clone ID: PAT_TA_84687.pep
DAAVVSMNDDLAGEIPVAFIVRTEGSQVTEDEIKQFVAKEVVFYKKIHKVFFTESIPKNPSGKILRKDLRARLAAGVH

SEQ ID NO: 190270 - protein, 145 aa, Triticum aestivum
  unsure (1)..(145): unsure at all Xaa locations
  Clone ID: PAT_TA_84688.pep
MDRAQLLLVGLPALLFFSDLTHIFAPPPPHLRHPHHHPPHHHHPHPLHHPHSPHPHPHPPHHPHPHPPHHHQHPDPSTAIIXEPRVDEAGFXSTVELQFCASCSYKGTAVTMKRMLETHFLGIHVILHNYPPQFPKRVSTKLSNC

SEQ ID NO: 190271 - protein, 138 aa, Triticum aestivum
  unsure (1)..(138): unsure at all Xaa locations
  Clone ID: PAT_TA_84689.pep
MAAAARVFRGSLFLMSPAAGAKASAAKKAGAAAAAAAVAKKTEAATTKPRLPTGITKPMPVSDEFRKFAGGAPEVARSEAIKLIWAHIXGHGLQNQAKKTEIXCDATSKLFGGXDKVGCWRSQLLNAHFRRTTSILVQ

SEQ ID NO: 190272 - protein, 129 aa, Triticum aestivum
  unsure (1)..(129): unsure at all Xaa locations
  Clone ID: PAT_TA_84690.pep
HRPLTPMRRCRGVACVVIILSTAFLLVVYLAPITTFAVRLFSVHYSRKATPFYLECGLSLWPFLFEKINKTXVVFSGENVLPKHXYGXFANHKTEVTGDLWNLALKESNLXKTSQSLKQPYNXXILTWI

SEQ ID NO: 190273 - protein, 88 aa, Triticum aestivum
  Clone ID: PAT_TA_84691.pep
SFLSNVPIYFVFFLSSAKVFEVFPQLPNLLVPNLQTRCFLLLREGSIISVIVFKFSQGVFCNISKHQRISHNYPHRHIYSVHFLCATV

SEQ ID NO: 190274 - protein, 177 aa, Triticum aestivum
  unsure (1)..(177): unsure at all Xaa locations
  Clone ID: PAT_TA_84692.pep
GTEYISPQGTLNPYPAQQYLPIYGVSAAANTANQTFNQLNPYISGGGNGYMSVHSYNMPGNQYVQLTGSNFSSASPTAQPSCQDPFLSSXPVPAHPHLIIPAPQPSLTQASGSRPKEQAELCIPTLDLPIAARTKKRCLLYQFGLPSNRLNLYCEGTSHLRSVLWKYQADHIVEVTG

SEQ ID NO: 190275 - protein, 99 aa, Triticum aestivum
  unsure (1)..(99): unsure at all Xaa locations
  Clone ID: PAT_TA_84693.pep
LALRGTLLQKPTMKRDLQDDLRFLVWESLKGSVRFVGALAALQLAVEKFGSANVCVXGHPWGAGFALQICKELAKQGXLWMPPFHPPSVSLGMGVKEHE

SEQ ID NO: 190276 - protein, 189 aa, Triticum aestivum
  unsure (1)..(189): unsure at all Xaa locations
  Clone ID: PAT_TA_84694.pep
MSPVASKGVVMDGAVAVAAVAAAVLLCLHLPAVARGQLQVGFYNTSCPNAESLVRQAVASAFANDSGIAAGLIRLHFHDCFVRGCDAXVLLTSANNTAERDAPPNNPSLHGFXVIDAAKAXVEQSCPXTXSCADIXAFAXRETSTHGNCRTSASGPRTELPTGQNCGQNRPTGATPAKLPTMHPGKRGV

SEQ ID NO: 190277 - protein, 121 aa, Triticum aestivum
  unsure (1)..(121): unsure at all Xaa locations
  Clone ID: PAT_TA_84695.pep
RINTQQGVCVYASRTLLFLRDDGALKPLAIELSLPGDGAEVSSRVILPATPGTTDGHLWWLXKXHVSVNDSSYHQXQHWXFTHATVXPXIIATKRQIXPLTHXKIXGPQFKXXMHLKTGES

SEQ ID NO: 190278 - protein, 106 aa, Triticum aestivum
  unsure (1)..(106): unsure at all Xaa locations
  Clone ID: PAT_TA_84696.pep
IPSTRHSDPDSAGSSFSILLGNSPHLDGQYAVFGRVTKGDDTLTKLERLPTRREGIFVMPIERINILSTYYYDIDLESCEAEKSXLRRRLSESASEVSDGERKCFA

SEQ ID NO: 190279 - protein, 60 aa, Triticum aestivum
  unsure (1)..(60): unsure at all Xaa locations
  Clone ID: PAT_TA_84697.pep
LFYVASSCPVTRFFVCSPSACSLRLAAAAIRLRLRLXXYFXLYGLQLQXSKQLQXCRXVX

SEQ ID NO: 190280 - protein, 73 aa, Triticum aestivum
  Clone ID: PAT_TA_84698.pep
PWPRRRSPRDHPRCGRRGGPPSPAAAAAHQRTSSSSRRPWRLIVPRGGCGEARGVEVDSCVRLGFRSRGCVLA

SEQ ID NO: 190281 - protein, 78 aa, Triticum aestivum
  Clone ID: PAT_TA_84699.pep
EPEPKPKPMPKPKPKPCSKPKPEPMPKPEPKPEPKAKLEPKPKPPPKCKPPATHNWMGYLYMTLGWRRTRYGATLCYF

SEQ ID NO: 190282 - protein, 181 aa, Triticum aestivum
  unsure (1)..(181): unsure at all Xaa locations
  Clone ID: PAT_TA_84700.pep
GXSMVYTXWILVRSQFXMTFXFXRNRPXVXXRFYXCXXLXXQAAVSFSSGEXIGQFXGGPLKXTXFPXFAXKXKXLXXGXGGPEXALTNYXKDSXPGPSXXFNXXFSKLKGSAXETRQVGDHPRPELELQAKARSSRKQKRQRAQRPWQTERRNPGWGRTRKRGRGHAAVVIWKTYLSPSQ

SEQ ID NO: 190283 - protein, 178 aa, Triticum aestivum
  unsure (1)..(178): unsure at all Xaa locations
  Clone ID: PAT_TA_84701.pep
PLPASGGPEDRRLQVVGVSAAAGSGGDDYYLDVESGSAAVPLVQQQYVNGRLVRLRTFSVFEVSMMAAKIAYENAAYIENVVNNVWKFHFVGFYNCWEQFVGRXTTQAFVFTDKGRGXXXVVVXFPGHGAFKIXNGSTDVNRLGGHGPNGQIQXGFSKWPRRRRKGPTRSKGPPGNPA

SEQ ID NO: 190284 - protein, 141 aa, Triticum aestivum
  unsure (1)..(141): unsure at all Xaa locations
  Clone ID: PAT_TA_84702.pep
RHRNIVRLLGWAANGGTRLLFYSYLPNGSLSGLLHGGRAAKGSPADEWGARYEIALGVAHAVAYLHHDCVPAILHGDVKSMNVLLGASYEPYLADFGLARVLAAASSKLXTXRQPXIAGSYXYMXPEYASIIGARFTSRLI

SEQ ID NO: 190285 - protein, 101 aa, Triticum aestivum
  unsure (1)..(101): unsure at all Xaa locations
  Clone ID: PAT_TA_84703.pep
PKLTVDLSXSVGSGLCLVSSKFILVMDRSPGSGPISSDNRPIKIAFATAPVGSVPLTKPLPMSRRLILQQARGQRSLSPPTAWELSTVSRSISLPTGGSFH

SEQ ID NO: 190286 - protein, 60 aa, Triticum aestivum
  Clone ID: PAT_TA_84704.pep
SGSRFSIQNTSSRQENQLSKLRRYQQKLTGMQRIAKLVYSLAPACTSGASTEVSSIVLSA

SEQ ID NO: 190287 - protein, 106 aa, Triticum aestivum
  unsure (1)..(106): unsure at all Xaa locations
  Clone ID: PAT_TA_84705.pep
RXVGXEHLXDXANCPPVLGRKSGEETHPRRIAPQEIAGANTGTPATATAAGGSHGRQRLPDAVVARSLPHVRRLSSLCLQGGYSYYLQKQEKLSQLLLTPVTYCKL

SEQ ID NO: 190288 - protein, 160 aa, Triticum aestivum
  unsure (1)..(160): unsure at all Xaa locations
  Clone ID: PAT_TA_84706.pep
MAILSALATEVLIPVAAVIGIAFAVVQWVVVSRVKLSPAASGGSGGKAGYADSXEGXEGRGSNXHXNVVVKCAEIXNAISEXATSFLFTEYXYVGIFKAIFAVVIFLFXXSVEGFSTKXQACXYSKDKYASCAVXASLTMVLLLEHTLPGSLDMISMQNT

SEQ ID NO: 190289 - protein, 124 aa, Triticum aestivum
  unsure (1)..(124): unsure at all Xaa locations
  Clone ID: PAT_TA_84707.pep
GMGRVQRLQGHDAGLLRHGGPQVLPLPVPQHLPGGTPRPPVATTTTTSLLLELDAASQDTPGPSSYAIITSSACAFTHRSVPVHDELHNFVPCXYVRTLLLEIGRFIRLGTHYLYHNKTRVTLL

SEQ ID NO: 190290 - protein, 69 aa, Triticum aestivum
  Clone ID: PAT_TA_84708.pep
KFRITDLVVPVPAVSGLLFLLLTSTDQQTNNLICLYLSNVSFGCNARVLCLAHFVNNIFVQLDINKKKK

SEQ ID NO: 190291 - protein, 88 aa, Triticum aestivum
  Clone ID: PAT_TA_84709.pep
TSPAILTSMHRLRLFFLLLRFRTGMRSEFYLVAACCNTSLTIAPWHCSHPGLSNRKRRYLLGFPANEISNFFTIPISKPKCPIRLLYK

SEQ ID NO: 190292 - protein, 107 aa, Triticum aestivum
  unsure (1)..(107): unsure at all Xaa locations
  Clone ID: PAT_TA_84710.pep
KVSLLDXGXISVLFRLAFFSSQXIRNPLYSRSFFXIKPMQYVLQEHLSLSYMIRALKRIHNYAQAARTTARLGRSSGFRRDRHRQEEEEDTARQLADGGCSAHCSTS

SEQ ID NO: 190293 - protein, 57 aa, Triticum aestivum
  unsure (1)..(57): unsure at all Xaa locations
  Clone ID: PAT_TA_84711.pep
QXRRTIWXQRGRRXRXRWGQXAPXRXAXXRGXPWASAGSSSRGSGPRPWXPGQXPRA

SEQ ID NO: 190294 - protein, 114 aa, Triticum aestivum
  unsure (1)..(114): unsure at all Xaa locations
  Clone ID: PAT_TA_84712.pep
MTFKRRNGGRNKHGRGHVKYIRCSNCAKCCPKDKAIKRSXVRNIVEXAAVRDXXEVVCMMECLPKLYAKVTLFSSQSIAISVSLEQEERAPLSAGIIAKASQGPRAKCCPWCVY

SEQ ID NO: 190295 - protein, 41 aa, Triticum aestivum
  Clone ID: PAT_TA_84713.pep
LQIGRRPLFIEEGGWTLYTTGFRAKSANIANKHSTKLGTLT

SEQ ID NO: 190296 - protein, 102 aa, Triticum aestivum
  Clone ID: PAT_TA_84714.pep
FAAATRRSDRSRARSVAMARCRHHLLLLSVLLALAAAAARQAQSHGKASAVFIDASSHRYLRDQQADHQDASMSLNEVSAVVSVLLGFRTVNIPTKLFLPRS

SEQ ID NO: 190297 - protein, 75 aa, Triticum aestivum
  Clone ID: PAT_TA_84715.pep
RSPRSPQDPSAAVNETIAVDEAQDEEEDLTLGSDAESSTASISSSILNYRTINGRTFHSERGNATYWGSNDERQK

SEQ ID NO: 190298 - protein, 156 aa, Triticum aestivum
  unsure (1)..(156): unsure at all Xaa locations
  Clone ID: PAT_TA_84716.pep
RRFVLEKRARSKLAPARTYLLNILNDVNTLANVNQEVAQSELERVTQELKELEPQLESSRRAKTEVSESVDANVEETCKDVYDYTRNTLNSAILHSGXSHYDVPYPGIWNAFXYAEDLKEAMLSRIANSVSNCEEYARRKTCXGVNAIKQLGILHL

SEQ ID NO: 190299 - protein, 144 aa, Triticum aestivum
  unsure (1)..(144): unsure at all Xaa locations
  Clone ID: PAT_TA_84717.pep
SDPYLSFASSVNGLAGPLHGLANQEALLWLKSIIQETGSDVTTDQLKDYVWKTLKSGKVVHGFGHGVLRRTDPRYLCQREFALKYLPEDPLFKLLSKLYEVVPPILTEXLGKVKNPWXPNVDAHSGLLAEXLGLSETRYXXXLS

SEQ ID NO: 190300 - protein, 148 aa, Triticum aestivum
  Clone ID: PAT_TA_84718.pep
MSEHDLTALMAAQLDRHLVFPLLEFLQERQLYSESEILEAKIRLLSGTNMVDYAMDIHKSLYGTDDVPEDMVKRRAEVVSRLRSLEEGRARRLPEPARCRSSGPTSTTSHAPIQIGPDIDACIVCQIQFCNYGLRLTAQTECPGTGQS

SEQ ID NO: 190301 - protein, 168 aa, Triticum aestivum
  unsure (1)..(168): unsure at all Xaa locations
  Clone ID: PAT_TA_84719.pep
PDAGVEVRALPTRAGTRVVSAFWRHPAARLTLLYSHGNAADLGQMLGLLLELRTHLRVNIMSYDYSGYGASTGKPSEYNTYNDIEAVXDCLKKDMGXRRGLILXWGNXXGSGPTXLHLTSRLGNIRGXVLXNGILSXIRVLFPIKXTLWFDIFKEHRQXTSXCLCWQN

SEQ ID NO: 190302 - protein, 79 aa, Triticum aestivum
  unsure (1)..(79): unsure at all Xaa locations
  Clone ID: PAT_TA_84720.pep
MFGYQKGLDVEAGTSGAAATGGARQLYPGMQESPELRWALIRKIYVILSLQLLLTXVVAAXVVKVAPSRTLHTQRRLGL

SEQ ID NO: 190303 - protein, 53 aa, Triticum aestivum
  Clone ID: PAT_TA_84721.pep
WLLLQDCSSLLTLEEGAPSIVSFEKSQLLLPSYHFEDWKRWTSVTLSIYHLEL

SEQ ID NO: 190304 - protein, 94 aa, Triticum aestivum
  unsure (1)..(94): unsure at all Xaa locations
  Clone ID: PAT_TA_84722.pep
LPTXSVLXHLXXDXCPSLSKLXNWTSNYXNPFIXGVFXLIRQERRRMRRTALGYENQIDLGPRRMGXKLVNMXXVESCFNXTTVANREXSEHVD

SEQ ID NO: 190305 - protein, 53 aa, Triticum aestivum
  Clone ID: PAT_TA_84723.pep
FFFFKQILHVVVLYSLNGNRCVLHLHFSKEPKPIRNILHLGVPTIQHNTNSKT

SEQ ID NO: 190306 - protein, 76 aa, Triticum aestivum
  unsure (1)..(76): unsure at all Xaa locations
  Clone ID: PAT_TA_84724.pep
PVGXLCCIXPLGXXIXDDGQVXGXGAGRGFRGGIWRLVRRRPQTLGLSCSSAGGDSTRADIFISSGDEEDQQSRXP

SEQ ID NO: 190307 - protein, 31 aa, Triticum aestivum
  Clone ID: PAT_TA_84725.pep
GLGPIQRILLGSVTNYVLSNASCPVTVVKGK

SEQ ID NO: 190308 - protein, 74 aa, Triticum aestivum
  Clone ID: PAT_TA_84726.pep
SFYYCLRDQAAATGEGDLFYKVKYLAWDMETVVGDLMATELRLGLPGTVGRLQPAPAADPAEGGRAAVQPTRGK

SEQ ID NO: 190309 - protein, 65 aa, Triticum aestivum
  unsure (1)..(65): unsure at all Xaa locations
  Clone ID: PAT_TA_84727.pep
NTYAGACFQLPTTLTRAWWLVLTQKHRNNMALIFKFSFDKKATQCGRFAYNRVWEKAPXLEQLAY

SEQ ID NO: 190310 - protein, 115 aa, Triticum aestivum
  unsure (1)..(115): unsure at all Xaa locations
  Clone ID: PAT_TA_84728.pep
MAASMITSPIVAPTSVPSLSRRGSSFAVVCSGGKKIKVDKPLGLGGGLTVDIDANGRKVGKKGVYXFVDKYGANVDGYSHLHPRECXSGDRYARRNNXFLSGXNLAXLLXGXLLV

SEQ ID NO: 190311 - protein, 105 aa, Triticum aestivum
  unsure (1)..(105): unsure at all Xaa locations
  Clone ID: PAT_TA_84729.pep
MCQGGDFTRGNGTGGESIYGEKFPDEKFVRKHTAPGVLSMANAGPNTNGSQFFICTVATPWLDGKHVVFGQVVEGMDVVKAIEKVGTRNGSTSXVVKVADCGQLS

SEQ ID NO: 190312 - protein, 162 aa, Triticum aestivum
  unsure (1)..(162): unsure at all Xaa locations
  Clone ID: PAT_TA_84730.pep
MAAALRSPASAKVSSPAAASKVRQASRVAVGGFRQHPRSRVGPVAVRASLFSPKPAAAKDARPTKVXELYVYEMNERDREXPAYLRLNAKQTENXLGDWXPSQTRLQRHLGQALGITAGLLLXQHXPRRNGDGTSIYTLDTIPKGVLTTGSTGVRRSSRPTQ

SEQ ID NO: 190313 - protein, 88 aa, Triticum aestivum
  unsure (1)..(88): unsure at all Xaa locations
  Clone ID: PAT_TA_84731.pep
ALGEAMGNVNTGLADEKVSECVKEVVCCSSDHTQMDQDDGSCAICLEDYRDKEALGILKCRHDFHAGCIKKWLQTXIXPVCKXAAANR

SEQ ID NO: 190314 - protein, 142 aa, Triticum aestivum
  unsure (1)..(142): unsure at all Xaa locations
  Clone ID: PAT_TA_84732.pep
LEEALAQAPNAALVMGHNGIFRNDTTDVYEGAIPNWGKKRPIKSIVVGRPILLALEDIDGSPSFLXEKALCFLEKHGMKVEGILRQAADVEEXVDRRLQEYEQGRDRFAPEEDXKLFVRVNPRELQLPSSVTFWTSVGNKPN

SEQ ID NO: 190315 - protein, 127 aa, Triticum aestivum
  unsure (1)..(127): unsure at all Xaa locations
  Clone ID: PAT_TA_84733.pep
SCXCSPAFEXPSGIRSPRFQERSLREVLEEXAVDNVVTQEPRXVAMAPRKXRTSCXHQSSYRTMLCSLPAXILCTFVFWRWSIPVHSERNNTDVLSFSFFPLLCLRGLLVKLCTSQLLWYSEKERRG

SEQ ID NO: 190316 - protein, 59 aa, Triticum aestivum
  unsure (1)..(59): unsure at all Xaa locations
  Clone ID: PAT_TA_84734.pep
PPXWGFCXXFAEARNHSTSAQKVDIDLRQXGTWYIAERSQTSCVQPKAPWQIDTPVSXF

SEQ ID NO: 190317 - protein, 118 aa, Triticum aestivum
  unsure (1)..(118): unsure at all Xaa locations
  Clone ID: PAT_TA_84735.pep
WVKQEXCCSVPCFPGARFXGRXVNLNHSMXKLHPGCSNPAYNVRIXNLQAXLSXRLQYSXITIXKKKXRGGXVPIRLNDLYRXMAXLXSTGKLXTTNPXXXLXSGXTKPTFLKFXLRX

SEQ ID NO: 190318 - protein, 102 aa, Triticum aestivum
  unsure (1)..(102): unsure at all Xaa locations
  Clone ID: PAT_TA_84736.pep
FSKLFEELLGYXSYVVMXXGRRAVNRIXIXGIRIXKXXXLLGNTFXTKVDELTGLCXTGRLPQVGLDNVXPAXXVPATFSFCIGNRITRAPFTRTFCLFGIV

SEQ ID NO: 190319 - protein, 172 aa, Triticum aestivum
  unsure (1)..(172): unsure at all Xaa locations
  Clone ID: PAT_TA_84737.pep
RVGVALSKDLMAVAGEALRTNITTLGPLALPMSEQILFLASLVARRVFGARGVRPYIPDFKMAFRALCIHAGGRAVLDTIREELGVNAWXMEPSRMTXYRWGKTSSNSLWYNSPTXXKGRLRRXNALEISFGQVQQHFGRSTSTCQGPPWPGGNSEGQVETLMSHHGAIHSV

SEQ ID NO: 190320 - protein, 119 aa, Triticum aestivum
  Clone ID: PAT_TA_84738.pep
LGLSPHSDAAGLTLLLQVSAVPGLQIRRRGAWISVDPIPGALVANVGDVVEVLTNGRYKSIEHRALVSPTHHRVSVAPSTSPPATLTRRFEETLSVNQRGTGWRRTTSAWCCPSSKGKT

SEQ ID NO: 190321 - protein, 94 aa, Triticum aestivum
  unsure (1)..(94): unsure at all Xaa locations
  Clone ID: PAT_TA_84739.pep
SLNXIQVAILNGSCFVGLRLVDRSSKQFCPXKXYGDCFFRDDRGVMLNVHMAQCIAFVQSGQKRRHAGGFIRTRVLNIATFFVQFNQKPNIQSG

SEQ ID NO: 190322 - protein, 55 aa, Triticum aestivum
  unsure (1)..(55): unsure at all Xaa locations
  Clone ID: PAT_TA_84740.pep
SCSRKTNGXGICGPFICHMPLACLNMELFPLRYLSDTGPEPGIHSRLNSPFTYIV

SEQ ID NO: 190323 - protein, 62 aa, Triticum aestivum
  Clone ID: PAT_TA_84741.pep
IGICTLNLQSMHDNRSSHFTSFHQHKHSHLKPFKRYNLVKKVCQCFSKACNHRVVPTLLTWE

SEQ ID NO: 190324 - protein, 106 aa, Triticum aestivum
  unsure (1)..(106): unsure at all Xaa locations
  Clone ID: PAT_TA_84742.pep
PXXFXLXXIRQGTCDVLFRIAINKERXXSTGILRIFXHMLSREMTSCSGTRSQISPTWIFVGLTFLNGTXGSSVRCLXXTHLDLSMDRKHGRVPSGQQFVXKLQKP

SEQ ID NO: 190325 - protein, 109 aa, Triticum aestivum
  unsure (1)..(109): unsure at all Xaa locations
  Clone ID: PAT_TA_84743.pep
MSGRGKGGKGLGKGGAKRHRKVLRDNIQGITKPAIRRLARRGGVKRISGLIYEXETRGVLKIFLXENVIRDAXTYTEHARRKTVTAWTSLRAXSAKGRPFNXFXGKGAS

SEQ ID NO: 190326 - protein, 46 aa, Triticum aestivum
  Clone ID: PAT_TA_84744.pep
NPGVITIASAVFGSKPPISDDVLAKAFQVEKKLIDWLQSQFWDTNY

SEQ ID NO: 190327 - protein, 127 aa, Triticum aestivum
  unsure (1)..(127): unsure at all Xaa locations
  Clone ID: PAT_TA_84745.pep
GRPRXVSWPPRGVXXHPAXGXFFTXCXWNSTVEPCRRLPLNXHPXRHGDXXRQREVRXHVWKVGTEVAGDQLERGEIKAAIDRLMGGSEEGEGIRKRMNELKIAADKGIDESAGSDLTNLVHLINSY

SEQ ID NO: 190328 - protein, 50 aa, Triticum aestivum
  Clone ID: PAT_TA_84746.pep
IPRSHSHSTYYARETRYKYTLIYIHTLCPKKINNHMQFLTIYVCFSLRSA

SEQ ID NO: 190329 - protein, 126 aa, Triticum aestivum
  unsure (1)..(126): unsure at all Xaa locations
  Clone ID: PAT_TA_84747.pep
SKHCPLWYGYGGGLKFLERFSYINSIVYPWTSIPLLAYCTLPAICLLTGKVYHTXELTNVASIWXFMALFICISVTGILGNEVKLXLAIEQLGGRNNNSGASEGVSGAXFPGSXGLLKGSPGXQXX

SEQ ID NO: 190330 - protein, 158 aa, Triticum aestivum
  unsure (1)..(158): unsure at all Xaa locations
  Clone ID: PAT_TA_84748.pep
RLRGGMQIFVKTLTGKTITLEVESSDTIDNVKAKIQDKEGIPPDQQRLIFAGKQLEDGRTLADYNIQKESTLHLVLRLKGGMQFSVKTLTGKTITXEVDLQDTIDNVQGKFXDKEGFPQDQXRSLXXKHLRTAKLADYTSXKGXLHLGSPREDETLRD

SEQ ID NO: 190331 - protein, 63 aa, Triticum aestivum
  unsure (1)..(63): unsure at all Xaa locations
  Clone ID: PAT_TA_84749.pep
PNYLFEIVGLFGVAMIAQTVYALAYATGAAAYLAGRSCATRRWYXSKFDEFPARIKALVPYVL

SEQ ID NO: 190332 - protein, 50 aa, Triticum aestivum
  Clone ID: PAT_TA_84750.pep
DDVPVLKLVPLLMVVASLVLETDCIWSALFLSLHQWTYPFVFSQGILPCR

SEQ ID NO: 190333 - protein, 126 aa, Triticum aestivum
  unsure (1)..(126): unsure at all Xaa locations
  Clone ID: PAT_TA_84751.pep
MSKYGTIPTSSSAGGGPVPLGGASPLDFISRAKARGASALATRRPWARVVDVHAVGXPPSLXDAYXRVRANXAHFAMNXIVVLSSSSLLLLEPVSLIVFLVCMLAWXVLYFSAKSPRLFGASRRRY

SEQ ID NO: 190334 - protein, 67 aa, Triticum aestivum
  unsure (1)..(67): unsure at all Xaa locations
  Clone ID: PAT_TA_84752.pep
PEXPRKPKKGAXLSPLNADDIFPLLLPLPVLPRLPLCYGHRRERSRFRTTARDWPCRSDLKSAWVPG

SEQ ID NO: 190335 - protein, 54 aa, Triticum aestivum
  Clone ID: PAT_TA_84753.pep
MSSHRVKWNEDNLYEIESNKPVRQKITEPKTPYHPMIDDDGSLSPTLLSDKCPG

SEQ ID NO: 190336 - protein, 99 aa, Triticum aestivum
  unsure (1)..(99): unsure at all Xaa locations
  Clone ID: PAT_TA_84754.pep
MVCVACLLPLFLIPVVNALPYLIDLIISKVYRLFGWEYRRPXKIPPACPYKPAVRRTMRVRVNQNPGRTARCWVLRRQKIRKWMMQQALKMVATSVWLA

SEQ ID NO: 190337 - protein, 116 aa, Triticum aestivum
  unsure (1)..(116): unsure at all Xaa locations
  Clone ID: PAT_TA_84755.pep
RSNLYYSFEVAGAHIIMLXSXTDYDDSSDQYAWLKADLAKVDXKRTPWLIVLLHVPWYXSNWAHQGEXDSMMASMEPLLYXAHVDMVIXGHVHAYEXAERVYNSKXDPWGAVHITI

SEQ ID NO: 190338 - protein, 71 aa, Triticum aestivum
  unsure (1)..(71): unsure at all Xaa locations
  Clone ID: PAT_TA_84756.pep
NLYITGLLLILSLVKLTSYPYASEAAVDDEXNPVIMLVYVXTARSRILRDYWLLLKYWFXFGETTSCLYTG

SEQ ID NO: 190339 - protein, 109 aa, Triticum aestivum
  unsure (1)..(109): unsure at all Xaa locations
  Clone ID: PAT_TA_84757.pep
LVSVMMTSHSSVLVAGLVCLSAAVVVPMPWLAAGESSIGGAECKRSCGGVEILSISPEQGEAKVLLPISSYCYDLRLGRXWRRVDWPWAPITVLQQGQQXTXXGAPAPG

SEQ ID NO: 190340 - protein, 94 aa, Triticum aestivum
  unsure (1)..(94): unsure at all Xaa locations
  Clone ID: PAT_TA_84758.pep
MGGAKAEDKPAAAAAEDWCYQFGNKDAFDLKPXKKSPIALRTVVFAMTMLCGISICSMCMKQLXSDGWSRVVKIEXXEQQFIQLLSFGQFRYLR

SEQ ID NO: 190341 - protein, 152 aa, Triticum aestivum
  unsure (1)..(152): unsure at all Xaa locations
  Clone ID: PAT_TA_84759.pep
SSLXGPGGRWNRKVVGRCRAICRQPQSFCLTXTRXSGLXPRRWTLASWAIXTRXXFVASCSRQQSFAGSMSIPPVTSTLTSPASASAETSALSTPCERLIISFTASFIFLTQPLHWQCMSSFRTYVFEPPAALHCPFPMITYAPAFEVALQL

SEQ ID NO: 190342 - protein, 112 aa, Triticum aestivum
  unsure (1)..(112): unsure at all Xaa locations
  Clone ID: PAT_TA_84760.pep
MPKDRSSRVSSYESRRAGASPYFSSSHGQSSSCRRSEESCGAAAAAAAKQAAEWEDVRCPVCMDHPHNAVLLVCSSHEKGCRPFMCDTAXRHSNCYDSTGRLQGSTDATQQQ

SEQ ID NO: 190343 - protein, 114 aa, Triticum aestivum
  Clone ID: PAT_TA_84761.pep
RMSLLLLFTQTMYKHGLNRRPARDSVTEQTNKQQTPPQHSCISPKRYFHPGNSQAHFPRAGAITFDKHAVQQQQQAVRSSETAGRRPLTPSAYGWSPCPRPRRGCLPRHGPTNP

SEQ ID NO: 190344 - protein, 90 aa, Triticum aestivum
  unsure (1)..(90): unsure at all Xaa locations
  Clone ID: PAT_TA_84762.pep
PXXXXLXXXKXGEVIXXXRPXSPHSFSLWMVSMSTXXPRVPSSTWSQQPMXNFHHQLNRGNXNHPRNVSLXXTPXLLAVSTXSXXXXVRX

SEQ ID NO: 190345 - protein, 125 aa, Triticum aestivum
  unsure (1)..(125): unsure at all Xaa locations
  Clone ID: PAT_TA_84763.pep
MAVKIYVVYYSMYGHVGKLAXEIKKGALSVEGVEAKIWQVPEILSXEVLGKMGAPPKPDVPVITPQELAXADXILLGVPDKVGMIXTQIKGFXXSTVGSGRNKASLEXCRMXXKTGNQGGGKKNA

SEQ ID NO: 190346 - protein, 102 aa, Triticum aestivum
  unsure (1)..(102): unsure at all Xaa locations
  Clone ID: PAT_TA_84764.pep
MNDADVAKQIQQMVRFIRQEADEKANEISVSAEEEFNIEKLQLVEAEKKKIRQEYERKEKQVEVRKKIEYLCNLXCSRNKILKAQRMIQLNKMKRXSIKESP

SEQ ID NO: 190347 - protein, 88 aa, Triticum aestivum
  unsure (1)..(88): unsure at all Xaa locations
  Clone ID: PAT_TA_84765.pep
KLLRTTRRIRIRGPFVRHTPXTYRTRNFPPPVSARKHKHRGILSRGXPPFNXFNYNALGXRXRVLPCKFGKLVARIIILPLPRXHXRA

SEQ ID NO: 190348 - protein, 69 aa, Triticum aestivum
  Clone ID: PAT_TA_84766.pep
FFFLDANFPVFDFIGTRANLTFSMKNPRYPDLEAPGTTGKYRYYRRLARSKCLGKFDTTGITDNSGCSS

SEQ ID NO: 190349 - protein, 101 aa, Triticum aestivum
  unsure (1)..(101): unsure at all Xaa locations
  Clone ID: PAT_TA_84767.pep
RSPXKGGXXXKXGXXTXSAXTGPPFFAHAHGHVALRHGPRFLPLAPPAPVVLAAGPRRRHRRPSXERXPXPTVRDSRRRSRFMAGWDGWVGGGGGGGAGAE

SEQ ID NO: 190350 - protein, 123 aa, Triticum aestivum
  unsure (1)..(123): unsure at all Xaa locations
  Clone ID: PAT_TA_84768.pep
ETQRSRGFGFVTFSTEDAMRSAIEGMNGKELDGRNITVNEAQSRGGRGGGGGGYXGGRRDGGGTAGGGGGYGGXRGXRXGGGGYGWCKPAXAANXNNDGNWEELSGGVRSLLCSLPLPCSPLS

SEQ ID NO: 190351 - protein, 134 aa, Triticum aestivum
  unsure (1)..(134): unsure at all Xaa locations
  Clone ID: PAT_TA_84769.pep
TSEKMSELAEDSRLQCMEFASPVLANFASKECGETPEPQVLNEIVEDSRLQCIEFNSPAHTISQIKQAPKTXASPXLMWVAKDSKPPSLGFTSPAHTVAHSNRYADGIPTPXIHXXXRXFLLSXLXLTQPRSKA

SEQ ID NO: 190352 - protein, 56 aa, Triticum aestivum
  unsure (1)..(56): unsure at all Xaa locations
  Clone ID: PAT_TA_84770.pep
EKRVRRERERXRXIERXPLIVXSXXXLRXIRKESNIYNPPLXPGHXPNWNXCXXXT

SEQ ID NO: 190353 - protein, 155 aa, Triticum aestivum
  unsure (1)..(155): unsure at all Xaa locations
  Clone ID: PAT_TA_84771.pep
SDNSSSFFLLLLFSTAHPPFFFSSSIGKLRRHHCLSSDPRRARVAAQDDDGNSRWQRRRPHHAAPPQHIWIRLRRHGTSEILRRQMRRFGGPRSCQVNGVXADSNQRFYTLPKCFXGIPRLTGIHPXXEIPNGAXQDEVGIPXQAXYXXLGNRWF

SEQ ID NO: 190354 - protein, 105 aa, Triticum aestivum
  unsure (1)..(105): unsure at all Xaa locations
  Clone ID: PAT_TA_84772.pep
HFPINASITNSNTAIEIRNFLGEKKVRKVDMLDGVTILRSEKVKDELXLDGNDVRAPYLRSAALINQXKCHXEEEDIRXFWDGIYXKRQGRHRKTSRQSNPNAKR

SEQ ID NO: 190355 - protein, 146 aa, Triticum aestivum
  unsure (1)..(146): unsure at all Xaa locations
  Clone ID: PAT_TA_84773.pep
RHPPVQHELLPRPATDHRTTRPLPRAQMLHRRLALSSPSSRRLAAPATPSVAPILLSPSKPQLTIASRGLNAALPFLILSLPXSLNCFLLLCQQEFRHGRPSFSLLHLXKPARXXXTSIAQGPXDXNVHGXAXPAGSIPPTXKFSS

SEQ ID NO: 190356 - protein, 148 aa, Triticum aestivum
  unsure (1)..(148): unsure at all Xaa locations
  Clone ID: PAT_TA_84774.pep
EVYGSYDAPSQKKKGFVLPRPKMSNADLGRIINSDEVQSVVKPLNKEVXQXXXRGKNPLKNMAAVLKLNPYXGTARKMAPLLRLLRVKAKKAKLDSKRTKLTPXETAKVKAAGQAWYKTMXPDSDYTDFEXLKMVRVTQFSGKVIFLL

SEQ ID NO: 190357 - protein, 116 aa, Triticum aestivum
  unsure (1)..(116): unsure at all Xaa locations
  Clone ID: PAT_TA_84775.pep
MAARNILRGAACGHRFLVPVPSGALAGSGSRSIGAVAQGLXRHYAARRSNWETWELHAPQGKTSVIYPQTKNGTXMXLPLHIHYEXYYSGLLLQTEXCXIQAIPRLFEAKFTPKPV

SEQ ID NO: 190358 - protein, 64 aa, Triticum aestivum
  unsure (1)..(64): unsure at all Xaa locations
  Clone ID: PAT_TA_84776.pep
YNGLXSXFFNTFXAPFTKRXLLLXVLLLGGXSLLAXXSXTDSPXLLPIXKGPXXXPTPXPLGKI

SEQ ID NO: 190359 - protein, 119 aa, Triticum aestivum
  unsure (1)..(119): unsure at all Xaa locations
  Clone ID: PAT_TA_84777.pep
KISIGLGASRSSRMEKCQPYVQSSVTSRDKQKLFVRFFGVLYRVFNKTNFMLLLDDDWEPLMDNYRPLGNKTLRSAHFLLGNMSPKIEEQKFXYTIHTIGRKLNCIHXFLANLVSCGIR

SEQ ID NO: 190360 - protein, 122 aa, Triticum aestivum
  unsure (1)..(122): unsure at all Xaa locations
  Clone ID: PAT_TA_84778.pep
APAVLLSTSCVLQPPSSLIGYAARWPARAAALPCVHPVPNPACGRRRLVXLRPRFRPNLLXCAPKAKMPLXPTAGXCCXQVKQSRYXGSNPXPCNXVXGXFLKKXCXNNXXXSXCQIQXLVE

SEQ ID NO: 190361 - protein, 152 aa, Triticum aestivum
  unsure (1)..(152): unsure at all Xaa locations
  Clone ID: PAT_TA_84779.pep
GSKGXQVIVIKQXLSGIXPGGLEIXVLVRFRSDCNQLTXDXXDGNGKLGNXSFLDFVRNRLSGSLPAEILGAGIXTFVDCXGQRISGECHRTVPGLLSLQYLDLSYNVIGGTLPSDIGMLTSLTKLILSGNRLSGPVPPDIGSCSRLQLLDL

SEQ ID NO: 190362 - protein, 77 aa, Triticum aestivum
  unsure (1)..(77): unsure at all Xaa locations
  Clone ID: PAT_TA_84780.pep
XFGICSNTKTILTTNSFFFFEHTQIKLTLCMXLXSGQGGYFKXCTGWXWPHPIRPNCSSNTTVQEXLLPFGPCIXAX

SEQ ID NO: 190363 - protein, 110 aa, Triticum aestivum
  Clone ID: PAT_TA_84781.pep
EYVHVSHNCRHLLSRIFVQNPYKRITMSEIKTHPWYLKNLPRELKEEAQAAYYYSRQGRQQQQQASNNATADPPTPSQSVEEFLRCREGQNGATNVQGPDEARQQEERRP

SEQ ID NO: 190364 - protein, 84 aa, Triticum aestivum
  unsure (1)..(84): unsure at all Xaa locations
  Clone ID: PAT_TA_84782.pep
GVRPVAMRPSSXASNSRKISLHSSTCSGVSFSAMLAHRSQPQPLPLAMDALDERSAEFSFILIRFRQIKRVNSKFRSGRPLATF

SEQ ID NO: 190365 - protein, 130 aa, Triticum aestivum
  unsure (1)..(130): unsure at all Xaa locations
  Clone ID: PAT_TA_84783.pep
REFNIILDDVAITHLSYGIEFSLAVEKKQVAQQEAERSKFLVAKAEQERRAAIVRAEGESESARLISEATAMAGTGLIELRRIEAAKEIAAXELARSPNVAYIPSXGENGKMLLGSQMLLGFGPVDSLFF

SEQ ID NO: 190366 - protein, 46 aa, Triticum aestivum
  Clone ID: PAT_TA_84784.pep
FPVNLLCCFLSFFPPDSSGLVVDPCHCIVVQLNQQLFWLVLHCNLT

SEQ ID NO: 190367 - protein, 92 aa, Triticum aestivum
  unsure (1)..(92): unsure at all Xaa locations
  Clone ID: PAT_TA_84785.pep
SSSSAAASSSSSSGGSSLSSSGGAAGEGEDGADAGDGEEYDSSNLIATRSAGAAGYLGRMRGGNXEPGXKEERDLFGSNNERYSRTPARSHY

SEQ ID NO: 190368 - protein, 90 aa, Triticum aestivum
  Clone ID: PAT_TA_84786.pep
AVCADQIESGRSSGCWSHPEAQAEEWGKRTPSLHMDMATLLMITGVLHRDTPRETLGIRPPVIASGTRLLRRTVYSRRHMPGCRGSIQDR

SEQ ID NO: 190369 - protein, 115 aa, Triticum aestivum
  unsure (1)..(115): unsure at all Xaa locations
  Clone ID: PAT_TA_84787.pep
RVLCSSTPLSIHRTHTVTLTPPPSSRFSCRASRAAPAAGAGYPSTRSGSGAAAPARDGGAGRGGGAXRGVGGGAQPLSGCCGCTRRLTPATRAGAQELLAPDSSGWVHGLPARQQ

SEQ ID NO: 190370 - protein, 141 aa, Triticum aestivum
  unsure (1)..(141): unsure at all Xaa locations
  Clone ID: PAT_TA_84788.pep
MAKKRKRTDAPAEAAGAEKPDDSAPARPERTLFGFKDLVPDAEPASAGAEAAVAPFRNREKVLITCSRRITYXYRHLMQDFCRXSPHXKKXSKXEXKQTKGNALNXSFNSXSCSNCFSSNARKKRXYLWMGNXLGGPSXNF

SEQ ID NO: 190371 - protein, 97 aa, Triticum aestivum
  unsure (1)..(97): unsure at all Xaa locations
  Clone ID: PAT_TA_84789.pep
MKGTKLAAILILQAVLVMGLLSHVNADFFPKCCNNCRSFSGVXDVCDDAHPKCPQXCSGXRVXVXXSPEMWRCAXDMKSTVXXTXGGPCXXSGCRIP

SEQ ID NO: 190372 - protein, 82 aa, Triticum aestivum
  Clone ID: PAT_TA_84790.pep
PNDFFADATSQINAYVQSAKVDGVITDFPGTAHRYKLNSCTSMGKNMPLFMQPPQPGGPPFNHSPKMHSHQAAAPMPLLDGR

SEQ ID NO: 190373 - protein, 127 aa, Triticum aestivum
  unsure (1)..(127): unsure at all Xaa locations
  Clone ID: PAT_TA_84791.pep
GQGKEKELDLSSNDVVTKYKAAAEILNNALKIVVSQVQAKSKXVDLCEKGDXFIRXEQTGECFTKNAKRKIERGLLFPTWCTXSMDTXWHFXNGWQXDMAFXEXNDXXXIDIGGXIEXFYCGWWTTH

SEQ ID NO: 190374 - protein, 119 aa, Triticum aestivum
  Clone ID: PAT_TA_84792.pep
MESAWMVQTARWEPPAFKQPTVRANRMHPYEASDHKPIDKKNKPFTGYRTVLDELLDKPCQDTYDIRAPHQRTASGHVGYPASGKSGEGYPHQYYSKRRSFRRMTISTSLRPSETSPSK

SEQ ID NO: 190375 - protein, 52 aa, Triticum aestivum
  unsure (1)..(52): unsure at all Xaa locations
  Clone ID: PAT_TA_84793.pep
QQENRFRHPLLFEQEASLSHREPPAAGFPPFSXSVYTHHLNPETANTFTLFV

SEQ ID NO: 190376 - protein, 125 aa, Triticum aestivum
  unsure (1)..(125): unsure at all Xaa locations
  Clone ID: PAT_TA_84794.pep
RSSSRILFTSSGTDSGLAAERKTLSFLCFHKCQHTKITIVSKALRFSLRFVFGYCPTIAPDCHLSPRARIGWILRIGRGSCSTLGRRIDALGPGDDQHCXLPXPKRYNGKXQLXTHAVPPIXXSK

SEQ ID NO: 190377 - protein, 67 aa, Triticum aestivum
  unsure (1)..(67): unsure at all Xaa locations
  Clone ID: PAT_TA_84795.pep
RPLVGRCSKPSKAVAIFKKSRILSQPNPSLTXWASRVPNLPLTFAHCPSIGDTTKLXDTNLSSKRLP

SEQ ID NO: 190378 - protein, 148 aa, Triticum aestivum
  Clone ID: PAT_TA_84796.pep
QPDSIAAHSVGGSFSSVSLSKSSTMDHSMHFTSSRLSDAITGDGIVNRGQALNDADDEECKDMPLILRNKAPRWARAVQCWVLNFRGRVTGRSGQRFPVVRGDTAGRPGALDPSTRQPGSQFAPSGRTREIRILEEFYQYTAVNFQAF

SEQ ID NO: 190379 - protein, 89 aa, Triticum aestivum
  Clone ID: PAT_TA_84797.pep
WLTEDERVYRGFFLLILYNLYLGSNKDPRKDPYILAVVRGEMNDGHIYDVGVVLLSPTLDHTTLNSPLVCCGINHPRHHRQALILRDEV

SEQ ID NO: 190380 - protein, 153 aa, Triticum aestivum
  unsure (1)..(153): unsure at all Xaa locations
  Clone ID: PAT_TA_84798.pep
NHFLVTDFLKNKLKFRGFVISDWEGIDRITTPPHANYSYSIEAGVGAGIDMIMVPFKXTQEFIDDLTTQVKNKASPXARIDDAVYRFFRVKFTMGLFREPYPIXLAGESGKQEHRELAREXQESLVPLKNXXLLSPLLPSRRXRKILVPRNNP

SEQ ID NO: 190381 - protein, 139 aa, Triticum aestivum
  unsure (1)..(139): unsure at all Xaa locations
  Clone ID: PAT_TA_84799.pep
SCRSFIHSSITHPSRPPLTSLDHSSSPPHTHTRERIKXRKKRRRIHGEVQVGAARALVGVLRLRRRVRLRRTSAAGPGRPAXRTVQRAERPGRPGGEAAAPPWRRXTCSPRKAGXKTTVRSSVNGQXXSPTPLRXSELI

SEQ ID NO: 190382 - protein, 149 aa, Triticum aestivum
  unsure (1)..(149): unsure at all Xaa locations
  Clone ID: PAT_TA_84800.pep
ARCTKKNFGRYHVSEPPVEHLRDPLYKTEREIMKVFLTKHYRNRRADDPDFFLDFEEIYVIDSXTRSITRAKVMVXVPEGKKRDRRNDLLLIRXRGXLQESSDKTKRDDXSTIIKXEELGKXRQDVXETFKELKNFDYXNWXPGKVTAL

SEQ ID NO: 190383 - protein, 95 aa, Triticum aestivum
  Clone ID: PAT_TA_84801.pep
PFRRACKDALVWSLMSTLMECSYDTELLNNKMKLLACVISSTVSLCVCVHVCTLRTHCVCIYIYADMYACSVCVELTVNPLLYPSVADVVRCDVP

SEQ ID NO: 190384 - protein, 89 aa, Triticum aestivum
  unsure (1)..(89): unsure at all Xaa locations
  Clone ID: PAT_TA_84802.pep
MSSKKIELXHKDMVHDSAIDYYGKXLSTAPQXLTVXLSTFGAGNAPXQGLCKLNGHXXVWRVALXHPKXXXYLAXCNYDGXVIIXKXDH

SEQ ID NO: 190385 - protein, 144 aa, Triticum aestivum
  unsure (1)..(144): unsure at all Xaa locations
  Clone ID: PAT_TA_84803.pep
VTPFEVVKIRLQQQKGLSPDLLRYKGPIHCARTIVREEGLFGLWSGALPTVMRNGTNQAAMFXAKNTFDIVLWKKHEXGDGKVLLPWQSMVSGFLAGTASPVCTGPFXDVVKTKLMVKGRTGDAKYKAWVHAIRTIYPKXGLRA

SEQ ID NO: 190386 - protein, 91 aa, Triticum aestivum
  unsure (1)..(91): unsure at all Xaa locations
  Clone ID: PAT_TA_84804.pep
MSCNCGSGCSCGSDCKCGKMYPDLTEQASAAAEVAAVVXVLGVAPGEQGGTFEVXPAGHPAKGCNCGDNCKCNPATVLHAPLLIRVMVRYT

SEQ ID NO: 190387 - protein, 135 aa, Triticum aestivum
  unsure (1)..(135): unsure at all Xaa locations
  Clone ID: PAT_TA_84805.pep
SRHDPVFAMRGAMHAVRNDMILLENQLPLFVLDLLLGIQLGNPEQTGAVAALAVRFFDSLMPTDAPLRRXGPVQAGVVRSAPRPRRRSTAAGPMLHCLEVFPPDLLRAXVHQAAAAAAGCGCPRSCPSGCQGHSL

SEQ ID NO: 190388 - protein, 118 aa, Triticum aestivum
  unsure (1)..(118): unsure at all Xaa locations
  Clone ID: PAT_TA_84806.pep
RKXLEXXXPESLEEPVPQAGAPEPRQSVPRRSFPGAAARLARSQEHQRRPHQPRXRRESRSPCCTPRYPSRLSRGSGMLEIPIAVGGVRFGDCVARGGLGCKFPLLLGRPTGMVTDSR

SEQ ID NO: 190389 - protein, 105 aa, Triticum aestivum
  unsure (1)..(105): unsure at all Xaa locations
  Clone ID: PAT_TA_84807.pep
RYRPGTVALREIRKYQKSTELLIRKLPFQRLVREIAQDFKTDLRFQXSHAVLALQEAAEAYLGGAVPKDTNLCAIHAKRVTIMPKGHPVPPHPAKGLSCPSRRPV

SEQ ID NO: 190390 - protein, 128 aa, Triticum aestivum
  unsure (1)..(128): unsure at all Xaa locations
  Clone ID: PAT_TA_84808.pep
FGFVTMSSVEEVEVAVDQFNGYVLDGRSLRVNSGPPPPRDRSSPSPQRPRGDANRVYVGNLSWGVXDNQLSANLFNXQGEVLGARIIYDRKVESQGVWFVTLRSPEKVLECISNLXGLTLTXTPCYTK

SEQ ID NO: 190391 - protein, 63 aa, Triticum aestivum
  Clone ID: PAT_TA_84809.pep
AVQAHLPQLRSAPCNMLTMEGSCERAGGTRAAVFFVALYLVALGAGCVMPNMTAYGGEWPGGK

SEQ ID NO: 190392 - protein, 48 aa, Triticum aestivum
  Clone ID: PAT_TA_84810.pep
ATCARCWQRAIWWVSSRAIERVLMVFKCLGLFRLQGIKFYHGFNPTKN

SEQ ID NO: 190393 - protein, 94 aa, Triticum aestivum
  Clone ID: PAT_TA_84811.pep
ALSPCISYARGNGANPPAACCSGVRSLAGAARSTADKQAACKCIKSAAGGLNAGKAAGIPSKCGVSVPYAIKLICGTVLKIPLDSTLLSVASYT

SEQ ID NO: 190394 - protein, 91 aa, Triticum aestivum
  unsure (1)..(91): unsure at all Xaa locations
  Clone ID: PAT_TA_84812.pep
CGYRGQYGCPTGSRMLXPLNREGVPRSCLYFHQTYRVTRLRVIYLAEYLDRGLERKSPKSFGQRDRTAERGHRMSIGETEKVVSGYAIKSK

SEQ ID NO: 190395 - protein, 131 aa, Triticum aestivum
  unsure (1)..(131): unsure at all Xaa locations
  Clone ID: PAT_TA_84813.pep
PRRHSWWRFFILFXDLDSPIFAXMTWGKLLEGCNFSQTDTRLSKVNXIVNGDCTGCSVTGACQCCVSPEEGREILREIHEGDCGHHAGSKSLMAKAFRHGFYWLTAHADAEDLVSKCDGCQKFSRRAHVPA

SEQ ID NO: 190396 - protein, 139 aa, Triticum aestivum
  Clone ID: PAT_TA_84814.pep
STTWPWVRPRLDRPPQLLVSGEQQEDCQKNRRRTQYCQQKEVLLFPYSCKSYVSAHTVFIPRKKLVERFLLHLLRDTKCTRFPPFYYFTFARGSSPPGISIQGQSKPQLKEATPLKRAEQLVRLFPGKRRIVSIIRVWG

SEQ ID NO: 190397 - protein, 117 aa, Triticum aestivum
  unsure (1)..(117): unsure at all Xaa locations
  Clone ID: PAT_TA_84815.pep
XEFXKSLEIXPQNHPVXXVGKIPEISIRXTPCFVCNAFETVRFLIRRCHXSXILCNFRXLNGAGQARCNLAQLSHWLLASWGVIIPCGWNELRSFMPACFCCAIEFVVRDVSFVTFY

SEQ ID NO: 190398 - protein, 113 aa, Triticum aestivum
  unsure (1)..(113): unsure at all Xaa locations
  Clone ID: PAT_TA_84816.pep
ARTQVAANVKTVCDSLSEQREEGGRAGTPAPRTRSGAAPPQRAAPPTTAPSPPTPAPPPRTAAPAAPPXGEAVVPGEERGHGSPHXPSSSSPAPLPSHRRAPAPPLSPCRTQR

SEQ ID NO: 190399 - protein, 138 aa, Triticum aestivum
  unsure (1)..(138): unsure at all Xaa locations
  Clone ID: PAT_TA_84817.pep
YKLFTKYETKFGAVRAQRAAQPSIHTGKRKQAWGRIFGDSSSGVVGPPPSSTPSASSSSAICELSAYLDSDNVTSYEDDFDILLWWRDHKLTYPVLSIXARDIMSVPVSTVSSESXFSLTGRIIEERRXRLMPEKWRC

SEQ ID NO: 190400 - protein, 145 aa, Triticum aestivum
  unsure (1)..(145): unsure at all Xaa locations
  Clone ID: PAT_TA_84818.pep
LAATIPSTDSEDVPPGKKQSAYAIKSGTSMACPHVAGAAAFVKSAHPGWTPSMIRSALMTTATTTNNLGKPLASSTGAAATGHDMGAGEXSPLRALSPGLVFDTKHAXLPRLLCYYGYKEQQVRKXSGAARFSCPGGAPSXDSSR

SEQ ID NO: 190401 - protein, 85 aa, Triticum aestivum
  unsure (1)..(85): unsure at all Xaa locations
  Clone ID: PAT_TA_84819.pep
MMRANREQRVAFSSTKEAAAVPKEEVWEVRPGGMLVQKRSPDADPPPGGAPVPTSASXSSSTASNTRSTSNSQASFGELKETAVE

SEQ ID NO: 190402 - protein, 113 aa, Triticum aestivum
  unsure (1)..(113): unsure at all Xaa locations
  Clone ID: PAT_TA_84820.pep
MSRGGSAGGGQSSLGYLFGSGEPPKPAVAPAASAPPVEKPSAAKTDAGKQGCCWGLQAKTITYNRADGXNXXNFLXDVXXTKAXAAPGXXSXWGNXFGGNDWLNKVFLPGWWQ

SEQ ID NO: 190403 - protein, 118 aa, Triticum aestivum
  unsure (1)..(118): unsure at all Xaa locations
  Clone ID: PAT_TA_84821.pep
SFGHLCFFSGAERPPPSFSISSVSPXRXAASAEQSPRLHPASQCSHGGARIRLGFPPGRMATNGLPDSRSVGMRGKESSRGAAAAAASRKEAARGRSLCIASCGHGRLGVHQWRFDSG

SEQ ID NO: 190404 - protein, 53 aa, Triticum aestivum
  Clone ID: PAT_TA_84822.pep
GVKLLDEAKFPALTAWAERFLAVDAVKEVMPDAGRLLEHYKGFLAKRSPPAGY

SEQ ID NO: 190405 - protein, 151 aa, Triticum aestivum
  unsure (1)..(151): unsure at all Xaa locations
  Clone ID: PAT_TA_84823.pep
GRHGGRDYAVPSLFSDIFRDPLSAPHSIGRLLNLVDDLAVAAPGRAVRRGWNAKEDEXEALHLRVDIPALXGKEHVKVXAEQNNLVIKGEGREGGSEDEAAPPPEYSXGRIQLXPXXYKXXQIQGGNXKRXLKVVPXKVXEXQRKDFSQST

SEQ ID NO: 190406 - protein, 139 aa, Triticum aestivum
  unsure (1)..(139): unsure at all Xaa locations
  Clone ID: PAT_TA_84824.pep
LQLHPDGSIHVGTESGSQSGWTLKVMMLVLPQSLVKLHGLRGFXFAKAEVSSSPFSCRTLNWPPLRFFSAPSIFILDFLACSFLACFSLASFSPLEVELVLLLPLGKIVLLRHVPSLAVAADRHDSSQGKEETRANPSQ

SEQ ID NO: 190407 - protein, 111 aa, Triticum aestivum
  unsure (1)..(111): unsure at all Xaa locations
  Clone ID: PAT_TA_84825.pep
MAEKKQRPGGSRKDEVVTREYTINLHKRLHGCTFKKKAPNAIKEIRKFAQKAMGTTDIRIDVKLNKHIWSXGIRSVPRRVRFRIARKRNDXKDAKEXLYSLVTVSEIPPEA

SEQ ID NO: 190408 - protein, 144 aa, Triticum aestivum
  unsure (1)..(144): unsure at all Xaa locations
  Clone ID: PAT_TA_84826.pep
SFSAPFFVTRFREALFFYSALFDALDATTPRDSNQRMLIEENLFGRAALNVIACEGTDRXERPETYKQWQVRNQRAGLKQQPLNPDSCKXAEQVKDCYHKTCDRLHYRLSCKDGKAAPLSVSTWVANDPPLNLLSVHLSTNFKL

SEQ ID NO: 190409 - protein, 70 aa, Triticum aestivum
  Clone ID: PAT_TA_84827.pep
PITIIPRDEFIKAPQDKSTVRMTMHSSSWEHTWNEITSTEGLWPLRESKEPRSKGLRLHRKRSIADGINC

SEQ ID NO: 190410 - protein, 105 aa, Triticum aestivum
  unsure (1)..(105): unsure at all Xaa locations
  Clone ID: PAT_TA_84828.pep
LIEPYSRVEIAHIAEMIELPIDHVEKKLSQMIVDKKXAGTLDQGAGCLIIFXEDLKTEETSLPPRNIPNVRKVXDSFMXSXAKFMVKHPNLFISFPHFPKHLLPY

SEQ ID NO: 190411 - protein, 120 aa, Triticum aestivum
  unsure (1)..(120): unsure at all Xaa locations
  Clone ID: PAT_TA_84829.pep
TYAVAANMLLHGMXHQXFTTAEGIFTAGWSXXGYXYWFQTPXRWXTXGHYXSLVXMRPLAIWAIQYXVSPPKAILEAPTVKLMDRIHISPHMAPSNNXISIRKVXPDNXXFPSXAFHCEC

SEQ ID NO: 190412 - protein, 86 aa, Triticum aestivum
  unsure (1)..(86): unsure at all Xaa locations
  Clone ID: PAT_TA_84830.pep
MVLQNDIDLLNPPAELEKLKHKKKRLVQSPNSFFMDVKCQXCFNITTVFKQSQXVWCCPSCKTCSGXPKGXKGKXXRVVPSAAKXN

SEQ ID NO: 190413 - protein, 156 aa, Triticum aestivum
  unsure (1)..(156): unsure at all Xaa locations
  Clone ID: PAT_TA_84831.pep
EYKPEDLPVWNFDGSSTNQAPGDNSDVYLRPCAVYPDPFRGSPNIIVLAECWNADGTPNKYNFRHDCVKVMDTYADDELGLGLGTGXHLLGLDNRPYGWAAGGSLLPKGXYTGGVGTGKXLQRDIVXANYXXACMPGQIPGXTXGMPAQWETSPAG

SEQ ID NO: 190414 - protein, 149 aa, Triticum aestivum
  unsure (1)..(149): unsure at all Xaa locations
  Clone ID: PAT_TA_84832.pep
KNAVVTVPAYFNDSQRQATKDAGVISGLNVMRIINEPTAAAIAYGLDKKSSSDGEKNVLIFDLGGGTFDVSVLTSKEGSLSQRQRRRYHLEAXDXRQRSLNTFSKEFKREEQEGITWNPKXSRRFKTPCXKVKRRLLQRPKHTILLRDH

SEQ ID NO: 190415 - protein, 116 aa, Triticum aestivum
  unsure (1)..(116): unsure at all Xaa locations
  Clone ID: PAT_TA_84833.pep
MHSFGHRANAVATFAVTILAAMCFAASFSDNFNTLTPTASVKILNINWVPRRRPXGNDEVSMTLKHSADFXXLLTWXNTKQVFVFVATKYETXKSFKSIPFGMDYTAKEMQVSIQQ

SEQ ID NO: 190416 - protein, 149 aa, Triticum aestivum
  unsure (1)..(149): unsure at all Xaa locations
  Clone ID: PAT_TA_84834.pep
VRREYTVRTPVMIASIQITRQRIGRCNFIRHKVLIRSLTRLEGTKADNNRRLRCKNCIWSKTHFXXPMXSXCXAFNLGGFPTQXXRFSRWKPLGPSXXXGTHAYASPKISXXXPGXXLAXPVPXALGFXTPXRXNFPLLKFWTLRAPGS

SEQ ID NO: 190417 - protein, 78 aa, Triticum aestivum
  Clone ID: PAT_TA_84835.pep
MKEGTANCVDILIAIILPPLGVFLKFGCKVESGLPLAHFLAYLPGIIYAIYAITKGLARSSWGASAGPPLFSTVKYYY

SEQ ID NO: 190418 - protein, 162 aa, Triticum aestivum
  unsure (1)..(162): unsure at all Xaa locations
  Clone ID: PAT_TA_84836.pep
QIPAAKSSPPWDEDWGPSKKTGVPSLSVDSSAQTKQPSVHPFDFSTQTKQSTPLPFDLSTRAKQPSLVXHATAATIPPAQPQPSTSLGASSXTQTSGXCALVDIEWXXPKKSASDFNEPXXINKENDPGRYLXKXXTIDPLADWPQNYKVLFSTISKHKYLG

SEQ ID NO: 190419 - protein, 47 aa, Triticum aestivum
  Clone ID: PAT_TA_84837.pep
YSEQRWIALDNLLLVFIIQRSDLRQYLLFRSILYQLPFLAPFYQKKK

SEQ ID NO: 190420 - protein, 47 aa, Triticum aestivum
  Clone ID: PAT_TA_84838.pep
RFASVQLPNKPIRCKQASSNFKKKGPVHGALGYCADGTVLDILNTQM

SEQ ID NO: 190421 - protein, 88 aa, Triticum aestivum
  unsure (1)..(88): unsure at all Xaa locations
  Clone ID: PAT_TA_84839.pep
VPCLEFSKVGFVFREHNSSPGYYDGRYWTMWKLPMFGCTDATQVLNEVEEVKKEYPDAYVRVIGFDNLRQVXCVSFXRLKAPGXKDPG

SEQ ID NO: 190422 - protein, 79 aa, Triticum aestivum
  unsure (1)..(79): unsure at all Xaa locations
  Clone ID: PAT_TA_84840.pep
XLXFPXQLFTSRXXVNHMLKXPTFNCYXCXXFPXKGFAKGXXXKGXEXQNPGKGEKXLNMLPXGTRXXLXGXPNSSEXP

SEQ ID NO: 190423 - protein, 151 aa, Triticum aestivum
  unsure (1)..(151): unsure at all Xaa locations
  Clone ID: PAT_TA_84841.pep
RLXNLVVRRHGGHQQQVVVVLELGAAGSCRTARGRRRGGVRPGGGXXGGVXHXQRAXHVXPXRGXQYXXXAGRXVXXVLRLAGGGGLKCLCGYXNSXXMGVYNXEXMRAXSFLTCXAXLXVPNCXSVXXIQXKHEGPGFXLYVSXXYLPGE

SEQ ID NO: 190424 - protein, 97 aa, Triticum aestivum
  unsure (1)..(97): unsure at all Xaa locations
  Clone ID: PAT_TA_84842.pep
FLPPKARARGPKTSAFSCPPACLLVIAAAHEPPAPCRPALYGSAPTSPRGARKRSVKSRRRGERAVRHGINRYFQPVERPKCADSKXKNFGXIXNAG

SEQ ID NO: 190425 - protein, 132 aa, Triticum aestivum
  unsure (1)..(132): unsure at all Xaa locations
  Clone ID: PAT_TA_84843.pep
VSYXAGSILGKPLIILPESSRXVXXPGXQVGMMMPSQXLALCAIXLGXTXSRKMEFQSSGRSDDQLVLQLRLAGHGDRPKVRAWRSVEVDAARRGRTEERGLCWVRVSADSGGVDGGLHWLPSLYSIAPSPV

SEQ ID NO: 190426 - protein, 97 aa, Triticum aestivum
  unsure (1)..(97): unsure at all Xaa locations
  Clone ID: PAT_TA_84844.pep
MHACFSXXGACTHQLILNRRHXGXGREEGFQGINPLXDIGKPLFAYMCSSSXPFSVLLFFSLSCVSDDLFLFFISSAKVRRVLISPGFYEIRRCKDI

SEQ ID NO: 190427 - protein, 141 aa, Triticum aestivum
  unsure (1)..(141): unsure at all Xaa locations
  Clone ID: PAT_TA_84845.pep
LTRLFIGQAADEKGGLKTDAFFETSVAGVYAIGDVATFPLKLYNEQRRVEHVDHARKSAEQAVRAIKGQGVRRXVAEYDYLXYFYSRSFHLAWQXLTXTTSGQLXFXEQHPAXATQXRNYGXKDXXPPRGGATNFPKPLTR

SEQ ID NO: 190428 - protein, 103 aa, Triticum aestivum
  unsure (1)..(103): unsure at all Xaa locations
  Clone ID: PAT_TA_84846.pep
ISSKAMSIMNSFINDIFEKLAGEAAKLARYNKKPTITSREIQXTSVRLVLPGELAKHAVSEGTKAVTXSTPPDPRYLFGCVCGRIRVNPIMFPGPRIYRAAPM

SEQ ID NO: 190429 - protein, 165 aa, Triticum aestivum
  unsure (1)..(165): unsure at all Xaa locations
  Clone ID: PAT_TA_84847.pep
VGVTMAAAGGTVFTFGGRDLEHKELNELYAFDAATRAWTLLSSGXXGPPHRSYHSMAADAXAGRVYVFGGCGDARPPQTTCGAYILPAGQWEAAAPPRGRXPTAPAAPGCLPRRKXWLXXGFPGEXLXNXTXTTGNPELAPSKNGEKPTPGLAPRFGRVFGKWAQ

SEQ ID NO: 190430 - protein, 122 aa, Triticum aestivum
  unsure (1)..(122): unsure at all Xaa locations
  Clone ID: PAT_TA_84848.pep
ELSLRAQEERAAAEKLNNKAAEEIFRLRNSNNDIWKIDMHGLHASEAVAVLERHLHMIXSSNLGIFKPLKDYQFGASTTGNIFPPERGLNPAKSLVGTIKGGNSVGPHFEIFRAFQNPTWDF

SEQ ID NO: 190431 - protein, 101 aa, Triticum aestivum
  Clone ID: PAT_TA_84849.pep
FIRGETWFLKVRRELMLGMRPYHGMMERLEIEEIAEQVIARQHPLLKFPLLQNQAMKGLQRATLLLLLLVVVLPLRVPALATPPPLVLRHPVQIRTCYCTS

SEQ ID NO: 190432 - protein, 106 aa, Triticum aestivum
  unsure (1)..(106): unsure at all Xaa locations
  Clone ID: PAT_TA_84850.pep
MQPDQPVISLRPGGAXGPRAPAPLSPAFRNSVSGRLLRPHGGGAPXSPRXGDHIFEHVSVFDTQELTSPSALNVVRGIRIKQLCHNKGSNDRRQVHKTYLNDTLWG

SEQ ID NO: 190433 - protein, 61 aa, Triticum aestivum
  unsure (1)..(61): unsure at all Xaa locations
  Clone ID: PAT_TA_84851.pep
SITSLXXQLWCWGLDCSSXIARTRHGIRLXTLERWNLVGKPGCGKRRRKLNRRDDTVFLGC

SEQ ID NO: 190434 - protein, 103 aa, Triticum aestivum
  unsure (1)..(103): unsure at all Xaa locations
  Clone ID: PAT_TA_84852.pep
CSAVSKPKIKHGLTRKHHRAWTLSEVVKLVDGVARYGAGKWXSEIRKLSFASYSYRTSXVDLKDKWRNLIKSNPRHSSRRKKMVLSTERLTFYHTNTHHFVAK

SEQ ID NO: 190435 - protein, 76 aa, Triticum aestivum
  Clone ID: PAT_TA_84853.pep
LLIRKLPFQRLVREIAQDFKTDLRFQSHAVLALQEAAEAYLVGLFEDTNLCAIHAKRVTIMPKDIQLARRIRGEEG

SEQ ID NO: 190436 - protein, 135 aa, Triticum aestivum
  unsure (1)..(135): unsure at all Xaa locations
  Clone ID: PAT_TA_84854.pep
MISPDTIRTAIGVIGNGTALVLFLSPXVPTFIRIWEERAVEQYSADXPYVATLLNCMMWVLLRVPAVQPHSMLVITSNGTGMAIQLTNVALFLLYXWGLRRARWSCCWAAEVGSRRAWCQPGTHDAMVVGSLRLF

SEQ ID NO: 190437 - protein, 128 aa, Triticum aestivum
  unsure (1)..(128): unsure at all Xaa locations
  Clone ID: PAT_TA_84855.pep
RDPASWPDRPDEFRPERFAGSAVDVRGQHFELLPFGAGRRICPAYGLAMKVIGAGLANLLQXSXALPXXGLRPXDLSMEEHVXLSTRXKVPLLAVPGPKAAGASLHRHDLKNLHAKSISPTICAIQLN

SEQ ID NO: 190438 - protein, 125 aa, Triticum aestivum
  unsure (1)..(125): unsure at all Xaa locations
  Clone ID: PAT_TA_84856.pep
XXTSGSEEKXFNHXTPFLLKXLFVIPGXNGLFSINFGLFSXXGMXSKVGSFLYKKTGLRSVIPDPKQMDEPRFASSKCTLHLRSRVDLSDFPTKFELLLALFRELSYLYRYILLSEMEKDNGGIP

SEQ ID NO: 190439 - protein, 53 aa, Triticum aestivum
  Clone ID: PAT_TA_84857.pep
EWRIGGIIHLHQSINLIICYMNKLLRACGRTCGGAVQLTCMHVLYLYMMNKKR

SEQ ID NO: 190440 - protein, 70 aa, Triticum aestivum
  unsure (1)..(70): unsure at all Xaa locations
  Clone ID: PAT_TA_84858.pep
XGDIRVSQNXISLNCLFXSLXCLLALPIYHSSCTNSHTTGLRVVLFYLFLTISQSLSFRRKPLLFRSDME

SEQ ID NO: 190441 - protein, 152 aa, Triticum aestivum
  unsure (1)..(152): unsure at all Xaa locations
  Clone ID: PAT_TA_84859.pep
VDPMLSFVTKVTAVKVALSSGSQGQKLDSVLAKPLKTQAFASPDKVAELVQEXVAAAIQQDLPKVMTKMRLYLQNHLLRMILFKPIKDKYXVEANIQLHPFLKPXYXSERNASIRMLXIPDLHPQLXHLLFGIHIQRAAVSMLTCAFFQITK

SEQ ID NO: 190442 - protein, 88 aa, Triticum aestivum
  unsure (1)..(88): unsure at all Xaa locations
  Clone ID: PAT_TA_84860.pep
QTNYSGSSNSCTAHLPRQALKFTPTPLCSPHELHEFPRFEXGGLEYSPCXMKTFGRGRSGGNFSSPYQYFREXLXNXSFKAHVXPGLS

SEQ ID NO: 190443 - protein, 73 aa, Triticum aestivum
  unsure (1)..(73): unsure at all Xaa locations
  Clone ID: PAT_TA_84861.pep
DDDLCRPKSIXVGNSXIVLSLLATVHMCRFPFCHLGSKHRKIDPLQNTSSHFKISRSSWPKQKPKYRRRNTRL

SEQ ID NO: 190444 - protein, 78 aa, Triticum aestivum
  unsure (1)..(78): unsure at all Xaa locations
  Clone ID: PAT_TA_84862.pep
GGTTRHTVTSCYQCVQYLSHLTVPKAPSRVILGLVVKVTSFXLPQLNQXFRLRQSDISMLLDTRTIPNGHCVGNKNSG

SEQ ID NO: 190445 - protein, 65 aa, Triticum aestivum
  unsure (1)..(65): unsure at all Xaa locations
  Clone ID: PAT_TA_84863.pep
SLTAHPGTMTYLXDTKPDDLPLHWLAHYTIREKEGITAGPAGSPFRSSPGDDRGRWVRPSAGEAR

SEQ ID NO: 190446 - protein, 53 aa, Triticum aestivum
  Clone ID: PAT_TA_84864.pep
IHITNCVRRLHHSHVGLRVVAAGGLCCLLSLHPLCNRMHMLASTKLHGLGLRT

SEQ ID NO: 190447 - protein, 125 aa, Triticum aestivum
  unsure (1)..(125): unsure at all Xaa locations
  Clone ID: PAT_TA_84865.pep
KTCMLICYTSNKFPTDYIPTVFDNFSANVVVDGTTVNLGLWDTAGQEDYNRLRPLSYRGADVFVLAFSLVSRASYEXNVMKKWLPELQHYAPGVPIVLXGTKLGRRLGVQGVQHQAPFQTFRING

SEQ ID NO: 190448 - protein, 121 aa, Triticum aestivum
  unsure (1)..(121): unsure at all Xaa locations
  Clone ID: PAT_TA_84866.pep
AACRLPPRPSRSSIAVEMHLDSDHPAGVRPTIRAPGPAPPHRPGHAQLLEPPQRXPXDRRRFPGRTSVTPPPRRTSVTGLAFTRSGYLXGWLSVDMRISHLNASVYICFTQCPVSIESQGY

SEQ ID NO: 190449 - protein, 66 aa, Triticum aestivum
  Clone ID: PAT_TA_84867.pep
MAQGTLEVLLVGARGLENTDYLSNMDPYALLQCRSHEQKSSVASGIHLLSLFNCCGCCLLLHIKIL

SEQ ID NO: 190450 - protein, 128 aa, Triticum aestivum
  unsure (1)..(128): unsure at all Xaa locations
  Clone ID: PAT_TA_84868.pep
PDIYQSPLLFPNIRNDDVPDSVKNLNEKVSPKFKVDDVQDSVKSLNEKLSAALLTINDKDDLXVKQHTRVXEEAVAXWEQAEAEVAPPGSNYXETASKKNTLXEDXVNHLDXPLKECVXGFQAFGEQR

SEQ ID NO: 190451 - protein, 170 aa, Triticum aestivum
  unsure (1)..(170): unsure at all Xaa locations
  Clone ID: PAT_TA_84869.pep
HAFGGVPRESWNSGILSCLGRNDEFCSSDVEVCLLGTVAPCVLYGSNVERLAAGQGTFANSCLPYTGLYLLGNSLFGWXNCLAPWVSHXLRTAIPTTLXLEGSXEVSTSNVGCCGDLVRRTKEKRXXPKKPPGDXSTNYFCQPCALWQEXPNCPQVPNLDQQRGLLSRSP

SEQ ID NO: 190452 - protein, 130 aa, Triticum aestivum
  unsure (1)..(130): unsure at all Xaa locations
  Clone ID: PAT_TA_84870.pep
MAGTTPRRLLLVIVPLVAVVPASAKDYMVGDSSGWKSGVDYAAWAKGKPFAIGDXVSFQLQSAHXVLXVSEADTARVRRTNRCGLXXGQEQQHPGQPKGGNRYFIWGAPGALKHVSARNITPKHGSSVLR

SEQ ID NO: 190453 - protein, 96 aa, Triticum aestivum
  Clone ID: PAT_TA_84871.pep
GFAELVARGDRGFIIRGWAPQMLILTHPAVGGFVTHCGWNSTLEAVSAGVPMVTWPRYADHSTTKKWVVELLKAVSPLGFTDYASMLGDPGARYWC

SEQ ID NO: 190454 - protein, 61 aa, Triticum aestivum
  unsure (1)..(61): unsure at all Xaa locations
  Clone ID: PAT_TA_84872.pep
FEEXPDYXXDNEXIXAHXRCXWSVRDALRKAFVWHNXTLNVWXHLXXFFLFXYLXXAXTGT

SEQ ID NO: 190455 - protein, 82 aa, Triticum aestivum
  unsure (1)..(82): unsure at all Xaa locations
  Clone ID: PAT_TA_84873.pep
MSSSEVACTLAALILHDDGIPITSEKIATVVKAAGIKFEATGPRLRQVLEKRSVXXTHLSVGSGGVGAPSCCCCCPAVGCAE

SEQ ID NO: 190456 - protein, 79 aa, Triticum aestivum
  unsure (1)..(79): unsure at all Xaa locations
  Clone ID: PAT_TA_84874.pep
MSCCGGNCGCGTACKCGNGCGGCNMYPXAEAAGATLLVSATATHKXASSGGWMXXRENXGCGCXQCKCXTSCXCSCCSC

SEQ ID NO: 190457 - protein, 139 aa, Triticum aestivum
  unsure (1)..(139): unsure at all Xaa locations
  Clone ID: PAT_TA_84875.pep
EPRYPLFGGWHCTFTIGYGLPLQDFVFESVDGRRYINLTFGCPLLDTVVDDLTVKVXLPEGSKXPRACIPFVTEKXLETXYXYLTLLGXTTVVLKKXNVVRETXSFQVYXESDLPGGTFDGLHVCCFPASMATSFSETP

SEQ ID NO: 190458 - protein, 55 aa, Triticum aestivum
  Clone ID: PAT_TA_84876.pep
HFKIGDIGTAATAHVSVGTRKAPSQTVVTHQEELSCATGVQRNTCLYSRGKIWYK

SEQ ID NO: 190459 - protein, 140 aa, Triticum aestivum
  unsure (1)..(140): unsure at all Xaa locations
  Clone ID: PAT_TA_84877.pep
MSSPPPAVASPASEQAKSKKKKHKSKNDTVAADPPSLAEAEEKTDGTSSSASLVPSLXDTSTWAVLLKELRPLNVRTGTNPATSRXSPLXAPLRRXSPVTXSSTXTSVXPSSQXVXXWIXAISARNRQKTSTQGKIHRRT

SEQ ID NO: 190460 - protein, 136 aa, Triticum aestivum
  unsure (1)..(136): unsure at all Xaa locations
  Clone ID: PAT_TA_84878.pep
GGGGGGGGTSGRCPVDALKLGVCANLLNGLINATLGTPPRTPCCTLIQGLADLEAAVCLCTVLRANVLGINLNLPINLXLLVNYCGRRVPSGFQMLPDIYGVVYIFPCMQCISSSHHMLLLLCVFSHDSCPKYHYY

SEQ ID NO: 190461 - protein, 63 aa, Triticum aestivum
  unsure (1)..(63): unsure at all Xaa locations
  Clone ID: PAT_TA_84879.pep
MARIKPKQLLIQSKTKKAPSRISYSTIITWNLIVILVVLSLYATYXHWHQXSTQDFEMELHES

SEQ ID NO: 190462 - protein, 66 aa, Triticum aestivum
  unsure (1)..(66): unsure at all Xaa locations
  Clone ID: PAT_TA_84880.pep
ASRSSNFALYLDKKQQFSLQGRTALWDAILLLCXQINVGYGGVVRGIHIGSSALNLLSVIDSDSES

SEQ ID NO: 190463 - protein, 90 aa, Triticum aestivum
  Clone ID: PAT_TA_84881.pep
RSTHGRHRGTLTRAQHTERRRRATGDWRLVPPLGPHSPARRRPAASDGKLFFRLRVQKSWFVQGRGIEVMLLCERRRRCWHSCYLSSARK

SEQ ID NO: 190464 - protein, 124 aa, Triticum aestivum
  Clone ID: PAT_TA_84882.pep
LIDHLGAASRPDAALLVFRAVPAFCSHSNATFHALLHSLVCNGRVDAARDMLPEAPKLGVRTNAVSYNIILKGVCHRDGFSGARVVLDEMLARGVRPTVVTFNTLVGSACPGKGSWRRNGSWTR

SEQ ID NO: 190465 - protein, 104 aa, Triticum aestivum
  unsure (1)..(104): unsure at all Xaa locations
  Clone ID: PAT_TA_84883.pep
MVPPRLTSSASNRMHGGAVASLVDLVGSAVIFAGGSPVTGVSLDITVSYLGAARANEEIEVEARVLGIGDKTGCVTVEVXKXGXXQVLAHGRHTKYLANVSSKL

SEQ ID NO: 190466 - protein, 147 aa, Triticum aestivum
  unsure (1)..(147): unsure at all Xaa locations
  Clone ID: PAT_TA_84884.pep
XXVDETXPHVRSFAGTLLRYSXXPPLFGDKCVCLVCRTTEATRGRQGGRWRQIFWLQADVGSRGGGAGPTGRSGCQPSARRCGAVCERRAEPPWLWLWPLSSGSWDPRSAHRIGEEPPRRTAGGRGRGEPGRLGGWDGATREVATGR

SEQ ID NO: 190467 - protein, 70 aa, Triticum aestivum
  Clone ID: PAT_TA_84885.pep
YFMEASPGLARCIITIMLYEKRVLSGANEFVLLLARASHDISSRVPYHYLNCMCILDADKANDLSPCWSQ

SEQ ID NO: 190468 - protein, 61 aa, Triticum aestivum
  Clone ID: PAT_TA_84886.pep
ELRFYNSEIHRAAFVLPTFVRRELEAYTTPISSAENEKPKESVSEPQKIKILSNNAILTAS

SEQ ID NO: 190469 - protein, 75 aa, Triticum aestivum
  unsure (1)..(75): unsure at all Xaa locations
  Clone ID: PAT_TA_84887.pep
QIEGKTIKAQIWDTAGQERYRAITSAYYRGAVGALLVYDITKKQTFENIQRWLRELRGXHPDSNIVIMMVGNNPT

SEQ ID NO: 190470 - protein, 82 aa, Triticum aestivum
  Clone ID: PAT_TA_84888.pep
LDSIRNILKDIEDEADSVNVNGTHPSDGTLSSESKFAMDQDLKNAILKILDFVKLLDQEISKFKASHLIMMDYVEKTQQSLH

SEQ ID NO: 190471 - protein, 74 aa, Triticum aestivum
  Clone ID: PAT_TA_84889.pep
IALSLLYMYGFPSKKKHYVYVSTLFICTLQTSSTSLYYPPLLVFVAKDGLLNFCSPTHPMPGVARDNKEGCAIK

SEQ ID NO: 190472 - protein, 62 aa, Triticum aestivum
  Clone ID: PAT_TA_84890.pep
RVRRLQESQSVPCDPGYWSLVLYTLPPPTISILEPHSDARRAVRFRSHVTHFALTYPPPLLL

SEQ ID NO: 190473 - protein, 97 aa, Triticum aestivum
  unsure (1)..(97): unsure at all Xaa locations
  Clone ID: PAT_TA_84891.pep
MAASDALQSIVYSRGSLRLLDQRKLPLEMEYIDVKSSADGWXNAIRDMVVRGAPXAIAIAAALALPLKFXDLXFIGXPEEXSLVSKELGXLXSSRQM

SEQ ID NO: 190474 - protein, 104 aa, Triticum aestivum
  Clone ID: PAT_TA_84892.pep
CGAGQMHRRNDWGFSVGFLVRPPYLGFLDACFPFFRRLGLLGQDGDSKGGGGLVVVVRVVQIHESKSERKKKTIGASRNGQQKGDFFIKENSGKESLEIKDANF

SEQ ID NO: 190475 - protein, 84 aa, Triticum aestivum
  Clone ID: PAT_TA_84893.pep
LLTHHPGEHPMRMMNPSMMVSRLDLWFLELAATGIVFRRLPYGFFWNTGVFIEQRGGARGGRGGHNPPGPPVGLCSPRIPPGTS

SEQ ID NO: 190476 - protein, 116 aa, Triticum aestivum
  unsure (1)..(116): unsure at all Xaa locations
  Clone ID: PAT_TA_84894.pep
GHWEXXPSWGESXKEVXXHGANXPPAXXYKFALLVALGLNIXAALKSXVINPARKRHCWSNHFLPFXDPTIIASSLTAIVGGGGGVLLLVVLVVVVVLVAVAAVAAVALGTAPEAW

SEQ ID NO: 190477 - protein, 158 aa, Triticum aestivum
  unsure (1)..(158): unsure at all Xaa locations
  Clone ID: PAT_TA_84895.pep
SGSDRAAAFHHSSSAEVVTGSTAWFGXGLSCVCAQRRDSDARLSFDLTPVQEECLQRLQNRIEVQXYDSANREHQEALQSLWCAXFPGTDFRGLISKQWKEMGXGXGKDPXTXLKGXGSXPLGXNCXSLXIXKXFKDPXXQNGDXSXXXFQXXSLGLX

SEQ ID NO: 190478 - protein, 58 aa, Triticum aestivum
  Clone ID: PAT_TA_84896.pep
VVCSVRLDSAHPTQARVSIGVVICFALHFITLCNVPMMCVVLGLFHSVLVFISLLFSG

SEQ ID NO: 190479 - protein, 66 aa, Triticum aestivum
  unsure (1)..(66): unsure at all Xaa locations
  Clone ID: PAT_TA_84897.pep
SHPIFSDPDATNKPLLKMLVNVLGSCHFQDAGGKHSFRWVPFISRVLSNRSTCIIXLYTRFPTGSS

SEQ ID NO: 190480 - protein, 80 aa, Triticum aestivum
  unsure (1)..(80): unsure at all Xaa locations
  Clone ID: PAT_TA_84898.pep
NSATHIALLISFSPFNLCQILISSKEYSACLDFGRQELHRKWRKSSEFHAKFXASIPNKALRKTGQLGKYNTCKTYCIDA

SEQ ID NO: 190481 - protein, 160 aa, Triticum aestivum
  unsure (1)..(160): unsure at all Xaa locations
  Clone ID: PAT_TA_84899.pep
MDPNKSSTPPPPPVMGAPVAYPPPAYPPGVAAGAGAYPPQLYAPPAAAAAQQAAAAQQQQLQIFWAEQYREIRXTTDFKNHNXPLARIKKIMKXDEDXRMIRRRGPVVFRRAARCSPPVNHRGWAHPXXNKGGSPIRIRFHRRTIHSWGFARHGPYRRPT

SEQ ID NO: 190482 - protein, 71 aa, Triticum aestivum
  Clone ID: PAT_TA_84900.pep
CSQHHHQSHTCVVAAAFPQSKQLQFNRCHSNNIPLRQVIVHNLYLTTESHSPDQEIKTPEFTLMTPDVVDP

SEQ ID NO: 190483 - protein, 90 aa, Triticum aestivum
  Clone ID: PAT_TA_84901.pep
VPAPPRIFRADKPCNADENRDSYFAEHCINTQQSFTKLVDAVIDRKDELKKSSLQMEDDFNHFEGHTDVSEFLSDDVQSGSDDNNVQSHP

SEQ ID NO: 190484 - protein, 179 aa, Triticum aestivum
  unsure (1)..(179): unsure at all Xaa locations
  Clone ID: PAT_TA_84902.pep
PQLLLCFLLAASAPLIVATAKKSGDVSELQIGVKYKPESCSIQAHKGDKVKVHYRGKLTDGTVFDSSYERGDPIEFELGXTGQVIKGWDXGXLWGMCVGEKRKLKIPSKLGYGXQXSPPTIPGGSNLIFYTDLSLSMGEPTNNLTALDHQTNEPSLFTDQQMLSKEMTSSRNKFAVRTS

SEQ ID NO: 190485 - protein, 106 aa, Triticum aestivum
  Clone ID: PAT_TA_84903.pep
MAEEKKHHHLFHRHKDGGEEEASAGGEVDYDKKEKHHKHLGQLGGLGAIAAGAYAIHEKHKAKKDPENAHGHKVKEEVAAVAALGAAGFAFHEQHQKKDAKKQGQS

SEQ ID NO: 190486 - protein, 123 aa, Triticum aestivum
  Clone ID: PAT_TA_84904.pep
FAVRPASGGKSSGAGTGSRAAAGGRWKPSGKEKPVVLPRPCGGGSLLVGVKRAMTFVPRRRKKTAALPSAALKTGWVMHEYRLAAPLHKNGCSLAAQGEWSSAASSKRAAKARGRKARTAAAR

SEQ ID NO: 190487 - protein, 165 aa, Triticum aestivum
  unsure (1)..(165): unsure at all Xaa locations
  Clone ID: PAT_TA_84905.pep
MAPPMKVYGWAVSPWMARALVCLEEAGADYEIVPMSRCGGDHRRPEHLAKNPFGEIPVLEDGDLTLYQSRAIARYVLRKLKPELLREGDLEGSAMVDAWMEVEAQHMEPALWPIIRHSIIGQYVRRDRDTSRHRRELDRLXXVXPAYEXRLPSAITGPGLIRPTL

SEQ ID NO: 190488 - protein, 117 aa, Triticum aestivum
  unsure (1)..(117): unsure at all Xaa locations
  Clone ID: PAT_TA_84906.pep
TYLASAILSTVCQPKVTXAANEYTKMHLLNGTXCGEYLQKFADKAGGYVLNXDATSDCNFCSISDTNTFLKALTATYDDRWRNFGIGMVYIVFNIGAALFLYWLVRMPKNKNKKKQE

SEQ ID NO: 190489 - protein, 128 aa, Triticum aestivum
  unsure (1)..(128): unsure at all Xaa locations
  Clone ID: PAT_TA_84907.pep
FARGEDEECCINSSMDETAGTVLVMSFVSLVVIMSVLASFLFARNCRLLRHGVDNHPPYVKKQVVEKFPCSAYSAPCSSEDNFQEACAICLEDYNNGDMLRXSPCKHEFHKIXIDXWLTKWGTXAXAS

SEQ ID NO: 190490 - protein, 176 aa, Triticum aestivum
  unsure (1)..(176): unsure at all Xaa locations
  Clone ID: PAT_TA_84908.pep
MRSGRGKMATPPPPIRPAAALLLLVLAGVLASAASADLVISKADRRVDLTSHIVRVLASLKAENVGPDPVSQVLLPFPNIQAKNLAAIRAFGSEGKVKGQSTVLPIEVVQPSGAPPELTFFSALLPKPLXEKGKTLYLDVLTVXXHSLQPXPEEITQAEAHLLSIKICSHLSTYLL

SEQ ID NO: 190491 - protein, 76 aa, Triticum aestivum
  Clone ID: PAT_TA_84909.pep
PTLNFATLFACVACGFISSQKDIALGVVWLKRKQPPNFDQTSPTNLNVWLSVLTRGYEPTKQARRDKGQAKLAGDG

SEQ ID NO: 190492 - protein, 76 aa, Triticum aestivum
  Clone ID: PAT_TA_84910.pep
MAAKAISSPVPVEWYPTLAVVMVSVGLMFTASFFIYEATSSRRSRSLSKEIATAVVASVFLGFGSLFVLLASGVYV

SEQ ID NO: 190493 - protein, 62 aa, Triticum aestivum
  unsure (1)..(62): unsure at all Xaa locations
  Clone ID: PAT_TA_84911.pep
KGESAQDYGXFTQTSENXKTKQAMHTVLFFQGLDKLTKNMLQTPEEDQHQRGNIEWSQAQLN

SEQ ID NO: 190494 - protein, 60 aa, Triticum aestivum
  Clone ID: PAT_TA_84912.pep
GASMNPAVSFGPAVVTGVWENHWVYWVGPLAGAAIAALVYDIIFIGQRPHQQLPTTAADY

SEQ ID NO: 190495 - protein, 132 aa, Triticum aestivum
  unsure (1)..(132): unsure at all Xaa locations
  Clone ID: PAT_TA_84913.pep
SGLVHDECVTKMRLMSLLDLSSRCSGEIPYSAITVELRINDDEVEQWIVKAIASKILDCKVDQLNQTVIVSRHTERIFGXMEHWHALRTKLGAWRGNIAXAINTIQANKXPKEGAQGMQAWRFTDSKADRVP

SEQ ID NO: 190496 - protein, 53 aa, Triticum aestivum
  unsure (1)..(53): unsure at all Xaa locations
  Clone ID: PAT_TA_84914.pep
YLLLITXIEQQTQRLYPQYTSVPYQATMLLVSEVTFLVRHVLFGSTYITITRD

SEQ ID NO: 190497 - protein, 155 aa, Triticum aestivum
  Clone ID: PAT_TA_84915.pep
FFFFFFLCSPQVTSQLNTTLCIYLHWILGVNVFKHVIRELVKPQLRKRIKVKERIRARSRVMTRLIHPFTKIVSEIRIRKCRYLRGLLRKIRGFLLNRHSTKSPFQNIYATLYARAAGRDGVQSSHKHLESLGSNRPAAFKSCTTTWLRLVNKHK

SEQ ID NO: 190498 - protein, 174 aa, Triticum aestivum
  unsure (1)..(174): unsure at all Xaa locations
  Clone ID: PAT_TA_84916.pep
PYKQKIRTLGLLSSEADFCTVNILFLPRRTTDLTPWPPPYSSSVALQFPSSRPIRVITAVTGNICHISAVIGTDGSEHFLRNVAWLLCDYIFCSSIAXDQFCKDTNVQEKGRYAXCNSTVLRMIIIVPEFLLAVLINSGTSFALDCGEIQAALXANGVLSNRXFGDMKNLQAHI

SEQ ID NO: 190499 - protein, 54 aa, Triticum aestivum
  Clone ID: PAT_TA_84917.pep
VIVQKTRKVPAHEEPIMKGSFKATEPGKLVLGVNNPASRKKKLLCRFKVRSAAA

SEQ ID NO: 190500 - protein, 73 aa, Triticum aestivum
  Clone ID: PAT_TA_84918.pep
RLKTVFQDRLFTTRLAEDALYIYRRLVLLVAEVSSCECCRVPAAATPQRATCAFLSVAAAETFDGFLTCKLGG

SEQ ID NO: 190501 - protein, 111 aa, Triticum aestivum
  unsure (1)..(111): unsure at all Xaa locations
  Clone ID: PAT_TA_84919.pep
MAASSSAGPSAVDAASLAAVAEAAPPEEMTLVVKWRGQEQTVRMVGDDTLGELKLRICEVTGVLXXRQTLLYTKLILMXMXDXXLLSXIXXKPNXKXXMIXXXXEEYLSAK

SEQ ID NO: 190502 - protein, 68 aa, Triticum aestivum
  Clone ID: PAT_TA_84920.pep
NRESALRSRARKRAYVQELEKEVRRLVNENLKLKRQCKQLKLDMAALVQQSSSKSSSHIRRTSSSTQL

SEQ ID NO: 190503 - protein, 82 aa, Triticum aestivum
  unsure (1)..(82): unsure at all Xaa locations
  Clone ID: PAT_TA_84921.pep
TXCXTXTNXVENXRERFRXXSTAEXKXIRTXLXKNXFESXXAXXAARRXYSAXVXAWGRXGGWSGGSSMVEVWRRWRAGQRS

SEQ ID NO: 190504 - protein, 46 aa, Triticum aestivum
  Clone ID: PAT_TA_84922.pep
SCLSLSYLIFLVVLSNVRGTKFLVENFFESSYFSAHMKEINMRFSK

SEQ ID NO: 190505 - protein, 136 aa, Triticum aestivum
  Clone ID: PAT_TA_84923.pep
NVGAVREVKEETGIDAEFVEVLAFRQSHKSFFDKSDLFFVCLLRPLSYDITKQDSEIEACQWMPVEEFAAQPFVQKHELVKYILEVGLAKVDKEYAGFSPISIKSAFTDKLSLFYMNRRDLDKASRSIYVMTAIDN

SEQ ID NO: 190506 - protein, 104 aa, Triticum aestivum
  unsure (1)..(104): unsure at all Xaa locations
  Clone ID: PAT_TA_84924.pep
FDCIIGTDVTYNPDAILPLFKTARGVISEKANEDSVPALILCYIQRRVDEDSILSNATSQGFRLVDKWINGVHESNGTISSWFSGNDVCSAFRHTVLXVLYFEL

SEQ ID NO: 190507 - protein, 59 aa, Triticum aestivum
  Clone ID: PAT_TA_84925.pep
SEEVYGKYPMSLVWLPFRLTCSHSAPHFLSHVRHVNANTKVSLHGQKCYQSVDCALKKK

SEQ ID NO: 190508 - protein, 98 aa, Triticum aestivum
  unsure (1)..(98): unsure at all Xaa locations
  Clone ID: PAT_TA_84926.pep
GGXINKVLPWMWHKGYDSPLFPYQRSVKERGSLCHHRTLTPLCNDTNILYALAGKILCIQRSHNIMKKIVTTISHKSIILLHSNHVTSRVPYPRELGR

SEQ ID NO: 190509 - protein, 143 aa, Triticum aestivum
  unsure (1)..(143): unsure at all Xaa locations
  Clone ID: PAT_TA_84927.pep
MESLEALVAHIQGLSGSPEELAHLHSLLKQADGEPLRAHAAALVPFLAHLSPETHSLGYLYLLEACATSSSNLSDFGGGDFLVTIGGFLTACSADQIRLAPDKFLNVCXVLKDQVMQLNMPXXGXSPLXAAVPKIXSXPXQLT

SEQ ID NO: 190510 - protein, 158 aa, Triticum aestivum
  unsure (1)..(158): unsure at all Xaa locations
  Clone ID: PAT_TA_84928.pep
FXSXKVDKHXXGGDXSXXFMFSSRQAEMKQNLXQFPLXAXXXPPSWTTGFGAARGXRGGARWPSPGPLVLCDDAPVLQIQLQVHHLHGLCSSVSQPPQPQTSFLSPXASVFFSCRSRLTTTRDGCSLPLPLLLQNQEPEHMLLWTADGVGGLLLARFF

SEQ ID NO: 190511 - protein, 52 aa, Triticum aestivum
  Clone ID: PAT_TA_84929.pep
MDPQQPEPVSYLCGDCGAENTLKPGDVIQCRECGYRILYKKRTRRIVQYEAR

SEQ ID NO: 190512 - protein, 166 aa, Triticum aestivum
  unsure (1)..(166): unsure at all Xaa locations
  Clone ID: PAT_TA_84930.pep
XAXXREGXLSXCRYCRMXXXXVGXKPLRAHVVXYAAGSXPXTQXXCRCSCTAGEHGFDPXWWPARAPQWCXRXXPXXHQFPGLRXNPLLRWWIGSRHRRRLPQMRPPAVATPHLASPLCRCTPRWTCVTSPSRAVEAASSAAAALGQTSAAGLRPPGRLPLPLRPA

SEQ ID NO: 190513 - protein, 134 aa, Triticum aestivum
  unsure (1)..(134): unsure at all Xaa locations
  Clone ID: PAT_TA_84931.pep
NDQQQAAKATVQVSKRPTAFGALFGKAAAGRRPDLFLGFSNVQGKTKVDKITSSVVLPFHHFSGGAKLSSAALPAKESLHSEPDSIQHSDPACQLEXSDTVGHGNKTSNNHQKMATRMMDTVRLKTRRFKVPFK

SEQ ID NO: 190514 - protein, 61 aa, Triticum aestivum
  Clone ID: PAT_TA_84932.pep
LSFGNQRCLQQIWFPAWSLSSNSQGGKQPTLASRVQIIRENDFSQWQTSKMVQWFANMFQG

SEQ ID NO: 190515 - protein, 133 aa, Triticum aestivum
  unsure (1)..(133): unsure at all Xaa locations
  Clone ID: PAT_TA_84933.pep
MGSQAIEAHRAGAEVYRGAALCAEKSTELLAEAHLPLGLLPLADMEEVGYNRATGFVWLRQRKSLTHTFRPIARQVSYAAEVTAFVEDRRMRRMTGXKTKEXLIWVTFSXCSSTXTPSKXXFKTPXGSARLPS

SEQ ID NO: 190516 - protein, 58 aa, Triticum aestivum
  Clone ID: PAT_TA_84934.pep
GLSRSSSAIQVTSIRSWMMISTRNSVKKKTTIEEIRVSSKHQDLFFKLYHWLWSGDQL

SEQ ID NO: 190517 - protein, 99 aa, Triticum aestivum
  Clone ID: PAT_TA_84935.pep
SPRPPIHGRLRPPPHLLPNSSRPPPCNPLVHLLTVEVGCATTARLAELTALLSSLDRGHHICSVPRPCIPRSLNRYPPEHRTVGTVIFPSNCMFFLISN

SEQ ID NO: 190518 - protein, 58 aa, Triticum aestivum
  Clone ID: PAT_TA_84936.pep
ALLTSGFSLDDPNTFGSRIHRMLKLGLSIDEDEEAPEADTDMPPLEDDAGESKMEEVD

SEQ ID NO: 190519 - protein, 89 aa, Triticum aestivum
  Clone ID: PAT_TA_84937.pep
FFFLFKPNHARGLHVIHTALDNEKHFKIQFIHPNRRSRKDTSARTIQSPKNGAALLAQLDVQHWAVLTARCRHGSSSKQWQLDGPGARE

SEQ ID NO: 190520 - protein, 88 aa, Triticum aestivum
  unsure (1)..(88): unsure at all Xaa locations
  Clone ID: PAT_TA_84938.pep
RYIIIIHTCDAASVGRNXLXXVXVXTKXERDKLAVAWSTQWRRLPKRSATAGQRTAATTEDETAAAPDVGLGAGASAAIATPARADAA

SEQ ID NO: 190521 - protein, 146 aa, Triticum aestivum
  unsure (1)..(146): unsure at all Xaa locations
  Clone ID: PAT_TA_84939.pep
MASSMAAAATALPLPSGTTQRPSAQGRLLFTAAPARSRCRSLRLRPAGRRSARSSPRATKAVVAALADPLKVMISGAPASGKGTQCELIKTKYQLAHISAGDLLRAEIAAGSENGKRXKEFMEXGQLVPDEXVVNMVKEAFGTKTS

SEQ ID NO: 190522 - protein, 150 aa, Triticum aestivum
  Clone ID: PAT_TA_84940.pep
MSRRFQLPPILSFLITVLISGTASADTPDCPYPCLPPPSAAGAINGYPPPQPSTGGGGGLGGSYPPPPPGSFQLTPPGAMPAGFSPPYSGFPSGPAPPPPNPVLPWFPWVLPSAPTRRVDDSSSTARDARWDNHSRCFSSALARSLVLKG

SEQ ID NO: 190523 - protein, 156 aa, Triticum aestivum
  unsure (1)..(156): unsure at all Xaa locations
  Clone ID: PAT_TA_84941.pep
TTCRVPRQARREEAVSLPSAAAMAGAEVGEDKYRSFIYGEGERDTVWRYSAPPNYDVVNKPXRKEXRTQVWPEGSLEEKVQRLLKSWEMELVHKVRPEDQKTVNSEKYSASTNGMNALTRAXVMGIGGYNNFLRNKLPPXHASTTGQRDSAMALNG

SEQ ID NO: 190524 - protein, 74 aa, Triticum aestivum
  Clone ID: PAT_TA_84942.pep
IRKLPFQRLVREIAQDFKTDLRFQSSAVAALQEAAEAYLVGLFEDTNLCAIHAKRVTIMPKDIQLARRIRGERA

SEQ ID NO: 190525 - protein, 117 aa, Triticum aestivum
  Clone ID: PAT_TA_84943.pep
VAVVPPGEMAMSEDYTCVISRGPNPRTTHIFDDCIVESCGDLLADKPAAGGAAAAACGFFSSCHACNKQLGHGNDILIYRGHKAFCSSECRYQETLLDEAVDGEFALGNGGKGGGRC

SEQ ID NO: 190526 - protein, 143 aa, Triticum aestivum
  unsure (1)..(143): unsure at all Xaa locations
  Clone ID: PAT_TA_84944.pep
MAPSLLAAMSTSPFLASSGSSRRPLGAAHTRRAGLRVAALKYDPAKVAPQNDRVLVRLEQIPEKSAGGVLLPKSAVKFERYLMGEILSIGAEVSEVEAGKKXLFSDINAXXVELGTDEEXCFCRESNLLAVVNEFTRKFLLGM

SEQ ID NO: 190527 - protein, 175 aa, Triticum aestivum
  unsure (1)..(175): unsure at all Xaa locations
  Clone ID: PAT_TA_84945.pep
TPAPAPAAGSGGSPSLSSSSSSAATSPSQPNDISSILNSFLGLGEQPIRVGGSASRAAAGTATPENEPEPFDPVMFFQNYIHSLVEGGANIQVLLDDASVTLGSGPGLGRIGGASFGDYFVGPGLEQLIEQXLAENDPNRYGTPPAGKSVLSSLPDVLVTXCMVAAXXGAECAVC

SEQ ID NO: 190528 - protein, 85 aa, Triticum aestivum
  unsure (1)..(85): unsure at all Xaa locations
  Clone ID: PAT_TA_84946.pep
GLQINKFFSQSTFVLPXPGLPXSFIFMADRWNPSDLRDSRYVWLPLTIGGVPDEAADYSFMFPLWSRVSIYWHKRWRLPEEWRDS

SEQ ID NO: 190529 - protein, 117 aa, Triticum aestivum
  unsure (1)..(117): unsure at all Xaa locations
  Clone ID: PAT_TA_84947.pep
FHRSCADYHPRFGVLAFCXXXSIXYVIHSTTAVTFNVAGNLKVAVAVLVSWSIFRNPISAMNAIGCGITLVGCTFYGYVRHLISQRQAAAPGSLGTAQARNQTEMIPLVVDEKQEKV

SEQ ID NO: 190530 - protein, 143 aa, Triticum aestivum
  Clone ID: PAT_TA_84948.pep
FDEKLANLAEDKNQRLSDANQLRTGRLGEELVEKYLAKQLGSNNVRWVNNRIETGLPYDIVITHPEGFTEYVEVKTTVSSRKDWFDVSAREWQFALEKGDSFSIARVILGTKKASIEMLKNPHKLCKQKALRLALLISRSAAT

SEQ ID NO: 190531 - protein, 164 aa, Triticum aestivum
  Clone ID: PAT_TA_84949.pep
LNTWGLVLYNNLEALMLFPLELLVMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTTKPKAPKVEPKEENDEEQQKCCRCKEFKRVINLTKKNYKEAYG

SEQ ID NO: 190532 - protein, 51 aa, Triticum aestivum
  Clone ID: PAT_TA_84950.pep
EQKVKEYCEKYAKPEDAGITPEDKSSDEELSDDDDDDNDSGDEAILGNPDP

SEQ ID NO: 190533 - protein, 164 aa, Triticum aestivum
  unsure (1)..(164): unsure at all Xaa locations
  Clone ID: PAT_TA_84951.pep
SRSSSPPSYGYSAPAPRGGYTAAPYYSPSPFVSFGPAVGIGFGGSGFLVTLIGFAAFLYLAGFLSDSSGGTSVLTETDKTTVLKLQVGLLGMARSFQXKELDQIAXKADTSTPAGLSYVLTETTLALLRHPDCCISAYSSVXDVKRNVDXGEKRSINFNLGEGQ

SEQ ID NO: 190534 - protein, 144 aa, Triticum aestivum
  unsure (1)..(144): unsure at all Xaa locations
  Clone ID: PAT_TA_84952.pep
MAEEQQHQRWQEGHRLCANNCGFFGSPATLDLCSKCYRDLYQQQPAGAAAGPSAPTASAFQHSSSAVSGAAAVSPDLEPPATAPAGAKAGRCSSCRKRVGLTGFACRCGATFCGVQRYPERXACAFDFRAAGRDASRAQPVSRG

SEQ ID NO: 190535 - protein, 80 aa, Triticum aestivum
  unsure (1)..(80): unsure at all Xaa locations
  Clone ID: PAT_TA_84953.pep
XVVXFVXARXWGXGXCXXGAXXXXGWAGGSGTSWWGCRSXSLAASAVAPSPPPSTRRLVKNWTCFFFFLFTTNHKFYTKK

SEQ ID NO: 190536 - protein, 67 aa, Triticum aestivum
  Clone ID: PAT_TA_84954.pep
QGLTKNTESDSIVLTQKHCSRNDQGLLKKSIACLSMKEKKTNVIVFALTIRRHVSIPADHVFHDTDN

SEQ ID NO: 190537 - protein, 145 aa, Triticum aestivum
  unsure (1)..(145): unsure at all Xaa locations
  Clone ID: PAT_TA_84955.pep
DHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEAPMLEVGLDMGSDGHDMMGFGPLMPNDSERSLMEXVRXELKMELKAX

SEQ ID NO: 190538 - protein, 96 aa, Triticum aestivum
  unsure (1)..(96): unsure at all Xaa locations
  Clone ID: PAT_TA_84956.pep
MGKEKSHINIVVIGHVDSGKSTTTGHLIYKLGGIDKRVIERFEKEAAEMNKRSFKYAWXVLDKLKAERERGIXXDIXLWKFETPSTTHVIDALDIR

SEQ ID NO: 190539 - protein, 174 aa, Triticum aestivum
  unsure (1)..(174): unsure at all Xaa locations
  Clone ID: PAT_TA_84957.pep
SVGVIGGPFWSVPTGRRDGTVSIKQEALDQIPAPTMNFTQLLQSFQNKSLNLADLVWLSGAHTIGISQCNSFSERLYNFTGRGGPDDADPSLDPLYAAKLRLKCKTLTDNTTIVEMDPXGSFGTFDLSTTRRSQPAGLFKSDAALITDAAQRRILNVLTXAQFFKSSRLNKWRK

SEQ ID NO: 190540 - protein, 87 aa, Triticum aestivum
  Clone ID: PAT_TA_84958.pep
PLGTYLKTQSHTNRRRGDACAGINGRSRDKGSTISAFARCVSKTASQCVSRQAKKNRFVLGRAMMQEHAVQKLLADQIYEVLCSLWW

SEQ ID NO: 190541 - protein, 107 aa, Triticum aestivum
  unsure (1)..(107): unsure at all Xaa locations
  Clone ID: PAT_TA_84959.pep
GRQRRLPERMLGRSLLLLHARHVLLSSSSGAQGTGMARLESRPISIMQSGEKQCMELFFFFPSFLNHDDDTSLFPFPSCICFPVLCMEXSLATQEGIMFPXVMRLCS

SEQ ID NO: 190542 - protein, 135 aa, Triticum aestivum
  unsure (1)..(135): unsure at all Xaa locations
  Clone ID: PAT_TA_84960.pep
SLFLVAEIPPSIQLNRELARDISTPRRPPLHNTMTAESPKTQSPTSASASASRHDWDDSEAGPLLARFVGGGQLAPDADTEASTLIGTASPADYGAVTSSGDGTAEEAGVAKPEGKPLPKLKCCCSATRXDGAIA

SEQ ID NO: 190543 - protein, 68 aa, Triticum aestivum
  Clone ID: PAT_TA_84961.pep
TAQLCADRKDFVFWDAYHTSDAANQIIADRLFADMVGSGAVVPGNGTSPPRVVNAPTIPIHAAPPRKP

SEQ ID NO: 190544 - protein, 124 aa, Triticum aestivum
  unsure (1)..(124): unsure at all Xaa locations
  Clone ID: PAT_TA_84962.pep
MSWQAYIDSSLVGSGHIDKGAIISAAGDSAWASSPDLQLKPEEMKAISAIVGGDSAAKDXAFAEGLYIAGERYVMARAXDRSIYARSGRLGVAVAKTGQAIVIGHHGEXQVAGNAXSTVXGLAD

SEQ ID NO: 190545 - protein, 87 aa, Triticum aestivum
  Clone ID: PAT_TA_84963.pep
VALRVREKKWSGESRSSIQFQCLHTCTSPFDCIHLPWGYKGGNSRSHKGPDFLICQVGGYKYESCYAQIIMYIVSRKCVTDSARGGG

SEQ ID NO: 190546 - protein, 80 aa, Triticum aestivum
  unsure (1)..(80): unsure at all Xaa locations
  Clone ID: PAT_TA_84964.pep
GQLXSKRSTYMYHACNKKNTHQSSFFKRTNRRRNLASETGNKHGGEPDNKVVGECLCFTAGVLCRHRLLVPIGHINSAQR

SEQ ID NO: 190547 - protein, 156 aa, Triticum aestivum
  unsure (1)..(156): unsure at all Xaa locations
  Clone ID: PAT_TA_84965.pep
MAAAWGQKALGALPQLVKSLRSDPVSGSARHRRLPSLRRTFSLYDQINLIDSVPEDELRFQSYDDTGFKINNVKYEGSVLIVENKIMTWAPKTFXEITPESLSIFKVVHPIPEIFILGCGRHVQLVSPEXLRMFNRSTGNETRSIDSRNAASTYNX

SEQ ID NO: 190548 - protein, 113 aa, Triticum aestivum
  Clone ID: PAT_TA_84966.pep
MAAKQPSSRWWFWTKVLMGGAAVAVGGPAFTMWLTPTEEELRSRYNPELRKKSLENREERQQEFDDFVTRLKEYSKSDKPIWIVGKEEEERKRKAAAAAAKATQKDADTRRED

SEQ ID NO: 190549 - protein, 78 aa, Triticum aestivum
  Clone ID: PAT_TA_84967.pep
AKLLTGYQDMVGFLHVHKVAQPNSQVPVILEASTLSLKLRKRRSLVLERLNQAPVDGSSGPSSAASSSCSSQGSQLDF

SEQ ID NO: 190550 - protein, 60 aa, Triticum aestivum
  Clone ID: PAT_TA_84968.pep
FFFLGTCFFSYTERVGHADVKSSSVLHGKHAHQNYTHHRMQAIRADHPHHKHSLHIINTR

SEQ ID NO: 190551 - protein, 176 aa, Triticum aestivum
  unsure (1)..(176): unsure at all Xaa locations
  Clone ID: PAT_TA_84969.pep
RAATLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGFXVASNSKDDPAKEAASFTSQVIIMNHPGXQIGNXYPSAGLHTSHIAVKFAELITRXKASXXELXKTNSEKRHLVW

SEQ ID NO: 190552 - protein, 94 aa, Triticum aestivum
  unsure (1)..(94): unsure at all Xaa locations
  Clone ID: PAT_TA_84970.pep
SCREFFFFFFFFFFFFFFFNKARRRLYSDSATNMNNPMLTALTIXLGKKIXPXFFCRRCLLKGTLTNKAKXRGRPXRXNRTXGXLTPIGXXQAT

SEQ ID NO: 190553 - protein, 164 aa, Triticum aestivum
  unsure (1)..(164): unsure at all Xaa locations
  Clone ID: PAT_TA_84971.pep
TLXTXLXXFLYLSLIXQXNXHQXXLRFXTLVDLEKLDHLPPKFDXQSXEAREQITSCDVARWERWRSPLQRVTNLAWGSSSTRVFNDARRTGAAKQRGGXGGXLCVRRRPVAARLPAHGSGHGVAGKVLRRGTTAKPRRGGSLRYAQRGLCVVGQLLLGLKERQ

SEQ ID NO: 190554 - protein, 102 aa, Triticum aestivum
  unsure (1)..(102): unsure at all Xaa locations
  Clone ID: PAT_TA_84972.pep
PPVXKEVDADXACGCPEKGNDQVSEDWHRRRCSCLHQRIRRVAHIRLLAELNEIGGKHGRRLPRLMTGKSITRLTPRGGHQALVSRPGSGRCWRRVSESFFV

SEQ ID NO: 190555 - protein, 71 aa, Triticum aestivum; identical to SEQ ID NO: 189887
  Clone ID: PAT_TA_84973.pep

SEQ ID NO: 190556 - protein, 177 aa, Triticum aestivum
  unsure (1)..(177): unsure at all Xaa locations
  Clone ID: PAT_TA_84974.pep
GNLRSKQSQGSLVLLLKMQIFVKTLTGKTITLEVESSDTIDNVXKAKIQDKEGIPPDQQRLIFAGKQLEDGRTLADYNIQKESTLHLVLXLRGGXMXIFVKTLTGKTXTLEVESSDTIDNVKAKIQDKEGXPPDKQRLIFAGXAVEDGRTLLTXNXXGSTSXWXQGXXGNEXFTXTR

SEQ ID NO: 190557 - protein, 89 aa, Triticum aestivum
  unsure (1)..(89): unsure at all Xaa locations
  Clone ID: PAT_TA_84975.pep
PXFYDQSPDALRXSAARLIFSXLRLDYLSTFILTMVAYFTTRGGNPGWIPDNLNEGHLDYFFLLIAGISFLNLIVYVLCAGKYKSKKAA

SEQ ID NO: 190558 - protein, 132 aa, Triticum aestivum
  unsure (1)..(132): unsure at all Xaa locations
  Clone ID: PAT_TA_84976.pep
MQPACSGAALLAAFIAVLAYSAARCRGQLADNYYAGKCGNFSVEAIIRDAVKARLAWDKRMVAGLLHLQFHDCFVAGCDAXILLDGPDTEKTAVXNSGSSVQLSTTXXGLXKICPXVXPXLXXSPQGPRGAN

SEQ ID NO: 190559 - protein, 51 aa, Triticum aestivum
  unsure (1)..(51): unsure at all Xaa locations
  Clone ID: PAT_TA_84977.pep
RCWIXSLFXXXRRQEDDRRHPSWHQTLRSVPAILASYHHELDSVILITRCX

SEQ ID NO: 190560 - protein, 84 aa, Triticum aestivum
  unsure (1)..(84): unsure at all Xaa locations
  Clone ID: PAT_TA_84978.pep
NVXLYXKSQRISAXLCXKVALDLTKYAAQLYFRHRNESRGGKGAXSCTPNLYFFXDITWLLGERPPPQYYIKKKLNQSPDRERS

SEQ ID NO: 190561 - protein, 80 aa, Triticum aestivum
  Clone ID: PAT_TA_84979.pep
QNFAQRQGMTNWRRESTTLLENKRKYTIATIPDSKVYVQLSLCAAISCSPFQPLTCLRTDVLHYLRKKNKNNGLLVTSAK

SEQ ID NO: 190562 - protein, 84 aa, Triticum aestivum
  unsure (1)..(84): unsure at all Xaa locations
  Clone ID: PAT_TA_84980.pep
GXVIVXICVLHASAIDXLQGAXYNSPGLQGQSREQHIKYSSRKSISIKNTDISKYFPIFSNIYIKILNTFKRNSEQFSKNTNKC

SEQ ID NO: 190563 - protein, 125 aa, Triticum aestivum
  unsure (1)..(125): unsure at all Xaa locations
  Clone ID: PAT_TA_84981.pep
ACLFIXFXVGPRLIFIILLIRXREQDILVKSLGRDSSYFLSSVVSHRLMVAVVCTDAAYLIAVARSALPRAPLAQKCRHPPTHDPPSLVVPSLLGSRCLFAFGSTPAPLPETTPVSISAPVPMPV

SEQ ID NO: 190564 - protein, 140 aa, Triticum aestivum
  unsure (1)..(140): unsure at all Xaa locations
  Clone ID: PAT_TA_84982.pep
ARGPESRAPSAILCLPKQQAAAATAAGPMALSLSGTSARFALASLVPRARAYAASAXSGAMRXAAEGAXRGRGXXGRARRRRXCRGLVGAXTPSRATXXLAXXGXXVYPAXXRGXLXSPGTYAXXLDRXRALLTLXXLVS

SEQ ID NO: 190565 - protein, 102 aa, Triticum aestivum
  Clone ID: PAT_TA_84983.pep
DFGQVQKQCMPFIKLKKVETSNFGPNALELKLPFSEIDVLEQNLELIKRQLGLEHVEVLSTSDEATVAKAGSYVSVLNKTPPSPGEPVAVFMTRQAFEAPQN

SEQ ID NO: 190566 - protein, 164 aa, Triticum aestivum
  unsure (1)..(164): unsure at all Xaa locations
  Clone ID: PAT_TA_84984.pep
XXXGAAVPPTXPRREAEHGVHVGVAEPRQQPPRGERAEEAPAEDARSPANAPPAAAPTTRWLRMRLAAAKLRCREARAALRRGRVDPVVAAALPVALDSXLVGRTTADGPWHGRSVGGCCLGSWRGWAGLACSGAELASCRCAEMVGSWGLGAGCPGHMCNAEL

SEQ ID NO: 190567 - protein, 87 aa, Triticum aestivum
  unsure (1)..(87): unsure at all Xaa locations
  Clone ID: PAT_TA_84985.pep
MELDGKYSKDQSLKCECLLFDLDDTLYPFNSGIAADIKKNIQDYMVHKLGVDXAISLDLCVLLYKQYGTTXMAGFXGCWVQFDYXDY

SEQ ID NO: 190568 - protein, 68 aa, Triticum aestivum
  Clone ID: PAT_TA_84986.pep
ARSPEASGKCFHIGATRPRPAGRQDGGHHGAHCGITTRAFGRRRPPFVRISCTSCLPSKLAVVGSLPA

SEQ ID NO: 190569 - protein, 87 aa, Triticum aestivum
  unsure (1)..(87): unsure at all Xaa locations
  Clone ID: PAT_TA_84987.pep
WRVYLAGGIRGGGGGXQGSENQGSGGYGTGGGTGSGSSEASSGDPPSATPPYASADASGNGGGMGGGRDGGTGGGKGHGSGFGEGQP

SEQ ID NO: 190570 - protein, 93 aa, Triticum aestivum
  unsure (1)..(93): unsure at all Xaa locations
  Clone ID: PAT_TA_84988.pep
EVETYKIYIFKXLKQXHPXIGISSKXMSIMNSFINDIFEKLXAGEAAKLARYNKKPTITSREIQTSVRLVLPGELAKHAVSEGTKAVTKFTSS

SEQ ID NO: 190571 - protein, 167 aa, Triticum aestivum
  unsure (1)..(167): unsure at all Xaa locations
  Clone ID: PAT_TA_84989.pep
DDADVYSQAASNLVSGNNLEQTIQQILDMGGGTWERDTVVRALRAAYNNPERAIDYLYSGIPENVEAQPVARAPAAGQQTNQQAASPAQPAVALPVQPSPASAGPNAXPLNLFPQGVPSGGSNQVLFQVQDLGAPDALRQLPQFQSTLQLVQANPQXILXPMLQRAR

SEQ ID NO: 190572 - protein, 74 aa, Triticum aestivum
  unsure (1)..(74): unsure at all Xaa locations
  Clone ID: PAT_TA_84990.pep
SFSSLXIISESAPLLFYYPIYPPYLLIPNTLISWVAAGFQSEELWDVNRNLSIEEPSLESGIWNQESNTCNTKD

SEQ ID NO: 190573 - protein, 161 aa, Triticum aestivum
  Clone ID: PAT_TA_84991.pep
LLSCLPAVWVLAAAAGRSPGCATRCGEIDVPYPFGLDPQCAIHAGFWLNCTTVDGATKLLDKNSEVTKISVEDGKAWFKNFISRQCYNQSSGDMFENNAWVDYTGEPYVLSAEDNKIIVLGCNSMAYMQSDSYIIGCMSTCDDQLKNGSCSGTAGCCKRSS

SEQ ID NO: 190574 - protein, 95 aa, Triticum aestivum
  Clone ID: PAT_TA_84992.pep
FLLHYLCIILALIRLQLDCLGTRFDLIVNYQMVGAGRRGGFGGPRFDVQRATWRWLTSSSTASCSYNYCWPYREMLGLLYQLFKAWTLYNYMFLS

SEQ ID NO: 190575 - protein, 57 aa, Triticum aestivum
  Clone ID: PAT_TA_84993.pep
FFFFTLDASTVRYIQTSGLNNRQALLILEQMDAETSVAKPAKGFCNNPALHRRHLID

SEQ ID NO: 190576 - protein, 122 aa, Triticum aestivum
  unsure (1)..(122): unsure at all Xaa locations
  Clone ID: PAT_TA_84994.pep
MGRVIRAQRKGAGSVFKSHTHHRKGPARFRSLDFGERNGYLKGVVTDVIHDPGRGAPLAKVTFRQPFRYKHQKGVFVAAEXGMYTGQFVYCXRRATLSIGNVLPLRGIPXGAVXVCNVXHTP

SEQ ID NO: 190577 - protein, 97 aa, Triticum aestivum
  Clone ID: PAT_TA_84995.pep
ALRHRAGMGLPVGRHIVPDKPLPVNDELVWDNGTPFPEPCIDRLAPHIGKYEALAWLCGGLGFFAALGMAAVVNDKASNIPYTPKVYPYDNLRAELG

SEQ ID NO: 190578 - protein, 85 aa, Triticum aestivum
  unsure (1)..(85): unsure at all Xaa locations
  Clone ID: PAT_TA_84996.pep
KIKGETMLGTEEXGVSILQDLHQQXQSLLHAHILCTGVDDNIGRSKXKILAAMSKRMDRNKWIIGGIITALVLAILLILYFKLAN

SEQ ID NO: 190579 - protein, 156 aa, Triticum aestivum
  unsure (1)..(156): unsure at all Xaa locations
  Clone ID: PAT_TA_84997.pep
NMNYEKSLVDILHEHNNPRFRGQNGWIPEGWRSITQMFNEKFPLAQFSKAQIQEKEKELKANYKLIKEARKQSXGLGWNDSLGMINALPPIWDKNNXKPSKDEEFQSKAFPLLQPIGXLYQXSCATGDXNFTSHATTTPVKFQTSKMILCNRMMTL

SEQ ID NO: 190580 - protein, 69 aa, Triticum aestivum
  Clone ID: PAT_TA_84998.pep
PGIADRMSKEITALAPSSMKIKVVAPPERKYSVWIGGSILASLSTFQQMWISKDEYDESGPAIVHRKCF

SEQ ID NO: 190581 - protein, 65 aa, Triticum aestivum
  Clone ID: PAT_TA_84999.pep
NTYNTLHDSSCSCTHLGCSWWCLLYMHARTDGRPVVLIRNVHAFQPVRQAGREREREREREREIF

SEQ ID NO: 190582 - protein, 127 aa, Triticum aestivum
  unsure (1)..(127): unsure at all Xaa locations
  Clone ID: PAT_TA_85000.pep
SPLASGLLIAXHNGIPXAXVXPQQAXFGNTVNELQTEAGKAXKIEKVKKLSEVAERLGGNVAQLSLAWALKNPNVSTVILGATKVEQLEDNFKALEIYKKIDDKVLEEIEKILDNKPKPAPTYNRER

SEQ ID NO: 190583 - protein, 114 aa, Triticum aestivum
  unsure (1)..(114): unsure at all Xaa locations
  Clone ID: PAT_TA_85001.pep
MGGGNGQKSKMARERNLEKNKGAKGSQLETNKKAMSIQCKVCMQTFMCTTTEVKCXSTPEAKHPKTDVYQCFPXPXEVKSLNFTTILVGHYDLGQALVVSSVLPVHAPVLSYLH

SEQ ID NO: 190584 - protein, 114 aa, Triticum aestivum
  unsure (1)..(114): unsure at all Xaa locations
  Clone ID: PAT_TA_85002.pep
VKIPEDVAVNVALSLRYEINRGFATLREIGHGRDLKKFLIVIAGLWLLSVLGSCCNFLTLFYIVFVALYTVPVLYEKYEDKVDAFGXEKAMTELKKYYAIFDEKCLSKIPKGPL

SEQ ID NO: 190585 - protein, 82 aa, Triticum aestivum
  Clone ID: PAT_TA_85003.pep
MPAPSAVASAVERLQAAAQDAAKSSSRSAGAFSEQAQQALVSKDRRTVVSPVNMCKGQLPLALRLVLWQGSHSKEKPKIGCA

SEQ ID NO: 190586 - protein, 56 aa, Triticum aestivum
  Clone ID: PAT_TA_85004.pep
GASLRSAIVDNFWDYLDAPIMCLSSQDVPTPYAATLEDATVVQPAQIVAAVEQLCA

SEQ ID NO: 190587 - protein, 106 aa, Triticum aestivum
  unsure (1)..(106): unsure at all Xaa locations
  Clone ID: PAT_TA_85005.pep
YTPFPPPQQPSKIDLELENGEYFMSDKKKSAKKWQEKLDKQSGRAEENKRKREAAFVPPXENTAGPSKSDKNASDNSEIARYSESPLKRKGERILEKNEAKESVHS

SEQ ID NO: 190588 - protein, 116 aa, Triticum aestivum
  unsure (1)..(116): unsure at all Xaa locations
  Clone ID: PAT_TA_85006.pep
PRWPASCSARLFFASTMPQLGTCSLPGAAIYGTSTRRFGGLEFQQHKVNHISFGRKASVKATLKTVRCNATQTQSVQKKSSSATIQRDKKGMYKGQNWMTEAVGFPPFPLWKGVXG

SEQ ID NO: 190589 - protein, 95 aa, Triticum aestivum
  Clone ID: PAT_TA_85007.pep
LVIVPWGLHKLLNYIVKKYNNPVIYVTENGMDDEDDQSATIDQVLNDTKRVGYFKGYLNSVAQAIKDGADVRGYFAWSFLDNFEWGYGATPRRFG

SEQ ID NO: 190590 - protein, 77 aa, Triticum aestivum
  unsure (1)..(77): unsure at all Xaa locations
  Clone ID: PAT_TA_85008.pep
RSRARRAGSSCAVAPCRPPPRAVGICXAARRRWDLTNKGAESTPILKDAVEISTDEESDGVVTCHPNGNTDGCERNY

SEQ ID NO: 190591 - protein, 87 aa, Triticum aestivum
  unsure (1)..(87): unsure at all Xaa locations
  Clone ID: PAT_TA_85009.pep
KIPHFLRGEESVKDRAPAATMSGRGKGGKGLGKGGAKRHRKVLRDNIQGITKPAIRRLARRGGVKRISGLIYEETRGVLXSSQGGGG

SEQ ID NO: 190592 - protein, 147 aa, Triticum aestivum
  unsure (1)..(147): unsure at all Xaa locations
  Clone ID: PAT_TA_85010.pep
QFACLRAIKGGSAQVRFQPHVGQFLAAAAENVVSIFDIETHGKKYTLQGHNTDVQSVCWDNNGEYIASVSQDLVKVWSMSXGDCIYELKXMGNXSILAVFHPXSYSNSWVLGGYHLSEVWEHGEKPEPNRTTHESLIXGAXASPSQG

SEQ ID NO: 190593 - protein, 93 aa, Triticum aestivum
  unsure (1)..(93): unsure at all Xaa locations
  Clone ID: PAT_TA_85011.pep
MASIIVIAVVLVLDVLAFVLAIGAERRRSYANVTAADSVRAXYCVYSPNASTAYGVSAXLLLLAAQAVGMAAXRCFCCGRGLSPGRWRACGTA

SEQ ID NO: 190594 - protein, 167 aa, Triticum aestivum
  unsure (1)..(167): unsure at all Xaa locations
  Clone ID: PAT_TA_85012.pep
KKLAIFTALAFSQKLSGLPPETVFQPLLKDNLVAKGIVLSFITEFFKEYLKENTLXDDLIALLKKGKMEDNLLDFFPXAKRSXEALSEHFXKEGLTSLVEYNEKKMFEVKLKEIKSTLTTMINDEAAIPEVIETVKQQVKDAKFPDLXSSQLWDVLMEVMGREHNSN

SEQ ID NO: 190595 - protein, 172 aa, Triticum aestivum
  unsure (1)..(172): unsure at all Xaa locations
  Clone ID: PAT_TA_85013.pep
SPVTTMASESEACSWEPHLLHPNGTEPLHRIAVDYCPEACLHERHAGEIHVTYDDRGGARWRSCCRFLPGSAVATTXPRAGGGHVRTQLQHLLVLPGRVPPDQDEFDXDSSARQARCSRQTTTSXATAGGRNSSVPFDPLTXQQXPSPGTRPHPVXVNGTXXXXKGPGEPWP

SEQ ID NO: 190596 - protein, 128 aa, Triticum aestivum
  unsure (1)..(128): unsure at all Xaa locations
  Clone ID: PAT_TA_85014.pep
MAEEGYKVTLNVYDLSNGLARQLSTSFLGKPIEAIWHTGVVVYGNEYYFGGGIQSSPAGTTPXYGRPLRVXELGVTHIPXEVFRGLLRDIAPRYTGEXYRLLNHNCNNFSHWRPRRWRRADSSQLPAE

SEQ ID NO: 190597 - protein, 166 aa, Triticum aestivum
  unsure (1)..(166): unsure at all Xaa locations
  Clone ID: PAT_TA_85015.pep
SCRFADVPAESYKTLTSLSSVTAYGFDLVRGTQTLGLVTSAGFPAGKYLFAGVVDGRNIWADDLATSLSTLQSLEAVVGKDKLVXVSTSCSLMHTAVDLVNETKLDSEIXSWLAFAAQXVVXVDALAKALAXGQKDXAYFATNAAAQLXRGGPVPNKLLALTGRLL

SEQ ID NO: 190598 - protein, 52 aa, Triticum aestivum
  Clone ID: PAT_TA_85016.pep
VITLMDIYDRNPPLLKQQPAGLSCSIQPRPAQAMKLNSNSSSPTLTKCDPWS

SEQ ID NO: 190599 - protein, 98 aa, Triticum aestivum
  unsure (1)..(98): unsure at all Xaa locations
  Clone ID: PAT_TA_85017.pep
FSTFMPDLYCLIFFCMIKSTTNLLFHPRSWRSSFQLIAGGRGRYLTLSTLLRGHPSLSARATNRRXQXPXPACRHXPNNIAGVLRRQESNHNVXSRTV

SEQ ID NO: 190600 - protein, 145 aa, Triticum aestivum
  unsure (1)..(145): unsure at all Xaa locations
  Clone ID: PAT_TA_85018.pep
NILLTDSYRAKVSDFGFARSGPSDTEKTHISTKVKGTAGYLDPEYLRTYQLTPKSDVFSFGILLVEILSARRPVELKRTPEERITXRWTFKKFNEGNTREILDPLLEDHVDDEVLENSLTWLSKCAAPDTGRPADMKEXGEHCXR

SEQ ID NO: 190601 - protein, 113 aa, Triticum aestivum
  unsure (1)..(113): unsure at all Xaa locations
  Clone ID: PAT_TA_85019.pep
FLQNDKRGKVAITTIGSENIYSVLSIGSDNNHFFCCTKNQVRLSQFPPATNTYSLFSELYDFVPTNAFRLAHLVIXTLLWXVSPRRNGRLPPLXPLAPQGDDHXIIATQXQQG

SEQ ID NO: 190602 - protein, 53 aa, Triticum aestivum
  Clone ID: PAT_TA_85020.pep
YLFASLHQVLCSCRNSQNRPKQWSRQILHNSFLFFGVCEFGLLKVLFTSTCLS

SEQ ID NO: 190603 - protein, 79 aa, Triticum aestivum
  unsure (1)..(79): unsure at all Xaa locations
  Clone ID: PAT_TA_85021.pep
ESMKSVDNNPQEAPPPCPSPSFHLYPLSPLFSPLSSILFLFTSIRALQPXSLPLLSYQAKPRTXHLVPGXKLQXALIPK

SEQ ID NO: 190604 - protein, 61 aa, Triticum aestivum
  unsure (1)..(61): unsure at all Xaa locations
  Clone ID: PAT_TA_85022.pep
SXTPRGMLLNPGTKGLDGGISLWEPKERASLAIEYIVGKLLEMFAWRWVRYHRAEWTLSYV

SEQ ID NO: 190605 - protein, 52 aa, Triticum aestivum
  Clone ID: PAT_TA_85023.pep
MGNVLPCLVQQAGTAAGALPAMNPKRRLISLKLLTKAIHKMKKRSVPARRPR

SEQ ID NO: 190606 - protein, 127 aa, Triticum aestivum
  unsure (1)..(127): unsure at all Xaa locations
  Clone ID: PAT_TA_85024.pep
GVKHIVLVGSMGGTNPNHPLNSMGNGNILVWKRKAEQYLADSGIPYTIIRPGGLQDKDGGVRELLVGKDDELLQTDTKSIPRADVAEVVSRLCSTKEAIQAFDLAXKXEGVGTPTKDFRCSPCPFNC

SEQ ID NO: 190607 - protein, 134 aa, Triticum aestivum
  unsure (1)..(134): unsure at all Xaa locations
  Clone ID: PAT_TA_85025.pep
ELTVAEKNILLEVEPIKLRVRSIFREACDGVRLNPEDEKFILEKVLEHHPEKQSKVSGEIDYLTVNKHQTFQGHSVLFPWVSTDGSQASFSYLKCLENXVRKSYTEDADTFCMKYFKARRKAQPADVWDIKGPG

SEQ ID NO: 190608 - protein, 115 aa, Triticum aestivum
  unsure (1)..(115): unsure at all Xaa locations
  Clone ID: PAT_TA_85026.pep
MQIFVKTLTGKTITLEVESSDTIDNVKSKIQDKEGIPPDQQRLIFAGKQLEDGRTLSDYNIQXKESTLHLXVLRLRGGYGXKKRKKKVYTTPKKFKHKAQRRPSWXSSKYYXVDL

SEQ ID NO: 190609 - protein, 110 aa, Triticum aestivum
  unsure (1)..(110): unsure at all Xaa locations
  Clone ID: PAT_TA_85027.pep
SIEALQXFPVFGSXFXNLSXGXPXMLLGVIFLLXVFWPKDAVPFVQGSPHXLAQILSVILESSSSSIEPCHPVLPASSRLVSQSMSVNMTFAQASGRSYSSTNRLTADSS

SEQ ID NO: 190610 - protein, 166 aa, Triticum aestivum
  unsure (1)..(166): unsure at all Xaa locations
  Clone ID: PAT_TA_85028.pep
FVDSSRPTMVCRLNRSLYGLKQAPRAWHSRLATFPVTLGFVEAKSDTSLFIHHHGAETAYLLLYVXDIVLTASSQSLLRRLVXALQREFPVKDLGVLHHFLGVTAEPRPSXTPTXQGQYIXILERAKMIDXKSXSXQXXTQGKXSEGMGDQFKDPTGKGSCRLYSS

SEQ ID NO: 190611 - protein, 165 aa, Triticum aestivum
  Clone ID: PAT_TA_85029.pep
ENQNLGKLAECAQYQAQLQKNLLYLAAIADAQPQPPQNPAGRPQMMQPGIVPGAGHYMSQVPMFPPRTPLTPQQMQEQQQQQQFQQQQQQVQALTFPGTDGHETKAPSTACSSSSLCLTLPGAADCSHTIPTDGRGTTGTPVGLKTSAMRPQDAPDTSKCTWRNL

SEQ ID NO: 190612 - protein, 123 aa, Triticum aestivum
  unsure (1)..(123): unsure at all Xaa locations
  Clone ID: PAT_TA_85030.pep
VISVTSNLVPGLMHSLMYKGENATLNEKLSPLMKWLFCQPNPIALNTALAXLGVARPVFRLPYVPLPLEKRAXFVRIVEXSIGRENFXGQKEAQVLDDDDFRVDQVGTRKMSLPILLANKLWL

SEQ ID NO: 190613 - protein, 109 aa, Triticum aestivum
  Clone ID: PAT_TA_85031.pep
HPHTLYALLCSCVRGLFPPLFIQIRTRPPIHPNHPSPSPSLPPPPPPGRRLVVLNSPFEFRIPVLRVECRLGLLRTGLDSSSQQKHPVPSASPCSALLTNRQKNRSCRR

SEQ ID NO: 190614 - protein, 80 aa, Triticum aestivum
  Clone ID: PAT_TA_85032.pep
MGGGGAHGGTTYKGYTIPHNKRWHTVAGKGLCAVMWFWVFYRAKRDGATLLGLRHPWDGHDDHSHGHGHGHEASSSSSSH

SEQ ID NO: 190615 - protein, 140 aa, Triticum aestivum
  unsure (1)..(140): unsure at all Xaa locations
  Clone ID: PAT_TA_85033.pep
AYSATEFAIGLFTGRVGLVSDAFHLTFGCGLLTFSLFAMAASRTKPDNLYTYGPRLEVLAAFTNALFLLFLSFSLAVEALHAFMQDESEHKHYLIVSAVTNLLXNLLGVWFFRNYARVNIXYRNAXDMNYTRSVAVLDQY

SEQ ID NO: 190616 - protein, 140 aa, Triticum aestivum
  Clone ID: PAT_TA_85034.pep
VACFLTRGDLYHRIYSPISFGKKYDPNGDYIRHFIPVLKDMPKEYIYEPWTAPLSVQEKARCIVGKDYPKPVVDHEAASKECRRRMGEAYASNLGGPVKGNSSNSSRRKFSDGWARNPCPLIHVKQTVKADPRARTVLRN

SEQ ID NO: 190617 - protein, 174 aa, Triticum aestivum
  unsure (1)..(174): unsure at all Xaa locations
  Clone ID: PAT_TA_85035.pep
VEGVEKHWGAAVPGPNNFIETLRERMFRPSLSTIISENPKVVTVAPSDMVLTASKKMLELKVSSAVVAIENKPGGILTSRDILMRVIAQNLPPESTTVEKXMTKSPECATXWDTPILDALHTMHDGKFLHLPVLDXDGNVVTVVDVLXHNHAAIATLGNXGLVNICMIKVWDQQ

SEQ ID NO: 190618 - protein, 153 aa, Triticum aestivum
  unsure (1)..(153): unsure at all Xaa locations
  Clone ID: PAT_TA_85036.pep
LCVLFQINREMMELIESLQRKAVEEGKMAAGDAEESGDGDSEENGGALVKGEDDSNLNEEGQDGVXADGSVKIVVEMEGAKDDKKSKMGAAEVVDVLVEDAAAKQPKKRTADEDAAAKQTKHKADAETGGKRVKEQCCSGRGDVCVTPMKRRW

SEQ ID NO: 190619 - protein, 102 aa, Triticum aestivum
  unsure (1)..(102): unsure at all Xaa locations
  Clone ID: PAT_TA_85037.pep
EEKSPFFRLYKNTCLKIETAAEKISTSVEASSTHPTSQVPSIAETMKMVKDCGVKEKTALMHTTAFLIVKPEFREVFCMLETNEGRXDLLEREHAKEMMRHM

SEQ ID NO: 190620 - protein, 55 aa, Triticum aestivum
  Clone ID: PAT_TA_85038.pep
IQFSFICAPMFIGWILLIYGFVHRRRDALVCWFYGVLRRQLPECILQQGLSGFNE

SEQ ID NO: 190621 - protein, 122 aa, Triticum aestivum
  unsure (1)..(122): unsure at all Xaa locations
  Clone ID: PAT_TA_85039.pep
MNNREREKIFVASQEKFHANADKQYWKSISDLIPHEIATIXXRGKKDKDKKPSVTVIQGPKPGKPTDLSRMRHILVKLXHAPPPHMLQSPPAPAAKXGAKDGSKXRWKGWVDGAEQADAQPA

SEQ ID NO: 190622 - protein, 156 aa, Triticum aestivum
  unsure (1)..(156): unsure at all Xaa locations
  Clone ID: PAT_TA_85040.pep
IMISQYPSLVEEWSNGRLENEMDIVLDAVNKIRSLKPPTDSNERRPAFALCRGQEIAATIQCYQSLIVYLSSISHLKILTENDETPADCATAXVVNKDLSXVLSTSKELLNXDXXXEKLKKKKDXDQKXQNXXGAKNGXPPAISXKVPXSXQGGGH

SEQ ID NO: 190623 - protein, 81 aa, Triticum aestivum
  Clone ID: PAT_TA_85041.pep
MSRVAADAPYSAAAVALHAHSLLEESRFAGSPLSSHRGGHRPFDRAFAGGKIIVAGLAAAIVVAVFCYIRITRKKSVEPKV

SEQ ID NO: 190624 - protein, 105 aa, Triticum aestivum
  unsure (1)..(105): unsure at all Xaa locations
  Clone ID: PAT_TA_85042.pep
LSPLNLQLASSHLLPKRKHHFLPGILPPXTYLHADVPCVXSGLGGMRRNLMSMAALNSCRAPHLGRHNLQLFIVSLTTQRLSLIAIQALRRPMNESNDDGMGAES

SEQ ID NO: 190625 - protein, 154 aa, Triticum aestivum
  unsure (1)..(154): unsure at all Xaa locations
  Clone ID: PAT_TA_85043.pep
MGTIVDADVGFAVKRTSRSLVPPASATPRETLRLSVIDRVAGLRHLXVRSLHVFAAGGDKKRQQATATPAKGAGEAXWGKALVDYYRSRGXRCGCAXRAAGKXRVAFTGEGPLXVGGNPLLARRPHSTTHAHPQATSAGASPDNRLTCPHQTDF

SEQ ID NO: 190626 - protein, 122 aa, Triticum aestivum
  Clone ID: PAT_TA_85044.pep
MHANPAGRRGGTSLGRRVTYAVLAWSAVLWQCFFLGAVGVIFCVHTLLAGILIAVFIPVTEVAAVIFLRERFSSEKGVALVLSLWGLASYSYGEWSEARAKKRKTRTEEGAAAAEALQQANP

SEQ ID NO: 190627 - protein, 98 aa, Triticum aestivum
  unsure (1)..(98): unsure at all Xaa locations
  Clone ID: PAT_TA_85045.pep
MAESKARVALFLAALAAASLLALAPAGAATTCAPTQLTPCAPAIVGNAAPTAACCARLKAHPATCFCQYKRNPSMQRYVNSPNGKKVFAACKVSLPXC

SEQ ID NO: 190628 - protein, 158 aa, Triticum aestivum
  unsure (1)..(158): unsure at all Xaa locations
  Clone ID: PAT_TA_85046.pep
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGXTSQADCAVLIXDSTTGGFEAGYLKGWQTREHALLAXXLGVNKXLLLQMDHKY

SEQ ID NO: 190629 - protein, 119 aa, Triticum aestivum
  unsure (1)..(119): unsure at all Xaa locations
  Clone ID: PAT_TA_85047.pep
MSSAAGGVEETVRASHILIKHEGSRRKASWKDPDGRIISATTRGDAAARLLDLRNQILSGQANFADLAARHSDCSSARRGGDLGTFGRRQMQKPFEDXTYALRVGXXKXIVXXEXGVTP

SEQ ID NO: 190630 - protein, 78 aa, Triticum aestivum
  Clone ID: PAT_TA_85048.pep
ATPADAALMMQLGCDGVFVGSGIFKSGDPARRARAIVQAVTHYSDPTILADVSTGLGEAMVGINLNDPKVERYAARSE

SEQ ID NO: 190631 - protein, 135 aa, Triticum aestivum
  unsure (1)..(135): unsure at all Xaa locations
  Clone ID: PAT_TA_85049.pep
MGRKFFVGGNWKCNGTTDQVEKIVKTLNEGNVPSSDVVEVVVSPPYVFLPVVKSQLRQEFQVAAQXNCWVKKGGAFTGXKLSAEMLXVNLGVPWVIPWALLKGELLLGESNDXLGDKVAFAPSQGTKXIACVGRL

SEQ ID NO: 190632 - protein, 76 aa, Triticum aestivum
  unsure (1)..(76): unsure at all Xaa locations
  Clone ID: PAT_TA_85050.pep
MVSWXERRAXDVSLLITAAHAHEHGDELFTGDNGSSFSRVSXTVNSLVSLXLAASRWSVARVXCSXPCWKSCARQG

SEQ ID NO: 190633 - protein, 102 aa, Triticum aestivum
  unsure (1)..(102): unsure at all Xaa locations
  Clone ID: PAT_TA_85051.pep
VGASVGLXLHLPQEPPQRLLPRASRRRRRRTPGTRRRPLPTARSTPPGTAAGSSRPCTSSWHPPVGWAHRVRTVPSCSPLSRASRQLLAVPVRAAPPAGIGL

SEQ ID NO: 190634 - protein, 57 aa, Triticum aestivum
  Clone ID: PAT_TA_85052.pep
AVNQTNIDCPCHNQAIIKDHGAHASYKGRLLPIDDVDSKSSEAFHSLAMTASTSAGV

SEQ ID NO: 190635 - protein, 146 aa, Triticum aestivum
  unsure (1)..(146): unsure at all Xaa locations
  Clone ID: PAT_TA_85053.pep
MEKAGQKRRPLTVMASSSSQVAAARGMGMTNPLAEWTDRVRSLEAGVRAWLAKQPTHVEAAVVTAVGAVXGAALGGLMGQACARRRGRASCAARRRRGTXQXSLAPSKQTXALXGGPLXQTRNLRHNGAKCWXTCXXKRIKGLRSR

SEQ ID NO: 190636 - protein, 123 aa, Triticum aestivum
  unsure (1)..(123): unsure at all Xaa locations
  Clone ID: PAT_TA_85054.pep
MEAQDDCKWRQVPAFGDWNLWDDMPVTQYFQAGTFFFAAPTTEKDDDEDLFKVPQFPATPYSYKKCVVRXRGRKELLCLRGKGKGXRRRRVNEQQKWKPKGAVDXDLYKISPQLLCKVXKKNS

SEQ ID NO: 190637 - protein, 131 aa, Triticum aestivum
  unsure (1)..(131): unsure at all Xaa locations
  Clone ID: PAT_TA_85055.pep
MARGVVSAKGGAVAGKKKGSVSFTIDCTKPVEDKIMEVASLEKFLQERIKVAGGKAGNLGDSVTISREKTKVTVTSDGPFSKRYLKYLTKKYLKKHNVRDWXLRVVAANKDRNVYELRYFNIAENEGEEED

SEQ ID NO: 190638 - protein, 78 aa, Triticum aestivum
  Clone ID: PAT_TA_85056.pep
CIQRVYSLAYNFYKNSCPSVDSIVRSVTWAQVAANPALPARLLRLHFHDCFVKGCDRRFCWDTAQSEKTRRRTVGRYK

SEQ ID NO: 190639 - protein, 89 aa, Triticum aestivum
  unsure (1)..(89): unsure at all Xaa locations
  Clone ID: PAT_TA_85057.pep
EAXSCRGLPXRTPSWPSRRSSSPAPPRRGRRQHRRSRRLRSLTRSRWTASGGXWRVSSSXXTPARARXPAAATXAAEIXRHSXXPRXXR

SEQ ID NO: 190640 - protein, 76 aa, Triticum aestivum
  Clone ID: PAT_TA_85058.pep
IALFSCGVAIVVFRLPLLYLNMYAKYHICLNLCLLTFSPNVRSSYLLICCNVCLLTFAPNVGSSYRHLLIDLCSST

SEQ ID NO: 190641 - protein, 101 aa, Triticum aestivum
  unsure (1)..(101): unsure at all Xaa locations
  Clone ID: PAT_TA_85059.pep
RPWASLPLVRASCFSSAVFHGRKPRPFRTDGGGVPDVTPFLKASLLLGGGRTEDQGLEVSLGERIGXSRMGVXLVGPDEPADIFXNICPSAQEKVXMANPL

SEQ ID NO: 190642 - protein, 153 aa, Triticum aestivum
  unsure (1)..(153): unsure at all Xaa locations
  Clone ID: PAT_TA_85060.pep
AKVERDHHVLEIGCGWGSLAIQLVKQTGCKYTGITLSVEQLKYAQRKVKEAGLEDHISFMLCDYRQIPTQRKYDRIISCEXXXXGVGHEYMDDFFGCCESLLAQDGIFVLQFISIPEERYEEYRRSSDFIKEYIFPGGCLPSVSPDXSAKSQH

SEQ ID NO: 190643 - protein, 129 aa, Triticum aestivum
  unsure (1)..(129): unsure at all Xaa locations
  Clone ID: PAT_TA_85061.pep
CQAKIQDKEGIPPDQQRXIFVGKQLEDXRTLADYNIQKESTLHLVLRLRGGMQIFVKTLTXGKTITLEVESSDTIDNVKAKIQDKEGIPPDQQRLIFAGKQLEDGRTLADYNIQKESTLHLVLRLRGGQ

SEQ ID NO: 190644 - protein, 158 aa, Triticum aestivum
  unsure (1)..(158): unsure at all Xaa locations
  Clone ID: PAT_TA_85062.pep
NVIIQHALSMVALESVKIYTAISDGTINLVDKFFEMQRNDAVRALDVYKRATNQAERLSEFHEVCKTIHIGRGEKFLKIEQPPASFLQTMEDYVRDAPTGQKQKTILAIEYKKEPEEEEKPASPPPAPEQEPEQEPEPEPXPVKEEAPEAEPDLLGLN

SEQ ID NO: 190645 - protein, 151 aa, Triticum aestivum
  unsure (1)..(151): unsure at all Xaa locations
  Clone ID: PAT_TA_85063.pep
DGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAXVVWLYSIVFYFPW

SEQ ID NO: 190646 - protein, 60 aa, Triticum aestivum
  Clone ID: PAT_TA_85064.pep
RSMHSKILSSPSLPPCCRLVVVKLVGPGSIWTDVLFTAIEVIRSRFALAVDRYSLVFSIF

SEQ ID NO: 190647 - protein, 158 aa, Triticum aestivum
  Clone ID: PAT_TA_85065.pep
DLEAFKDAVELMFEPDALRWLARAGVSRATAVLQVCSSIAFDKGVESCLKYIEAVPWSESEEEKLKHVFARCTFGESVSKDVLARLQQQCASGSEDLAVQLVESITSGANNGARKEMQSLVSGLLSRSSVYHKDLSGVNKGGLYRICRSCLSSLVELS

SEQ ID NO: 190648 - protein, 163 aa, Triticum aestivum
  unsure (1)..(163): unsure at all Xaa locations
  Clone ID: PAT_TA_85066.pep
MVTRRLFARLYRHCAGAAAASSAAGRHRGALAAAAVEQFAGSSLPVGVPNILNHHFRYSTSIFQKIGFSSVSPQQSDDEVNELKDHERALDGSSEDCPSGSIEGLDLSRDDLVKLVREKDELLKSKDGEIXDMKDXGLRNYAEMXNINARTKRNLRTQKYQSE

SEQ ID NO: 190649 - protein, 120 aa, Triticum aestivum
  Clone ID: PAT_TA_85067.pep
FHNRLKPAKLTWTAMYRKQHKKDIHAEAVKKRRRATKKPYSRSIVGASLEVIQKKRAEKPEVRDAAREAALREIKERIKKTKDEKKAKKAEVSKSQKTQTKGAVQKGSKGPKLGGGGGKR

SEQ ID NO: 190650 - protein, 171 aa, Triticum aestivum
  unsure (1)..(171): unsure at all Xaa locations
  Clone ID: PAT_TA_85068.pep
DELIKEASKMVPDPDEPSQTLYDTMMRHHPPITRVAGAGTDFAAFVQHIGVPSLDMSYGLFEEYPVYHSLYDDYVWVERFGDPLFHRHVAVASVWGLIALKLADDEIIPFNYVSYASELXEECTKDIVDKCKGXPVSFSPLQNSIKQLESAATKITKRRIAASRKREPKDN

SEQ ID NO: 190651 - protein, 147 aa, Triticum aestivum
  Clone ID: PAT_TA_85069.pep
FINKIYHPNVDEMSGSVCLDVINQTWSPMFDLVNVFEVFLPQLLLYPNPSDPLNGDAAALMMRDRPAYEQKVKEYCEKYAKPGDAGVTPEEQSSDEELSEDEDDSGDEEIMGKPRPIVKLAPTIPVICTRCLLQQLQLNTHEHPRAV

SEQ ID NO: 190652 - protein, 169 aa, Triticum aestivum
  unsure (1)..(169): unsure at all Xaa locations
  Clone ID: PAT_TA_85070.pep
KAINNIFYRFIFETEKHNGIAELLEILGSIINGFALPLKEEHKLFLVRALIPLHKPKCVAMYHQQLSYCVTQFVEKDCKLADTVIRGLLKYWPITNSSKEVMFLGELEXVLEATQPAEFQRCMVPXFRQIARCLSSSHFQVAKKXLFLWNNDHIEGLLNRQQGYTAISK

SEQ ID NO: 190653 - protein, 72 aa, Triticum aestivum
  unsure (1)..(72): unsure at all Xaa locations
  Clone ID: PAT_TA_85071.pep
XSXSCLLSKETRNTSLXRSHXAFMPVDVKISAXPSTLPXSFAKSLADIQGXXGPXXQTELVPKPMKPXXAEX

SEQ ID NO: 190654 - protein, 49 aa, Triticum aestivum
  unsure (1)..(49): unsure at all Xaa locations
  Clone ID: PAT_TA_85072.pep
GXLADLEAAVCLCTALKANVLGIGLXIPIKLXLLLNYCGKTAPKGFQCA

SEQ ID NO: 190655 - protein, 47 aa, Triticum aestivum
  unsure (1)..(47): unsure at all Xaa locations
  Clone ID: PAT_TA_85073.pep
LVIYLLAYLLHACTTXTSLIXITYVHLCIRLXKWPVCMWRSXTYYCA

SEQ ID NO: 190656 - protein, 181 aa, Triticum aestivum
  unsure (1)..(181): unsure at all Xaa locations
  Clone ID: PAT_TA_85074.pep
ADITVEANDIKIAVASANKSGAMSFQELNQKKYRTPLILGMGLLVLQQLSGINGIIFYAGSIFKAAGLKNSNLDTCILGVIAVLATAVTTKIXDRAGRRILLIISSXGMTLSLLVVAVVFYIKDNISHDSDLXNTLSMVSLGGVLGLXVLPTPLXRGAIPWIIMAEILQVSXKDVAGSFXT

SEQ ID NO: 190657 - protein, 77 aa, Triticum aestivum
  Clone ID: PAT_TA_85075.pep
FFFLPHNDYPIPSILSNTKHNCEISEHSVGPFLQNALITLAKILQSKTSPFIWISSNSLNASRTFPLLTNQYVRCAT

SEQ ID NO: 190658 - protein, 102 aa, Triticum aestivum
  unsure (1)..(102): unsure at all Xaa locations
  Clone ID: PAT_TA_85076.pep
IKXSXVXALXLREPLMQLSRHCSVFPGIHGRKNPXQVCFPGQKFPVAFPQLLXRVDFHVARDWDVLVKLHNLASXVLLPPEHRVATHCCSFELSFLEFRYAK

SEQ ID NO: 190659 - protein, 121 aa, Triticum aestivum
  unsure (1)..(121): unsure at all Xaa locations
  Clone ID: PAT_TA_85077.pep
MQRRRGHTWAGVGKTAXAASAHAALFCFTLLLALRVDGRTTYSWWXIIFIPLWSFMVLLRLXRFQMPGPSIPHGRHWAXMSSIVATPLXXAFELLLCIXLENXKIXESPTFDLKXVPPRWA

SEQ ID NO: 190660 - protein, 60 aa, Triticum aestivum
  unsure (1)..(60): unsure at all Xaa locations
  Clone ID: PAT_TA_85078.pep
LLSGSGXFPKQEIDEIXEMVISMGSFVLARSXGLIGHTFXQKRLKQPLYXHPWEDVLYTK

SEQ ID NO: 190661 - protein, 62 aa, Triticum aestivum
  Clone ID: PAT_TA_85079.pep
LAEEVLKLAKNGLERRGYKEVGFLREVDEVVRTGVTPAERLLHLYETKWQRNVDHVFEHLLY

SEQ ID NO: 190662 - protein, 149 aa, Triticum aestivum
  unsure (1)..(149): unsure at all Xaa locations
  Clone ID: PAT_TA_85080.pep
SSSSSNIHHMLFTDICFLVLNLFVQGSCNCRLLFLFLAIEVSDLSLFPNSGGGRCHFSPFVYRRKTLCVNCTPPDGKNSIFSLSLPQQTAFEXAQXQDXIXFKIXSWQVXQGTLVNAKGIILNVFTKQXXGFVGESPQSDXTHXXGTXN

SEQ ID NO: 190663 - protein, 42 aa, Triticum aestivum
  Clone ID: PAT_TA_85081.pep
DQIQLHKNTHTIGKLHLEVSLIIFMTIAINATNSDSRANGTL

SEQ ID NO: 190664 - protein, 111 aa, Triticum aestivum
  unsure (1)..(111): unsure at all Xaa locations
  Clone ID: PAT_TA_85082.pep
VQTRRNPRHQRPLPNGADDGATADAANHWXGHPGCRPALRRHPPRXPRPGPRVLDVQAGFXEATTPEEDTVTAPIYAIGDPSLASLSVPFSCEPVPSXXISRXSXYXEISI

SEQ ID NO: 190665 - protein, 126 aa, Triticum aestivum
  Clone ID: PAT_TA_85083.pep
MARVALVAVFAVLAALAVAEMASGAVTCGDVTSAVAPCMSYARGQASAPSGACCSGVRTLNAKASTPADRKAACNCLKNLAGSGISMGNAANIPGKCGVSVSFPINTKTNCNNFTKLSTSIIITPS

SEQ ID NO: 190666 - protein, 75 aa, Triticum aestivum
  unsure (1)..(75): unsure at all Xaa locations
  Clone ID: PAT_TA_85084.pep
QEXXRXEEQXXERMXVXGXILQQPRRVPAPEAVAGDVRHLCXRGWTGLXPGGGGGGWIWVWGRATLLPVRPEGVK

SEQ ID NO: 190667 - protein, 122 aa, Triticum aestivum
  Clone ID: PAT_TA_85085.pep
WKTLWLLHQFPASFVPPLGADGGAGALGSMASRSGAYLSTIAWSFTSLDTSPAGRSGRAAEASRRLTTKRSSTRHVATRLLRALEEEAIVFSCKLRHEQRIDGGNFAVSLRPELLSKERCFL

SEQ ID NO: 190668 - protein, 162 aa, Triticum aestivum
  unsure (1)..(162): unsure at all Xaa locations
  Clone ID: PAT_TA_85086.pep
MVKSKAIRVHELGGPEVLRWEEVEVGEPGEGEIRIRTTAVGVNFIDIYFRKGVYAAPTMPFTPGMEAVGVVTAVGPGLTGRKVGDVVAYAGNPMGSYAQEQILPAAVAVPVPPSVDHKQAASVMLKGMTAHVLLXRVIKVXSGILSWSNAAAGGCXSXPCQW

SEQ ID NO: 190669 - protein, 107 aa, Triticum aestivum
  unsure (1)..(107): unsure at all Xaa locations
  Clone ID: PAT_TA_85087.pep
MMMANAKLHKQALLPPRSPFPTAAPYADRGPIARPQVGATHHRHGHHQRTSSESFIXEQPPSWLDDLLNEPRDARGAAXRPGWAPQVSSDSFALFDGGLLVLVLTQW

SEQ ID NO: 190670 - protein, 68 aa, Triticum aestivum
  unsure (1)..(68): unsure at all Xaa locations
  Clone ID: PAT_TA_85088.pep
LTIVIHQIHWATTFYYKATVEMWKLRQQLSHGGSTVLTMCTDNMLQKKYRSLXNKSEQLFIIINVALL

SEQ ID NO: 190671 - protein, 149 aa, Triticum aestivum
  unsure (1)..(149): unsure at all Xaa locations
  Clone ID: PAT_TA_85089.pep
VNWILMILCVAVTVGFRNTKHMGNASGLAVITVMLVTTCLMPLVIMLCWDRSPWLALAFFLFFGSIEALYFSASLIKFLDGAWVPILLGLILLAVMFVWHHTTIXKYEYDMHNKVTXEWLLALGDKLGMVRLPGSARLRLTPGCRKFPW

SEQ ID NO: 190672 - protein, 82 aa, Triticum aestivum
  Clone ID: PAT_TA_85090.pep
VALLLDLLLPPNRPPGCRDVRTRTTHAAGRAPSLLLVGWSTRAYVRTYYAWVQKEKGKEEEASSPSPSPSPSPALRPGRRKA

SEQ ID NO: 190673 - protein, 128 aa, Triticum aestivum
  unsure (1)..(128): unsure at all Xaa locations
  Clone ID: PAT_TA_85091.pep
MVEEEITEGLKNLTVTGDAAASGGEGQRRGGGISSNRIQVSNTKKPLFFYVNLAKRYMQQHGDVELSAXLGMAIATVVTVARNLKNNGFAVEKKXRTSTVDINDDHEXASIQKAKIEISLGKMTINDW

SEQ ID NO: 190674 - protein, 105 aa, Triticum aestivum
  unsure (1)..(105): unsure at all Xaa locations
  Clone ID: PAT_TA_85092.pep
LPHGDVRRAGARRLLLQGLLRLQVQRQGRRRAQQEDPHGSRRQQVLPQEHPLPPVPISHDTNPETKPATHAPKYSSGQWVCICIAVVYLGLSRLLLSRFFSSFXW

SEQ ID NO: 190675 - protein, 172 aa, Triticum aestivum
  unsure (1)..(172): unsure at all Xaa locations
  Clone ID: PAT_TA_85093.pep
QPSSHLIKTLSVLKSYKDHQTNKMGSLHIEPSPSPAFSSVRSALAQNNNKIILCETHDGTSTEIIRATVGKNGQKFDGIWYSGLCQTTYLGIPDSETLSPLQRASLLALDGELKRKTCNRSLCAAFDADSGGDIADIPALVALMNLVGVGMXVIKDKAFXPRQKVTRXXVIG

SEQ ID NO: 190676 - protein, 174 aa, Triticum aestivum
  unsure (1)..(174): unsure at all Xaa locations
  Clone ID: PAT_TA_85094.pep
MGKGFASYLAMKTGPEGGDAAAAQQALIDADLRELGVAARKLANHAFVLGGGLGFGTSFLKWLAFLAAVYLLILDRTNWKTNMLTALLVPYIFFTLPNVLFSLIRGEVGKWIAIIAVILRLFFPRHFPXWLELPGFIILLTVXVAPSLFADSFXGELVXVLICLVXGCYCSKNN

SEQ ID NO: 190677 - protein, 74 aa, Triticum aestivum
  Clone ID: PAT_TA_85095.pep
YRVGSLHRSELNESSHECIFIYPCLPSIDQPCLAVVPQGGAVVSCQRFYRPRFLCHRSGLAPATPAVVPRHGRG

SEQ ID NO: 190678 - protein, 46 aa, Triticum aestivum
  Clone ID: PAT_TA_85096.pep
VISRGMVVYMYYSNKNDNNHPIVVVLRHCRKIHMLPSIVLCYVSFS

SEQ ID NO: 190679 - protein, 142 aa, Triticum aestivum
  unsure (1)..(142): unsure at all Xaa locations
  Clone ID: PAT_TA_85097.pep
DAGQTQSRKPAYIHVNNAGQADRTAYTDLARPSGLYKDEREKRTADSSPPGVRSECVKTRWWRMATHLLEGVRRQLQACASVRTTSGAAAGGGGCQLRCSNFYTDXASGPQNVTKHLPXNDIGSTAVFPYLXFFXXTVXNSN

SEQ ID NO: 190680 - protein, 112 aa, Triticum aestivum
  unsure (1)..(112): unsure at all Xaa locations
  Clone ID: PAT_TA_85098.pep
SGAINPCHSVPRNSASYSQRHQNCYNPFIFHHFFCASCLCSRRCFDQRSSRQWXIPQVFCIILLNAGQHLTCVTSPNLAAKLLGALNGTPLLARCSKYDDGLKXGHKFKPLA

SEQ ID NO: 190681 - protein, 120 aa, Triticum aestivum
  unsure (1)..(120): unsure at all Xaa locations
  Clone ID: PAT_TA_85099.pep
MADAEDAAAARRRAAITDYRKKLLNCRELESRVGTVRESLKNAKRDFTKTEDDLKSLQSVGQIIGEVLRPLDNERFIVKGXAVGPRYVVGCRXKVDKENLXPGXXLXLXDFNNAFQREQG

SEQ ID NO: 190682 - protein, 104 aa, Triticum aestivum
  unsure (1)..(104): unsure at all Xaa locations
  Clone ID: PAT_TA_85100.pep
AXLFVCXXXPICXNXLVAWKLLEXPDRPLXSTLHQQAPWXXTVLHKDPTTGDVGRRPAFLQSSLQASLKFNCYGXCSFLFLVHLSPVLLLLFSFLFVPGLASPL

SEQ ID NO: 190683 - protein, 122 aa, Triticum aestivum
  unsure (1)..(122): unsure at all Xaa locations
  Clone ID: PAT_TA_85101.pep
MAGGNDLKVLGVWTSPFVIRVRIVLNLKGLAYEYVEEDLGNKSALLLGSNPVHKSVPVLLHAGRAINESQVILQYIDEVWAGRGPGXCLPXDPYXRAVARFWGAYIDDKVESAWLGMLLSRN

SEQ ID NO: 190684 - protein, 162 aa, Triticum aestivum
  unsure (1)..(162): unsure at all Xaa locations
  Clone ID: PAT_TA_85102.pep
LSSSGCTNPALYAVVIESPSLQVPSCCRVVTSSIPIKSPQFAVMKSVNYLPNALTKVEGEENGAFXGIWLDDEGFXAEGXPNMNVGFXVTKNKELLMPXRFDKILSXGCTARRVLTSAXHLIXXGKLKQGNIXRNVSVEEXKIGDXMISXGNGSLANCCQMG

SEQ ID NO: 190685 - protein, 148 aa, Triticum aestivum
  Clone ID: PAT_TA_85103.pep
INGGRSSIRNKVRPTTRHVMVVSSVPRRQILILISCATFLLSWIFPFLTSTLAPKVYTREMMRRGILVRTWERDCLIKIMIPDMNTLGYEYSTRCGRWLPRAGAASHHCQLFNTRATFNIKHSPTSCYYQQQISLLIYPGKSLLLNHL

SEQ ID NO: 190686 - protein, 56 aa, Triticum aestivum
  Clone ID: PAT_TA_85104.pep
RRWRSVELVATSYTVGFVQQSDSAVVSFLRDRLLSGVLARRLLKMADYDCGTLESY

SEQ ID NO: 190687 - protein, 149 aa, Triticum aestivum
  unsure (1)..(149): unsure at all Xaa locations
  Clone ID: PAT_TA_85105.pep
MALGAAYHHYLQLAGDHGTATHALLLGVLIFLVIRLVXARRTGTTSANIRKQQQRLPLPPSPPGKLPIIXHLHLIGAXTHISIXDLYAKHGRNSLLLLRIGVVXXLFVSSPSXADTVLRSHXXIFASXPPXMGADIIRYXXSXVGSCLR

SEQ ID NO: 190688 - protein, 157 aa, Triticum aestivum
  unsure (1)..(157): unsure at all Xaa locations
  Clone ID: PAT_TA_85106.pep
AARLLPRHALSLTPQLVAFVNGRPIAYGRKARAGGGRRKGRGPPAVGAAAPAGPAAAGVRVRHVPGSSTSSRRVPAACPASRARQRRLSQPSSSRYAPAGDYYAQGVPSRTSYGPVAEGRLXRMSVPILWLGLSWFRSKMGFPWLHPXVNWTSVLXV

SEQ ID NO: 190689 - protein, 135 aa, Triticum aestivum
  unsure (1)..(135): unsure at all Xaa locations
  Clone ID: PAT_TA_85107.pep
QDMLMSHSYTQVTLITWFLGNKLMATKVPDLSHTHDPCMSIPRSHASPSKIRDVDYIPCFFSLSPIHTHIYLVNQPCVHVRGASSMLHSLQDKLQFLLSMVELEQFSADPAMLLQAQIWVCVLCVAPXSQEHDSP

SEQ ID NO: 190690 - protein, 160 aa, Triticum aestivum
  unsure (1)..(160): unsure at all Xaa locations
  Clone ID: PAT_TA_85108.pep
MAAAAPTHAPVSSSACRAGFSSSGVSFPNFRSAAASAPGWRRREPYPAVSVVSSSPQSVAGAITVDTEVDTLLDSVKWDSKGLAVAIAQNVDTGAILMQGFANKEALAKTISTRKATFFSRSRSSLWTKGETSMNFINVHDIXLDXDHDSIIYLXKMDYL

SEQ ID NO: 190691 - protein, 80 aa, Triticum aestivum
  Clone ID: PAT_TA_85109.pep
LTTGRFASTNGCKLINLIGNHGEDEPNKIDRPTPSGRRVVTDFSRTYAQMTGPPRPSPFDEAGHPQHGVAQVVEVPVRAP

SEQ ID NO: 190692 - protein, 99 aa, Triticum aestivum
  unsure (1)..(99): unsure at all Xaa locations
  Clone ID: PAT_TA_85110.pep
MSTEEAVVAEVPVTEVPAEVPAAQVAEAPKAKKAPKEKKAPKEKKLSAAXKKPAAHPPYAEMIVEASXKXXXEKGSXLXLAIXQFXXGGNHGGKPPXXF

SEQ ID NO: 190693 - protein, 86 aa, Triticum aestivum; identical to SEQ ID NO: 125028
  Clone ID: PAT_TA_85111.pep

SEQ ID NO: 190694 - protein, 83 aa, Triticum aestivum
  Clone ID: PAT_TA_85112.pep
ISSVTKAFQSERLIYRSPEDNDKDKEFFFKHIENDPVAKALADPSILRPRNKKGVEDFLTELQKSSLAVVLCLSPAEAKKTKH

SEQ ID NO: 190695 - protein, 79 aa, Triticum aestivum
  Clone ID: PAT_TA_85113.pep
LRSQPGRLREGALSSVIGLVQVLADYLLSHTVYLSIVCKCFITVRTVHAIHWSRVLFVDCFIFVRMAHVCCFALICTEH

SEQ ID NO: 190696 - protein, 80 aa, Triticum aestivum
  Clone ID: PAT_TA_85114.pep
RKAFFRIRMNYVWALGYNVVGIPIAAGVLFPSTGFRLPPWVAGAAMAASSVSVVCWSLLLRYYKAPKIAGTAKEIGITTL

SEQ ID NO: 190697 - protein, 48 aa, Triticum aestivum
  Clone ID: PAT_TA_85115.pep
RGVLKIFLENVIRDAVTYTEHARRKTVTAMDVVYALKRQGRTLYGFGG

SEQ ID NO: 190698 - protein, 73 aa, Triticum aestivum
  Clone ID: PAT_TA_85116.pep
VDEKRNYHLSSNTCDPGKVCGHYTQVVWRRSTRIGCARVVCADNRGVFIVCSYDPPGNVNGQRPFLTLDAAAK

SEQ ID NO: 190699 - protein, 132 aa, Triticum aestivum
  unsure (1)..(132): unsure at all Xaa locations
  Clone ID: PAT_TA_85117.pep
MARTKQTARKSTGGKAPRKQLATKAARKSAPATGGVKKPHRFRPGTVALREIRKYQKSTELLIRKLPFQRLXVREIAQGXSKTDLRFQESAVAALQEASRGYSXLFEDTNLCXIHAKRVTSCQRNQLARXLG

SEQ ID NO: 190700 - protein, 82 aa, Triticum aestivum
  unsure (1)..(82): unsure at all Xaa locations
  Clone ID: PAT_TA_85118.pep
PSCSRWWDSWRRYDDASTVAGWVGGEQGRKYYCTVFFIFGSFFRFVLXCEIIIKXVGWLHLLLSCCXVXIYSDLLRQKKRGG

SEQ ID NO: 190701 - protein, 61 aa, Triticum aestivum
  Clone ID: PAT_TA_85119.pep
PAPAPAPAPPPRQQGQGQTRWEMFDLLSSLPSTSSASSTTTVSSTASSGAPPPSRPDWMLF

SEQ ID NO: 190702 - protein, 140 aa, Triticum aestivum
  unsure (1)..(140): unsure at all Xaa locations
  Clone ID: PAT_TA_85120.pep
MFLTRTEYDRGVNTFSPEGRLFQVEYAIEAIKLGSTAIGLKTKDGVVLAVEKRVTSPLLXEPSSVEKIMEIDEHIGCAMSGLIADARTLVEHARVETQDHSSQYGEXMTVXLQHSIWDLTLXFGKGKSKVAIWSPLPNAG

SEQ ID NO: 190703 - protein, 61 aa, Triticum aestivum
  unsure (1)..(61): unsure at all Xaa locations
  Clone ID: PAT_TA_85121.pep
DQNFPQLPLKAPTEYIVRPFRDQFTHTHRHRERGELYFVSVYXVVXXHCXSSXTXLSHERL

SEQ ID NO: 190704 - protein, 84 aa, Triticum aestivum
  unsure (1)..(84): unsure at all Xaa locations
  Clone ID: PAT_TA_85122.pep
EQSMXMSVHSIQSVYFEVSQIIFXVRTVYQLWLHSQYLYALQGLSHPPGFPVPWMFGSYDLLRPLDCPACWSRRGPCMPSVVGR

SEQ ID NO: 190705 - protein, 178 aa, Triticum aestivum
  unsure (1)..(178): unsure at all Xaa locations
  Clone ID: PAT_TA_85123.pep
DHATLTKLSILMNAVISGQDPEKLFFGFFDTDGKYIESLLTVNKRTDAEGKITGALCFLHVASPELQHALQVQKMSEQAATNSFKELTYIXRQELRNPLXNGMQFTCNLLKPSXLTXEEQRXFFQPNVLCQXQLKKILHDTDLESIEXCYMEMXTVXXNLEXXLNTVLMQXILWAXEN

SEQ ID NO: 190706 - protein, 134 aa, Triticum aestivum
  unsure (1)..(134): unsure at all Xaa locations
  Clone ID: PAT_TA_85124.pep
MDPTAPSPAPPAGDGAQPSDQNRQRPRSALRGALGVAFPIAVSFLFSFLVGLAGLALGXLSSTASVSMPSTCRILSKXVDLRSSKVCELGLLNYRAKHVFYHXSKRRFRCHDDYYWASILQVEYTEYFLGNYLM

SEQ ID NO: 190707 - protein, 84 aa, Triticum aestivum
  Clone ID: PAT_TA_85125.pep
STRMPLLMRRRNMRTRRPSKTSKGGLGRHICTLVSFHSGACLWFACCIRSSYAVCSSTFVRSMLYATTKTLFHLHRLICQPWHM

SEQ ID NO: 190708 - protein, 143 aa, Triticum aestivum
  unsure (1)..(143): unsure at all Xaa locations
  Clone ID: PAT_TA_85126.pep
VERPLDLLGRPLHRRRPGCHLPPGDHQGHPVQEQVLSCRGCAETCGECIVCPRLVSLLNLPSLFPSRLLTAALLCYLNPELRVLLYRAVCMFFFLPSVFVARVPSPFMRWDXGKKGQDIMWETWVKTISWDFSSKVGXIQNFL

SEQ ID NO: 190709 - protein, 119 aa, Triticum aestivum
  unsure (1)..(119): unsure at all Xaa locations
  Clone ID: PAT_TA_85127.pep
HPWVLFYTDCPQKAEFSNLWGTNKTAAPMIHQEIVRFGYCESSSSKSSSDNSEERDECGIVDALXTAIXQVRXSEPXRSRLXSLPNGLLPPSRNISEHEEDEPCVVXNLDLPTPIPMHV

SEQ ID NO: 190710 - protein, 114 aa, Triticum aestivum
  unsure (1)..(114): unsure at all Xaa locations
  Clone ID: PAT_TA_85128.pep
GGLTSSQVREAYQRLGQTEQLRESLRRQVVQNTRNLFRAVNTDVETVQARRQSIISNQSALEATEIGYQVGTRNIVXVLDAQRQLYSAVXXYNXAXYDYILKNLRLKQXXGTST

SEQ ID NO: 190711 - protein, 117 aa, Triticum aestivum
  Clone ID: PAT_TA_85129.pep
ELSSAPRPPLASRSRSAVSVAGRRGDMASTCFRAAARVASAAGRSAAATRSAPSAARAAAAAHRASSFSRMPVELGCCAGLSLLPLHSAVAAARLTSRLSTASSCRALSQEMGLSVR

SEQ ID NO: 190712 - protein, 103 aa, Triticum aestivum
  unsure (1)..(103): unsure at all Xaa locations
  Clone ID: PAT_TA_85130.pep
VGGLLLPILGALPDALLVLVSGLSGSKEEAQSQVLIGMGLLAGSTVFLLTLLWGTCVVVGKCDLGPNREAVDXQDTKGFSLXGTGITTDVQTSYAXRFMGLSV

SEQ ID NO: 190713 - protein, 143 aa, Triticum aestivum
  unsure (1)..(143): unsure at all Xaa locations
  Clone ID: PAT_TA_85131.pep
GLGFDFRATENSSRKRKKNHPSIRQRERERSGRTGGGVQEGEVGXGXVXRVXXXSSXLRRTIGAGDPXAHXPVXWWXSLXDXVGMXVSRPMGGXGRXSLXXXCXSXPDXSXPXPRXXXLXSCLSFXXILNCXGTXGIXXCYPR

SEQ ID NO: 190714 - protein, 84 aa, Triticum aestivum
  unsure (1)..(84): unsure at all Xaa locations
  Clone ID: PAT_TA_85132.pep
PNHPMLDLDRRGXLSXDKRISLPSSXSXYXCWXVCXGXXQXIELXXDRXRVPRRTXXNRVRQXPDXXXXGSKXSPMKGKASDSP

SEQ ID NO: 190715 - protein, 126 aa, Triticum aestivum
  unsure (1)..(126): unsure at all Xaa locations
  Clone ID: PAT_TA_85133.pep
EVILYPQAIFKDPFRRGNNILVMCDCYTPAGEPIPTNKRYNAAKIFSSPEVAAEEPWYGIEQEYTLLQXKDTNWPLGWPIGGFPGPQGPYYCGIXRRKSFGRDIVDAHYKPACYAGINIKWHQTGR

SEQ ID NO: 190716 - protein, 60 aa, Triticum aestivum
  Clone ID: PAT_TA_85134.pep
SCILYEHFTPPYEHIYCRLPYRLNLNQFSLWEYDFCQVIPSFKYYLDNRKHAYSSNHISL

SEQ ID NO: 190717 - protein, 123 aa, Triticum aestivum
  unsure (1)..(123): unsure at all Xaa locations
  Clone ID: PAT_TA_85135.pep
FGSTGGIERYPNDSFDRYWQPFPDDKHAVSSTQNVTSADFWNLPPPDVFNTAFIAXQDAPLVLQWPPVPLQNDSYYVALYFADTLPDNXRTFDVYXNDYLFFKDLNVTSAGXLSLEHNGSLKA

SEQ ID NO: 190718 - protein, 120 aa, Triticum aestivum
  unsure (1)..(120): unsure at all Xaa locations
  Clone ID: PAT_TA_85136.pep
MALSATLRISLSVAFFGVLAFVLGVIAENKKPASGTPILGKDVVICTFPSDPTLAMGSLSIVALVVTAXRXHVAIXFPILRASHSXXGALFSKAQLDXVLGVAXLSQTLVLKFPGGKFQR

SEQ ID NO: 190719 - protein, 128 aa, Triticum aestivum
  Clone ID: PAT_TA_85137.pep
SMNQVAEGVSTAGAVIALAQKYNVKLPVLTAVARIIDNELTPKRAVMELMNLPQCHSGCPSSIRRWQGASGFQDDASRSDVGANVYFPGIQYKLINSSRAHNKHWHYSIPFTVLPTPKTSSLAFHIPT

SEQ ID NO: 190720 - protein, 166 aa, Triticum aestivum
  unsure (1)..(166): unsure at all Xaa locations
  Clone ID: PAT_TA_85138.pep
LRWASYKENPLCPQCKHPFEFLSVHRSLDGCLHDYLFEESVCLLLRAAWFEPLIVEAHEEALEEEEFXHQQYQYDDDEDDLDEESYYMNRSPSIRIGNRRWGXDNGXIKGKAGKEARXVNTDXVXGHPRXXKKKEKPNFGSPVRFGPRIPEGKRGKTERNAKTLTS

SEQ ID NO: 190721 - protein, 64 aa, Triticum aestivum
  Clone ID: PAT_TA_85139.pep
ACRSPEAEVRLDMFSSAAQLLLLVLELLAKSLSIISSIDRSSCLSFCSFPGDAHLYQLAACFCG

SEQ ID NO: 190722 - protein, 81 aa, Triticum aestivum
  unsure (1)..(81): unsure at all Xaa locations
  Clone ID: PAT_TA_85140.pep
NLWFVVKRKKKKQVQFLTKRRVEGGGEGATALAARLEERQPHQLVPLPXAPPREHPAPSRQXRRPQLPAEGTRRPLQXXGE

SEQ ID NO: 190723 - protein, 94 aa, Triticum aestivum
  unsure (1)..(94): unsure at all Xaa locations
  Clone ID: PAT_TA_85141.pep
MGTRXVALLLLAAVLLLQALLLASSEGLVRVALKKLPVDQNGRVAARLSAEERQRLLLRGANALGSSGDDDSDVIALKNYMNAQYFGKXRVGRR

SEQ ID NO: 190724 - protein, 87 aa, Triticum aestivum
  Clone ID: PAT_TA_85142.pep
MQCTKGGSRHREVRGDWGDTRSVRCDELAEQWNQLPSHTHHQASRKDESTTYTTILLIAERSAAAVVCVGGESTQAQHLLRVLFAPF

SEQ ID NO: 190725 - protein, 106 aa, Triticum aestivum
  unsure (1)..(106): unsure at all Xaa locations
  Clone ID: PAT_TA_85143.pep
MSRGGSAGGGQSSLGYLFGDGEPAKPAAAPAAKPAPAEKPAPAAADVAKQIPAGIPGSRANNYYRADGQNTGNFLTDVXXTKVXAAPGXXXSLGXXLXGXVIRRGP

SEQ ID NO: 190726 - protein, 140 aa, Triticum aestivum
  unsure (1)..(140): unsure at all Xaa locations
  Clone ID: PAT_TA_85144.pep
VVPRGPVALLGLGAGTAAHMMLEVWPWIQLIGWEIDPTIIELSRDYFGMSNLEKTTXLXGSLSVRIXDALSPSTTVXXGLPGXVVELISXMGKVLPXLQEXRKLWVXIAKKPXPKWXXQGKXGGGPPSPCVRFPLNKTRA

SEQ ID NO: 190727 - protein, 136 aa, Triticum aestivum
  unsure (1)..(136): unsure at all Xaa locations
  Clone ID: PAT_TA_85145.pep
MARRAASSLVSRCLLARAPAGAPPAAPSAPRRTVPADGMHRLLPGVLXRFSTAAAVEEPSRXSVHVNYTKXLINGNXVESAXXKTFPTPGPXXREXVLLKLAEGDAXDINRAXVTAVXKAFDEGQWPXITAYKXPV

SEQ ID NO: 190728 - protein, 170 aa, Triticum aestivum
  unsure (1)..(170): unsure at all Xaa locations
  Clone ID: PAT_TA_85146.pep
ADDFFKAAKLDQPRDTTKSKVGSNVTLINVMQLPGLNTLGISLARIDYAPLGQNPPHTHPRATEILTVLEGTLYVGFVTSNQADRSNKLFAKVLNKGDVFVXPQGLIHFQFNPVHDKPXAIALAAXSXQNPGAITIANAXFGLKPLXRVIXTKALRAKRXIDWLNQFWXK

SEQ ID NO: 190729 - protein, 137 aa, Triticum aestivum
  unsure (1)..(137): unsure at all Xaa locations
  Clone ID: PAT_TA_85147.pep
WHWVGSTPLHTVTRATARRGAARGASAEREQATAVRRAGHGAAPCFAPSPVRSRLTQVHASTYGILVWDQKRTQQQQRRKARAMDGDAGPEQHGCVHYRRGCXIRXPFSGKVFGSRNCQNETKXXWRXRPTXQRXSL

SEQ ID NO: 190730 - protein, 93 aa, Triticum aestivum
  unsure (1)..(93): unsure at all Xaa locations
  Clone ID: PAT_TA_85148.pep
HLCSLASLSILLRGRGAGAVGHHRPRTPLPLPFDPPPPPSSLLPPLSPLLVFHSLHFAASSPLLMLVGSYDPPSAAGFLIIPGQRKRXPGEHS

SEQ ID NO: 190731 - protein, 110 aa, Triticum aestivum
  unsure (1)..(110): unsure at all Xaa locations
  Clone ID: PAT_TA_85149.pep
PGSXWGSXKAVLXRPFLKASXXSXXXGXXPXGTXAWPAXEEGXXPAPEPGALKXTXPGXXVNXRXEANLXXPCLNYXLIRDLVSIWRVDLCTEASELAAVPTTTARGWDL

SEQ ID NO: 190732 - protein, 59 aa, Triticum aestivum
  Clone ID: PAT_TA_85150.pep
VEAAAHCAFSLLAMYLLRAAGILLPLCVVMRLIRIVQSGQEQQYGLQLLEHQRRNVSTI

SEQ ID NO: 190733 - protein, 59 aa, Triticum aestivum
  Clone ID: PAT_TA_85151.pep
QVNYADSSAADQIIGTRFNRRGKNARVLEERERRPTWQRLSYNGLTDLLIDLAVAGVVE

SEQ ID NO: 190734 - protein, 90 aa, Triticum aestivum
  unsure (1)..(90): unsure at all Xaa locations
  Clone ID: PAT_TA_85152.pep
MDHAAEAQRTDLMTITRHVLNEQXSRHPESRGDFTILLSHIVLGCXFVAAAVNKGGXQVIGLAGETXQGEEQKKLDVCQRVFVKXLVKSX

SEQ ID NO: 190735 - protein, 164 aa, Triticum aestivum
  unsure (1)..(164): unsure at all Xaa locations
  Clone ID: PAT_TA_85153.pep
RPVYYVSTVLTPCKSRYPHYQKIAYVVFMASRKLRHHFQECSIIVASEVPLNDIIKNRDAIGRIAKWAIELLPFDITYKPWRPIKSQVLXADFRRRMGRRPSSLKSTTHIQTGIMHFDGPKCWXDWGAGVVLTSPTGDISQYVLQIMXMDSNNATEYEASYMSG

SEQ ID NO: 190736 - protein, 42 aa, Triticum aestivum
  Clone ID: PAT_TA_85154.pep
KNGVEEVLGLGELNDFEKKGLESLKVELKSSIDKGIKFAHGS

SEQ ID NO: 190737 - protein, 102 aa, Triticum aestivum
  Clone ID: PAT_TA_85155.pep
MSMLTSILGRKHQPPPQQQQQQKGGGARTGTGAGAGTEAAAVEPVSIDIAEQGPLVDAITLAAFAAPALGLPPFATASMDWKETPTAHVFMADLPGLRRDEV

SEQ ID NO: 190738 - protein, 80 aa, Triticum aestivum
  Clone ID: PAT_TA_85156.pep
LGMVELLLQYGANVNPTDSRGRTPLHHSIMKGRHVYAKLLLSRGADSQAADRDGRTALQYAIDSGTIEDEEILVLLRGPK

SEQ ID NO: 190739 - protein, 41 aa, Triticum aestivum
  Clone ID: PAT_TA_85157.pep
PPPEIRDAVTYTEHARRKTVTAMDVVYALKRQGRTLYGFGG

SEQ ID NO: 190740 - protein, 74 aa, Triticum aestivum
  unsure (1)..(74): unsure at all Xaa locations
  Clone ID: PAT_TA_85158.pep
FPSEXLEPCTYNEQRYGRGEFSYRSDYGARVGGRVAHYTEVMLAISGSTTLGTSQWTWCPGTISGRCYGKVSSW

SEQ ID NO: 190741 - protein, 92 aa, Triticum aestivum
  unsure (1)..(92): unsure at all Xaa locations
  Clone ID: PAT_TA_85159.pep
MXFLPPNRRRLPPPLGFPAIPVSVSALLLPLISSSSASESLDPHPWPLFQGWLEDEAEARDRRERERLTRQFLRLLIGVNMSHPYRPDDGVL

SEQ ID NO: 190742 - protein, 173 aa, Triticum aestivum
  unsure (1)..(173): unsure at all Xaa locations
  Clone ID: PAT_TA_85160.pep
GTAGRGVAMDMDRDSVECLSLPDAAMDVDNVDGHPHHGHLGLPLHPAHLPSSGAGRAFPKVNAGGGGAGPAVAGAAGAAGAGGGPPATSVHELLECPVCTNSMFPPIHQCQNGHTCVRHARPRVHNRCPTCRQXLGDIKCLALGKVAESXELPCXYCSLSCXEIFPYYSKIKH

SEQ ID NO: 190743 - protein, 84 aa, Triticum aestivum
  Clone ID: PAT_TA_85161.pep
DIIFRHAPLPKHREAVLTLVLPDTGEGFSLRSFTSSSETTLMFRLSPFDLISVPEAVLRVTKFSVLECFSADYALNMTSDEGAL

SEQ ID NO: 190744 - protein, 110 aa, Triticum aestivum
  unsure (1)..(110): unsure at all Xaa locations
  Clone ID: PAT_TA_85162.pep
TARRCAKNRATSCPRSAARRRPNSSGLVSLDLTLTVAAAAAAESSIPTTSNSGGTPADAAAVARERSRVLTCNYXNAVLQLQGLGGHKNRTGRERXWPATCGHPGALRYX

SEQ ID NO: 190745 - protein, 89 aa, Triticum aestivum
  Clone ID: PAT_TA_85163.pep
GHLILTVRLLNDVAVLNKCELLVMFNKKHVLRCNVDGKFLGVVNIGKSHYCMLLTQHRLQESIVPIPGHDMMQEKPRSPHSPQGMSEWS

SEQ ID NO: 190746 - protein, 69 aa, Triticum aestivum
  Clone ID: PAT_TA_85164.pep
KIFRFRSVLDLLLHAHFFYNALRARPLLRVGENTPHALRFLLAKHNFYRYITCPYNDNIVMHLGVTMSF

SEQ ID NO: 190747 - protein, 82 aa, Triticum aestivum
  unsure (1)..(82): unsure at all Xaa locations
  Clone ID: PAT_TA_85165.pep
MGQCPCFGSAKAAEQERRAEADRRESQDARAKAAEAAQRRXRQQDYEKSAAGRAAKAQMKAMKESKASNQGGEPVLKWQMGS

SEQ ID NO: 190748 - protein, 81 aa, Triticum aestivum
  unsure (1)..(81): unsure at all Xaa locations
  Clone ID: PAT_TA_85166.pep
MAEESGRPLPKFGEWDVNDPASADGFTVIFNKARDEKKGGNGQDTDSPSKDPRTERVXESYAAKPSTKKWFCCVTASPTQS

SEQ ID NO: 190749 - protein, 54 aa, Triticum aestivum
  unsure (1)..(54): unsure at all Xaa locations
  Clone ID: PAT_TA_85167.pep
TGXSHHILLMTRTCIYKTTQKHSLCPKINQFLRVILNQTIFKFDQIHKKSMALN

SEQ ID NO: 190750 - protein, 108 aa, Triticum aestivum
  Clone ID: PAT_TA_85168.pep
FCCSTRSFWCPKLVILLEYCTGHLMQGAKTGVRSAVAFKEVCAGCLHIFNSGSEEQIRSIYGLGNMHLLCWRTLSCYLFIDTSDLQEGGHSSLPLFAHCLHLFVLLVD

SEQ ID NO: 190751 - protein, 53 aa, Triticum aestivum
  Clone ID: PAT_TA_85169.pep
FSANRFRVQECHKSLWPTSFLYHGIVCHVSSLQIITNYMRRAAGKEFSFQLLR

SEQ ID NO: 190752 - protein, 62 aa, Triticum aestivum
  Clone ID: PAT_TA_85170.pep
GTYVINKQTPNKQIWLSSPVSGPSRFDWDATANGWIYKRTGVNLVRLLEKEIGELCGTPVEL

SEQ ID NO: 190753 - protein, 98 aa, Triticum aestivum
  Clone ID: PAT_TA_85171.pep
PPKAAGNEVIRQVQYGDPRDISNYGNLLGIVGDLTGNAEFSRYINIGYESAVWGAALSEAAGYGQYQYFGDVKQYIDPEVYRQAVIYSLPVIATSGSL

SEQ ID NO: 190754 - protein, 78 aa, Triticum aestivum
  Clone ID: PAT_TA_85172.pep
NHSRAETEEKTPYICSSGYCATQRSITTQHKYDWSASCPVEAQHVRWKLSHGHDPTESTGSDFSCFLHLSTWYCFSSL

SEQ ID NO: 190755 - protein, 153 aa, Triticum aestivum
  Clone ID: PAT_TA_85173.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGACRPAPRRRCGSGVAAIRKLFVWGKFARYWNCSAVCSHGVFVRRNVVIAG

SEQ ID NO: 190756 - protein, 123 aa, Triticum aestivum
  unsure (1)..(123): unsure at all Xaa locations
  Clone ID: PAT_TA_85174.pep
VHQEISTGGLQGLFPAGHGRWQQQLLLLPPCRRPLQHHQDSPTPPRQLPPPPHRPPPSGTARRRRRRRAITIPAERIKKPHCKSAGKLAFSPRPLPLSGRCDFFSFAPPAGVVVXCTDRLDPR

SEQ ID NO: 190757 - protein, 140 aa, Triticum aestivum
  unsure (1)..(140): unsure at all Xaa locations
  Clone ID: PAT_TA_85175.pep
MGRLDGKVAIVTGAASGFGQGIAEHFAQEGAKVLICDINEEAGQKVAATSGSFEFQTMNVTKAADWQSAVEKAVQLWGHLDIXVNNAGTSYENKSTNLVTEEEFDKVMSVNVKSVFSGSNAFTVSQKQQKHDQHRLRWRQ

SEQ ID NO: 190758 - protein, 137 aa, Triticum aestivum
  unsure (1)..(137): unsure at all Xaa locations
  Clone ID: PAT_TA_85176.pep
MARTKQTARKSTGGKAPRKQLATKAARKSAPATGGVKKPHRFRPGTVALREIRKYQKSTELLIRKLPFQXRLVREIAQXDFKTDLRFKSSAVAALQEAAEAYLVGLFEDTNLCAIHAKRVTIMPRTSTRRRIRGEXA

SEQ ID NO: 190759 - protein, 138 aa, Triticum aestivum
  Clone ID: PAT_TA_85177.pep
SDEDDSDDSDEGEGLSPDEGDDDSSDEDDTSDDDEEETPTPKKPEAGKKRGAENALKTPLSDKKAKVATPPAQKTGGKKGATHVATPHPAKGKTPANNDKSTEKSPKSGGSVPCKSCSKTFNSEMALQAHSKAKHGAK

SEQ ID NO: 190760 - protein, 108 aa, Triticum aestivum
  Clone ID: PAT_TA_85178.pep
IINHRSQQLVTCKPYTSKINRAQAYLSTSILNSVEVIYTLEMVFEKQKNVETNRCYKSIVGDSQNFGGVIRLMVRHHCMLISPDDTALSPNGRKTSASSSSLSSRSFA

SEQ ID NO: 190761 - protein, 164 aa, Triticum aestivum
  unsure (1)..(164): unsure at all Xaa locations
  Clone ID: PAT_TA_85179.pep
KTKIYFVLEHVKGGELFNKIQRGRLKEDAARKYFQQLICAVDFCHSRGVYHRDLKPENLLLDENSNLKVSDFGLSALAECHRQDGLLHTTCGTPAYVAPEVINRKGYDGAKADIWSCGVILFVLLAXGYLPFHDKNLMDMLGKIXKADFKCPSWVSRCSGFAKD

SEQ ID NO: 190762 - protein, 102 aa, Triticum aestivum
  Clone ID: PAT_TA_85180.pep
MSYYGQQQPPVSAPPAQGYPGKDAYPPPGYPPAGYPPPAQGYPPQGYPPQGYPPQQGYPQQGYPPQYSQPPPPPRQQQSSGPSFMEGCLAALCCCCLLEACF

SEQ ID NO: 190763 - protein, 62 aa, Triticum aestivum
  unsure (1)..(62): unsure at all Xaa locations
  Clone ID: PAT_TA_85181.pep
QSXXYHQSRRGDHRRRPCXXXQAXGPMSAPAXDXELEXEVXLLXXSQXGDXGCXRPRGPCAS

SEQ ID NO: 190764 - protein, 49 aa, Triticum aestivum
  Clone ID: PAT_TA_85182.pep
IEFIKKYLHALHWEAVAAADAEPSSESEENEMILVIRKKLWLPEAGSHT

SEQ ID NO: 190765 - protein, 141 aa, Triticum aestivum
  unsure (1)..(141): unsure at all Xaa locations
  Clone ID: PAT_TA_85183.pep
MEAKMGRFFESVSNFFTGGDHIPWCDRDLIAGCEGELVNAVNEEQRNESLMRLSWALVHSRQTDDVNRGISMLQASLDNSASPLQTREKLYLLAVGFYRIGDYSKSRQLADRCLEIQADWRQAISLKKXIEDKIAKDGLIG

SEQ ID NO: 190766 - protein, 103 aa, Triticum aestivum
  Clone ID: PAT_TA_85184.pep
VALTVEKSVASQRGNYLPADQYLNHAEKSDMTIVEAFKRMQVVQHEEPEDVAEENGELDQQAFEETEMQNTDDDADEPEETVLVNGNKGEEHQGTDNEGALSA

SEQ ID NO: 190767 - protein, 72 aa, Triticum aestivum
  Clone ID: PAT_TA_85185.pep
IINRSSDENVLYMKVAQNNETNPNTRSIHPPHVPIIANVEPFPSGHLSDRRPGTGKTFRMFSPFRQYRLTLR

SEQ ID NO: 190768 - protein, 105 aa, Triticum aestivum
  unsure (1)..(105): unsure at all Xaa locations
  Clone ID: PAT_TA_85186.pep
AIDEKGDIQQPFLPIHREAPAFVEQVQSSKFLLLDDNQSAEKEDYEEKLKEVEAVCNPIVSAVYQRSGGAPGGDADGGVDDDHDELXMVVDGGGDVECREPSQIL

SEQ ID NO: 190769 - protein, 92 aa, Triticum aestivum
  Clone ID: PAT_TA_85187.pep
WRVEIAEKLTRLLHWLMISVLRVGSLCTMAWSIASRSNFRILCCTVPLWTSCGPVGSLQTHCDPGPRGQNQTVQRLLLGPSNIDCILSTSDS

SEQ ID NO: 190770 - protein, 128 aa, Triticum aestivum
  Clone ID: PAT_TA_85188.pep
PQLEPLAEAQRMLVGGLQHTSTQAEDALSQGMEKLQQNLAEILTAEADPFGAPDAYMLQMATAVEKLKELVNFVTQADHLRLMTLQQMHKILTTRQAARGLLALGDYFQRLRTLSSLWAARPREAAIS

SEQ ID NO: 190771 - protein, 127 aa, Triticum aestivum
  unsure (1)..(127): unsure at all Xaa locations
  Clone ID: PAT_TA_85189.pep
MSTNSRANSRANFNNEIHDIGTAVHNSSSLPPAYYDRSLADMFPPHLLKKVVSEVVSTFLLVFVTCGAAGIYGSDKDRISQLGQSVAGGXIVTVMIYAVXHISXAHMNPXVTLAFAVFAIPWIKSRS

SEQ ID NO: 190772 - protein, 166 aa, Triticum aestivum
  unsure (1)..(166): unsure at all Xaa locations
  Clone ID: PAT_TA_85190.pep
PPPWSQWAPSGQPVGVPPPTEHPGGVWPPHTPTAPGTPGSAYPPGTPGSPSTPTTPGTPGSTFPPTTPGAPGSLPSTPTTPGTPGSTFPPTXPGAPGSLPPTPTTPGSTFPPTTPGAPRSLPTTPGYNLRPQATTAAARSTPAIGTGTTGSTFRPCTGGYRRRSPP

SEQ ID NO: 190773 - protein, 111 aa, Triticum aestivum
  unsure (1)..(111): unsure at all Xaa locations
  Clone ID: PAT_TA_85191.pep
KQGTDWEGGHFPLTLHFDEDYPSRPPHCKFPAGFFHVNVYNTGSVCLSILGDAWKPSITVRQTLIGIQDLLDNPNPASPAQNLSYVLFTQNMPEYASRVXRQQAKRYPSLV

SEQ ID NO: 190774 - protein, 116 aa, Triticum aestivum
  unsure (1)..(116): unsure at all Xaa locations
  Clone ID: PAT_TA_85192.pep
MKKGAMASLVPLVVALLLCPSSSLAMASGAGPAQWGKKLDPHFYDQSCPHAQHIVASIVGXAHQQGPRMAASLLRLNFXQLLLXGCDACCCWTTTGHRERKRPTQTGSPRASSHHK

SEQ ID NO: 190775 - protein, 159 aa, Triticum aestivum
  unsure (1)..(159): unsure at all Xaa locations
  Clone ID: PAT_TA_85193.pep
VSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQXVQCVSFIAFKPPXCXDPARAKQLTHTGHI

SEQ ID NO: 190776 - protein, 105 aa, Triticum aestivum
  Clone ID: PAT_TA_85194.pep
FPSSSPSSRPINPPVLVHSTSNQNRLRPLETFDLIDLCRYLYSLAIHNSQALLPLIGSYTRASPAIAPAREPQTDSQPSKRSVLASPVKFCYSLSARLITPKGNT

SEQ ID NO: 190777 - protein, 199 aa, Triticum aestivum
  unsure (1)..(199): unsure at all Xaa locations
  Clone ID: PAT_TA_85195.pep
FCLEQGVHREERVVLXWRAPHQIAXWXLAPRNPAHHQXFPXKRIRRGHRPPPPRAGTESPGEQQXRPQSSRSPLQSEPVESKSSNCPRAPAASQETKSPRTQQGRGSHSRSNLAPKGLLFFQGPGGVGRGAARGERRKASGCGSPLLSPPLNNEAQSKRGDGERGKGRRGIRRIKIEAFAALRCAALLCVAPRPRLAGS

SEQ ID NO: 190778 - protein, 170 aa, Triticum aestivum
  unsure (1)..(170): unsure at all Xaa locations
  Clone ID: PAT_TA_85196.pep
MGQAWGNLQDRLQGRRWKEHQVRKITDKVFDRLTEDAQKRDKEALRFEEVYIAVLCVYNDINKYLPGPHHDPPSKEKLRAMMEEYDVNLXGLLDREEFAXFIRKLTADSLCSISVKLLITLVAAPALAMATNRATEGRPGVGXVVPRCQRALLRITWALCCSITASVTPL

SEQ ID NO: 190779 - protein, 83 aa, Triticum aestivum
  Clone ID: PAT_TA_85197.pep
MPSPMVPQFAGGAPESHAPSHQAHLAHIKAHAFQNPARKTEINCDATLKSLFGGRDKVGMLEINRLLERSLPEELASSSPWCQ

SEQ ID NO: 190780 - protein, 126 aa, Triticum aestivum
  unsure (1)..(126): unsure at all Xaa locations
  Clone ID: PAT_TA_85198.pep
MSTDVPMSPELEQVDGEIQDIFRALQNGFQKMDKIKDSSRQSKQLEDLTAKMRECKRLIKEFDRILKDEEKKNTLMSTSKLNDKKHXMIKELNSYVTLRKTYQSSLGNKRIELXDTGNDKWLRELN

SEQ ID NO: 190781 - protein, 105 aa, Triticum aestivum
  Clone ID: PAT_TA_85199.pep
EQKWLKNQAQQRRSRKENEETERGKKVIEPIAPISYCYTATSGQDASGQASREDQISCPHPTPSSSDSSSSSFPPSPSSRSSSCCSCNAAIATSNASSHNGGLWW

SEQ ID NO: 190782 - protein, 117 aa, Triticum aestivum
  Clone ID: PAT_TA_85200.pep
KYYSDHLTNSVVSLSLAQINTLNKKKIFTVLSQFWCLSVYVSGTENKCLFSETRENIKPLKVSPFTGQTVSKYFNHFRIKYSSTQPWKGLSEHKARNGCSHQSNHQTRTQQLAPHSR

SEQ ID NO: 190783 - protein, 101 aa, Triticum aestivum
  Clone ID: PAT_TA_85201.pep
GPDLGAQPLGRAQGVYVASSADGSSQMMAFTAMMEGGEYGDTINFFGVYKVGTPLCRLSITGGTGKFKGACGFAEVRPLIASGQHVTDGAETLLRITVHLA

SEQ ID NO: 190784 - protein, 76 aa, Triticum aestivum
  Clone ID: PAT_TA_85202.pep
SMVGKVAISIQSYRERTGEKSGPLGDATAVLRHKPHGVVAVFGPYNFPGHLPNGHIVPALLAGNCVLFKPSELTPK

SEQ ID NO: 190785 - protein, 76 aa, Triticum aestivum
  Clone ID: PAT_TA_85203.pep
NSPCVEYFKVKAIRIEPGLRVGSSTKGGIIDSDGEVLARGDGSHSRAGDEPGHLMAYGPPIQLTVDQGLATIFSPR

SEQ ID NO: 190786 - protein, 163 aa, Triticum aestivum
  unsure (1)..(163): unsure at all Xaa locations
  Clone ID: PAT_TA_85204.pep
WQSFRRKAPVYLSSVFSRYYFIRNDHLLVYFYAGGLLQEKXVLYRGCTFGCHAASRTRVSQSSLYQCAGRLARRHRLTTSWTTRPSTLAAGSCVRAGLQHGRQLARPHRFTMTRPSHLSASTVDPPVIDVSFTVVIINSAVDNFWHDISGRQKISGLKRRISV

SEQ ID NO: 190787 - protein, 197 aa, Triticum aestivum
  unsure (1)..(197): unsure at all Xaa locations
  Clone ID: PAT_TA_85205.pep
VEVEVEVEVAVEVPRMGLEQPDVAPSLSTDMIQQFVPNIRSGSFADIGPRRYMEDEHIRIDDLSAHLGSMLVCPLPSAFYGVFDGHGGPDAAAYMKRHAMRFLFEESEFPQASQVDEVYLQVXVKSCVRKAFLQADLALADDLDINRSSGNTXLTAXSVWKELVVANTGXCRACCPRSGDGDSRDNARTVEPRGRRR

SEQ ID NO: 190788 - protein, 138 aa, Triticum aestivum
  unsure (1)..(138): unsure at all Xaa locations
  Clone ID: PAT_TA_85206.pep
MGSDTETEKKASVALMSIAKPLAGKKLCKRTLKLVRRASEAKCLKRGVKEVVKSIRRGNKGLCVIAGNISPIDVITHVPILCEEANVPYVYVPSKEDLATAXTTKRPTCCVLXVLTKPNKGELSGEVKDKLKSDYDKL

SEQ ID NO: 190789 - protein, 141 aa, Triticum aestivum
  Clone ID: PAT_TA_85207.pep
DELTSLKDYVTRMKEGQNDIYYITGESKKAVENSPFLEKLKKRGYEVLYMVDAIDEYAVGQLKEFEGKHAMRHLVDLLHLAFTSVVLKLRHLSLCLNRLVLIDAQTEFEHAVDPVAEGVGVIQAEAGGQESSLEQQHHILD

SEQ ID NO: 190790 - protein, 63 aa, Triticum aestivum
  unsure (1)..(63): unsure at all Xaa locations
  Clone ID: PAT_TA_85208.pep
TWCSPXLKLFGFHVSKEEHXLCPETTTEAETTEPEEAPXCGNNGGGSDXXXSXTTTXXXATEA

SEQ ID NO: 190791 - protein, 51 aa, Triticum aestivum
  Clone ID: PAT_TA_85209.pep
IKHLKPNHSLHSTILYKGLDKDYSYIMSRMLKYTRNYHAFHKHANSQFCPN

SEQ ID NO: 190792 - protein, 59 aa, Triticum aestivum
  Clone ID: PAT_TA_85210.pep
QHYQHEVSRVNLGFKNPGIEYLLTKWHHRMLSRMVARIITPGTHSIARLLDDSLRHLVS

SEQ ID NO: 190793 - protein, 100 aa, Triticum aestivum
  unsure (1)..(100): unsure at all Xaa locations
  Clone ID: PAT_TA_85211.pep
MVMATAVLDTYNHNVNHPHIALKKPLLQESLEQYGVITPKQLIGQALHQRVGGIDHEMCEPGDEDTFFVADXGXVYXQHLRWEXRSPRVRPXYAVKCNPI

SEQ ID NO: 190794 - protein, 92 aa, Triticum aestivum
  unsure (1)..(92): unsure at all Xaa locations
  Clone ID: PAT_TA_85212.pep
KADYRSRQLCWGTRSSRQEDYCRKAQWDLYSIHPGXSRAGGAATXDXXVSGVXGXPGSPPPXPXQDPPPXPAXLXGLVXXHIXXHRTFLLSD

SEQ ID NO: 190795 - protein, 198 aa, Triticum aestivum
  unsure (1)..(198): unsure at all Xaa locations
  Clone ID: PAT_TA_85213.pep
EAPANSSVTDVAPTSVSEIRSFLGLAXYYRDSSRIXPGLQSPMTELLKKDTKFKWTEDCEASFKELKKRLTTAPVLTLPDIHKEFQVYCDASRLGLGCVLMQDRRVVSYASRQLKPHELNYATHDLELAAVVHALKTWRHYLIGNHCDVYTDHKSLKYIFTQKELNLRQRRWLELIKDYDMKLHYHPGKSNVVADALS

SEQ ID NO: 190796 - protein, 109 aa, Triticum aestivum
  unsure (1)..(109): unsure at all Xaa locations
  Clone ID: PAT_TA_85214.pep
MSSEASSVVVADENGAAETVGVGRYVEMEKDQESSAAKSRLSGLLWHGGSAYDAWFSCASNQVAQVLLTLPYSFSQLGMLSGILFQLLYGLMGSWTAYXISVLYVEYGK

SEQ ID NO: 190797 - protein, 112 aa, Triticum aestivum
  unsure (1)..(112): unsure at all Xaa locations
  Clone ID: PAT_TA_85215.pep
FTMEKMRHVSWSWLNSSPPTRIPCSPTRTTHPGAPPGPRRSPVRGTTTLPSNQGIKFGACEQAVXMVHFLFENFVYKNYRDSFCVWDETIXIMYLKYVHMQCNPGFCAWGFT

SEQ ID NO: 190798 - protein, 78 aa, Triticum aestivum
  Clone ID: PAT_TA_85216.pep
NTGRVGVIKNREKHKGSFETIHVEDSLGHQFATRMGNVFTIGKGNKPWVSLPKGKGIKLSIIEEQRKRDAAAQAAANA

SEQ ID NO: 190799 - protein, 186 aa, Triticum aestivum
  unsure (1)..(186): unsure at all Xaa locations
  Clone ID: PAT_TA_85217.pep
MGTVDKYVGVAGPESGGVDVEWSHHIGRSWMPQKAKEVVPQSLQEVNKGVDQAQWRIPLWGSFGMEISRVLGGGIVPGSLILVGGDPGVGKSSLMLQLASNILEGFKAKESSPVVYVSGEESIEQIGNRADRMSITSSNLYLYSGTDIEDILXKSTLSPRALISIDQTVMSDISGMLVICTVKECT

SEQ ID NO: 190800 - protein, 96 aa, Triticum aestivum
  Clone ID: PAT_TA_85218.pep
SKIILDRETQRSRGFGFVTFSTEEAMRNAIEGMNGKELDGRNITVNEAQSRGGRGGGGGGYGGGRGGGGYGGGGRRDGGGGYGGGGGYGGGGGHGC

SEQ ID NO: 190801 - protein, 76 aa, Triticum aestivum
  Clone ID: PAT_TA_85219.pep
TRISSRDSKREVRRHKGLETSMISMIQLAHHRNIDSLHPLGLDNSAFEIFIKHEFRDNSTMMDHLNDHKIISQNET

SEQ ID NO: 190802 - protein, 144 aa, Triticum aestivum
  Clone ID: PAT_TA_85220.pep
YGPNAERINKGRIMEPVPRPRGRSRSRSPRRRYRDDYRDDYQDRDYRRRSRSQSRDRYARDRYRDRDYRHRSLSRSLSPARRSPSHSRSRSYTPDDYKRRGKDSASPASRSPSRSPPRKTPPSPKRSPVRHNDDRSPRSRSPST

SEQ ID NO: 190803 - protein, 76 aa, Triticum aestivum
  Clone ID: PAT_TA_85221.pep
PVAGNTPLSPNSNSSNISKKHHLMKPEYCNFVAAIMKFSVTVVRKKSPPNDLSSPCTCSVAGANLQNDRCQQTLCL

SEQ ID NO: 190804 - protein, 154 aa, Triticum aestivum
  unsure (1)..(154): unsure at all Xaa locations
  Clone ID: PAT_TA_85222.pep
GGGGGGGGGVGNPKMVMPXPTPQQLQQLQQQLQMKGLKLPPHLLGXNMPAFPAAAPMKDPKSVKFALPEDNFDDYGSEFDXDFDDGFDDDXDDYDDDGLDDDVYGDPDDEAHGCAAGRRGRQERRWRWWERDPGNHRCRGTIKGRLPGWAHLGG

SEQ ID NO: 190805 - protein, 48 aa, Triticum aestivum
  Clone ID: PAT_TA_85223.pep
VLKKLGLPEARNLATVQEMICNVDRNCDGRVDFGEFKNMMQGITVWGA

SEQ ID NO: 190806 - protein, 155 aa, Triticum aestivum
  unsure (1)..(155): unsure at all Xaa locations
  Clone ID: PAT_TA_85224.pep
MAPKAEKKPAAKKPAEEEPAAEKAPAGKKPKAEKRVPAGKSAAKEGGEGKRGKKKGKKSVETYKIYIFKVLKQVHPDIGISSKAMSIMNSFINDIFEKXAAXAAKLARYNKKPTXTSREXQTSVRLVLPGXLAXHAVSXGTXASQVNSASCAAAA

SEQ ID NO: 190807 - protein, 74 aa, Triticum aestivum
  unsure (1)..(74): unsure at all Xaa locations
  Clone ID: PAT_TA_85225.pep
PXXXGFXIIVQRLGKDLIPWVSLALELEQTXRRSAQHTTKXAVRXKRCRSXSSYTRICCTSRAQIHSLPARFKP

SEQ ID NO: 190808 - protein, 72 aa, Triticum aestivum
  Clone ID: PAT_TA_85226.pep
LLAFSLVSLSVPRFSLLIARRLFCCSIGMPETFGRTRGICEGRLAGCVASSLGSSMAGCVRRYIEWIRMNVG

SEQ ID NO: 190809 - protein, 138 aa, Triticum aestivum
  unsure (1)..(138): unsure at all Xaa locations
  Clone ID: PAT_TA_85227.pep
GSLIILVTTSYSQARPTSKLYFSQVLLIMHWDCIYPLTGRHDYSSNSIXRDETHSXHVSRNTLPALCWGLMPIXPLVDXGLVXGRTLILRRXXYXPXKXPXGTXTXRGGARYQFAYMIYTPXRAXLXADGKTXVTTNA

SEQ ID NO: 190810 - protein, 104 aa, Triticum aestivum
  unsure (1)..(104): unsure at all Xaa locations
  Clone ID: PAT_TA_85228.pep
NGSHLVXRCRLVNAIWDRLLMAPLACTSPYIKHFVCKAADQXCFKWKWNXAFAASAVTLWYARYDRTFNGKCWTEXYIRFYAASLXRLWGNRALTQSDKVDLQX

SEQ ID NO: 190811 - protein, 34 aa, Triticum aestivum
  Clone ID: PAT_TA_85229.pep
SINPVNFQKSFRRVLILLVLIVLAMQICSVNLRQ

SEQ ID NO: 190812 - protein, 130 aa, Triticum aestivum
  unsure (1)..(130): unsure at all Xaa locations
  Clone ID: PAT_TA_85230.pep
MKPSKLVAAAAKSNKSMFVSGDDDLPKRDNIGERRRKHELRVLSRVGANSAEDHELPDGDASEEEDHHELPEGGDESEDDIHRDVKRKRTEKLSTKNALYSPTPGVXNIWEEETEGDGKRTFRTNLEDRG

SEQ ID NO: 190813 - protein, 194 aa, Triticum aestivum
  unsure (1)..(194): unsure at all Xaa locations
  Clone ID: PAT_TA_85231.pep
NILLDDKLVAKVSDFGLSKTGPNNVDNTHVSTVVKGSFGYLDPEYFRRQQLTEKSDVYSFGVVLLEVLCARPALSPSLPKEQVSLADWALHCQRKGVLGQXIDPHLQGXVSPQCFLKVPETAEXCVADRSVDRRQWRXLWELDSPATARDAEETARLVTTNTLVSNKSSPLMSRARTTATATHTHSHTLTYGRP

SEQ ID NO: 190814 - protein, 144 aa, Triticum aestivum
  unsure (1)..(144): unsure at all Xaa locations
  Clone ID: PAT_TA_85232.pep
MAPKAEKKPAAKKPAEEEPAAEKTTAGKKPKAEKRVPAGKSAGKEGGEGKRGKKKGKKSVETYKIYIFKVLKQVHPDIGISSKAMSIMNSFIXNDIFEKLAGEAAKSRATTRTHITSREXQTPCARAPRXXAKHAVSXGTRRHN

SEQ ID NO: 190815 - protein, 190 aa, Triticum aestivum
  unsure (1)..(190): unsure at all Xaa locations
  Clone ID: PAT_TA_85233.pep
ELLITELMFNGTFNDLDHHQVASLASCFVPCDKSSEQIRLRNELSRPMMQLQEAARKIAEVQRECKLEVNVEEYVESTCRPYLMDVIYCWSRGATFAEVMEMTDIFEGSVIRLARRLDEFXNQLRTAAEAVGEVNLEKKSRMQVXICSGXHVLNSLYRNNTLQQYHMLPTNLTAVCLNKYCRRKDCVTCP

SEQ ID NO: 190816 - protein, 129 aa, Triticum aestivum
  unsure (1)..(129): unsure at all Xaa locations
  Clone ID: PAT_TA_85234.pep
XVCLFPXESPXNXSAAGIFSXPPLDFXNRGYTLQGGDXAKRFVXSXCLXKRVWHTLAPPRLLCSKLPGGATPLGVLMVFGKIGARGGRGVQGTSTEGREFVQGRGGGSTRRTSREGRRPGKLRGGVPGT

SEQ ID NO: 190817 - protein, 60 aa, Triticum aestivum
  Clone ID: PAT_TA_85235.pep
RYNHNTNKFCWKEGKEVVDDNTNYRGARMVIPIRNSTVILEELKMLMMITTHLSRDLMKM

SEQ ID NO: 190818 - protein, 59 aa, Triticum aestivum
  Clone ID: PAT_TA_85236.pep
GVEAAAWVRVRSPEGGHGGGDGDAGGLGCRPIGDGGEAGVLAMEREVVRRLRHGFRALD

SEQ ID NO: 190819 - protein, 59 aa, Triticum aestivum
  Clone ID: PAT_TA_85237.pep
KKECHPIQPQETWRYNLAANKLTAALKILKSRTQMDGIHSLVIYLKGVPFQLHKNTCTG

SEQ ID NO: 190820 - protein, 86 aa, Triticum aestivum
  Clone ID: PAT_TA_85238.pep
QRCFPTVYVRSLVTSHERWSHNDGQASLEYNPDSENGEQRYIVKTKRASKLAFYLSKIVHPPVPNLLSFTQLPSWRLLPFSCRLHE

SEQ ID NO: 190821 - protein, 91 aa, Triticum aestivum
  unsure (1)..(91): unsure at all Xaa locations
  Clone ID: PAT_TA_85239.pep
LKLNLLGSILSGLAIATTCVGQILTNTIQKRLKVSSTQLLYQSAPYQAAILFASGPFVDQLLTNRSVFAHKYSATVLGFIVLXSCLDAVSC

SEQ ID NO: 190822 - protein, 85 aa, Triticum aestivum
  unsure (1)..(85): unsure at all Xaa locations
  Clone ID: PAT_TA_85240.pep
TTLRLVNXXXLARNWGNPSWMSPLFHSCAWLRSAGEAGCWWGDPGGSRRRLIRARCGADEEGEARRESIHGQATLYAAIWTVAVR

SEQ ID NO: 190823 - protein, 55 aa, Triticum aestivum
  Clone ID: PAT_TA_85241.pep
THLINCLSIISTLLRGVTVFAREDGQMEGTSAVLINATKLRRGGGLGARPWRRRA

SEQ ID NO: 190824 - protein, 64 aa, Triticum aestivum
  Clone ID: PAT_TA_85242.pep
WNETQAMYGDEMTPVFSGGVVYEYTEEDNNYGLVKITGDKLRILGDFNRLKNQFARINWEGGPI

SEQ ID NO: 190825 - protein, 87 aa, Triticum aestivum
  unsure (1)..(87): unsure at all Xaa locations
  Clone ID: PAT_TA_85243.pep
RIDMVENRLVGMKSRGVYETPGGTIMAAAVRELESLTLDRETMQWKDIIALKYAELVYAGRWFDPLRQSXDAFMEKVTATTTGSIDP

SEQ ID NO: 190826 - protein, 94 aa, Triticum aestivum
  Clone ID: PAT_TA_85244.pep
MQPTVSSPRSSPPNGLDMGAMLNPAWPSSPASRLKTALAAGRELDLDLELLALDQYQQKLFDKVSSPRAGWGGGMGSPLPAAAPSTRAVAGLRG

SEQ ID NO: 190827 - protein, 61 aa, Triticum aestivum
  Clone ID: PAT_TA_85245.pep
MAVSFANVNAEAGLKKLDEYLLTRSYITGYQASKDDLAVYSSFLADPSSKYINVARWFNHI

SEQ ID NO: 190828 - protein, 95 aa, Triticum aestivum
  Clone ID: PAT_TA_85246.pep
LVPIRHEATAALSTVRPASVLTPRFLASRFTSSALPHLIFFGMHLCCVVLQGQSSNWVVRRVQASEPLQRRLGSGVFSPSGFRYSDGLWMFRLCI

SEQ ID NO: 190829 - protein, 99 aa, Triticum aestivum
  unsure (1)..(99): unsure at all Xaa locations
  Clone ID: PAT_TA_85247.pep
XCNPXXGPTGNPEXRXXAXKXXRKXSAEGEGGAGRRWRPGKATTQALRRRRRRRGGRPSRGMGTGVSGEMRGRRRGPWVNRGGVEGPKEKVVENLGGSC

SEQ ID NO: 190830 - protein, 112 aa, Triticum aestivum
  unsure (1)..(112): unsure at all Xaa locations
  Clone ID: PAT_TA_85248.pep
MVKLTMIARVTDGLPLSEGLDDSRDLKDADFYKQQAKLLFKNLSRGQHEASRMSIETGPYLFHYIIEGRVCYLTLCDRSYPKKLAFQYLEDLKNEFEKXQWQQIETAARHMH

SEQ ID NO: 190831 - protein, 151 aa, Triticum aestivum
  Clone ID: PAT_TA_85249.pep
CLVAVNSNSVNSSFNIECGDATDANFEKYNLSRGSVAGILTLDTVADYLPRRGPLKQRRTGIAYIANVAVRKEERRKGIAKMLVQEAEARARSWGCRSMALHCDVNNVAALRLYRNQGFKCIRVPEGAKWPEPKIAKGAEYNFMMKLVPKA

SEQ ID NO: 190832 - protein, 151 aa, Triticum aestivum
  Clone ID: PAT_TA_85250.pep
SPAAFSLIAYFSFPTMETAPPQYNAEDAPPSYEDVVKKFTAALGNGKDPEKILDAMASLNLADCKVVCDKNGSKLGPIVGEKDMEKFQLGAEQAASLPVAQEHLKKVANTATRAVKDIEMVFNRLLLKIMEIDKITNRGSCKSLDTSRDIL

SEQ ID NO: 190833 - protein, 107 aa, Triticum aestivum
  Clone ID: PAT_TA_85251.pep
SRYQFYCSNKLVDEKRKPTFNIYTSGLIKRRELATSRLQKAHLTASYIRGDTFMLALGGQVPDTNVHFRQQARSHSRHHHRRRPTRPSCAARRTRRHTARRRKRHSR

SEQ ID NO: 190834 - protein, 125 aa, Triticum aestivum
  Clone ID: PAT_TA_85252.pep
GLDLSGLFEESNKKRESKFTSTNTSSTIISKIEDIAKNLRLNLTKKDGGLLKMEASKPGRKGVMGIDAEVFEVSPNFHLVEIKKTNGDTLEYQKVLNQEMRPALKEIVWAWQGEQSKQKQEQQSC

SEQ ID NO: 190835 - protein, 129 aa, Triticum aestivum
  unsure (1)..(129): unsure at all Xaa locations
  Clone ID: PAT_TA_85253.pep
MAAAKGXGGEFPVGMKVLVVDDDPTCLVVLKRMLLECRYDVTTCPQATRALTMLRENRRGFDVIISDVHMPDMDGFXLLELVGLEMDLXIIMMSAESKNGYCNERIKHGXLTINKTVRMEELKNIWQHV

SEQ ID NO: 190836 - protein, 85 aa, Triticum aestivum
  Clone ID: PAT_TA_85254.pep
KALELYARDAGLGAQEVVAAVECHLPEGLRDAVRRSQQQAGRARAVEWKPHNLAFRYLLAKELVGGSPACSRPLEPVSAPLRAGP

SEQ ID NO: 190837 - protein, 121 aa, Triticum aestivum
  unsure (1)..(121): unsure at all Xaa locations
  Clone ID: PAT_TA_85255.pep
MARLNSKAVVSAVVLAAVVLMMAGREATALSCGQVDSKLAPCVSYVTGKAPSISKECCSGVQGLNGLARSSPDRKIACRCLKSLATSIKSINMDKVSGVPGKCGVSVPFPSACXNNCNNVN

SEQ ID NO: 190838 - protein, 181 aa, Triticum aestivum
  unsure (1)..(181): unsure at all Xaa locations
  Clone ID: PAT_TA_85256.pep
PQQPYGSYPPTSGGYQTGWDQSQNQQSHTTPPGTGYDYYSQQQQPQQQQSAPGTAASTDATSYNYGQPSTYASQGYDSTYTQHSGGQQAYGHDGYSGYQTQGQQQGYSQQTGYDQQGYGASAYGSAANSXQDGSSYGGPGGAPSISGEQTPQLLEATWLSNQRLLLHKLQFRVTPSGYLTL

SEQ ID NO: 190839 - protein, 150 aa, Triticum aestivum
  unsure (1)..(150): unsure at all Xaa locations
  Clone ID: PAT_TA_85257.pep
IVAHILIKALMAMPAPDFSLCLFLIPEHVQMEEQFKVLIVLSHYLETARFSQFWDEAAKNRHISEAVPGFEQAIQSYAIHVLSLTYQKVPRPILVEAINIEGLXLGQFLEYHAANSGWVIEKGGQSQXIVLPRNXXNHQSSKKNTADTSV

SEQ ID NO: 190840 - protein, 104 aa, Triticum aestivum
  unsure (1)..(104): unsure at all Xaa locations
  Clone ID: PAT_TA_85258.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQXPHLYASEVS

SEQ ID NO: 190841 - protein, 154 aa, Triticum aestivum
  unsure (1)..(154): unsure at all Xaa locations
  Clone ID: PAT_TA_85259.pep
SRAKQWTMNMPPSNHPNMMNWTSNPSPVKTISHHQEHTNLHKXSSPLQEXEEAKAEVKTAEDALKNEMEQXTQQRKINMALXPRQRVTETQXLPRILRXGLRPRGQKRKNPLAGIDDKXQARLQXXRAQPXTISKKVTGSHLGQKEDQEXITAD

SEQ ID NO: 190842 - protein, 92 aa, Triticum aestivum
  Clone ID: PAT_TA_85260.pep
EFGRVPRWEQVRERCISGPSSFDTLCFFCLMCIRPMYTQITFTKNLHYRCVPGEYTVRFCLGNGCVPNGSVVRFYRGPLNNSISQHLRVHSR

SEQ ID NO: 190843 - protein, 92 aa, Triticum aestivum
  unsure (1)..(92): unsure at all Xaa locations
  Clone ID: PAT_TA_85261.pep
MARTKQTARKSTGGKAPRKQLATKAARKSAPATGGVKKPHRFRPGTVALREIRKYQXKSTELLIRKXPFQRLGPRRFAQGFQDRLRFNPPPS

SEQ ID NO: 190844 - protein, 138 aa, Triticum aestivum
  unsure (1)..(138): unsure at all Xaa locations
  Clone ID: PAT_TA_85262.pep
MMGGSXRAALLLALVAVSLAVEIQADAGYGYTXXPTPATPTPXPXKPPTKGPKPXXPPKXHKPPKEHXXKPEKPPXEHKPTPXTXTRXPKPTPXXXTPTRTPPKPTPPXYTPAPXXHKPLPLLXRXPSPSLXXKPNXP

SEQ ID NO: 190845 - protein, 118 aa, Triticum aestivum
  unsure (1)..(118): unsure at all Xaa locations
  Clone ID: PAT_TA_85263.pep
SWKRRFPVKTCKXXHERANRXYRRLVPGPPXXFFXXRITGVDGVHXXDLNIDNXQHTHGWDVTMQRKRXNGGPVSQKVHSRLYLCKRMDIVAVAVNQGNAQQKAXVXSNRSGGHGGGA

SEQ ID NO: 190846 - protein, 113 aa, Triticum aestivum
  unsure (1)..(113): unsure at all Xaa locations
  Clone ID: PAT_TA_85264.pep
MYTLYVIVPIALVAFQTAGNCCGSCAQVQRFDSVVLTSIYCXLFSDAXXFESIFVNAERNRRVAAPMLLLIGAIIGGLIAKSELGTSGALWVAAVLKITVMFGWAAWPAEEGS

SEQ ID NO: 190847 - protein, 77 aa, Triticum aestivum
  Clone ID: PAT_TA_85265.pep
HSPPREQRCSGAPAMATANRTPPRTTTAPTPANTSPPRSPRNPAMPAAPCSSTTLSTRSRRSRSWTGVTAAASTTIP

SEQ ID NO: 190848 - protein, 170 aa, Triticum aestivum
  unsure (1)..(170): unsure at all Xaa locations
  Clone ID: PAT_TA_85266.pep
MSAGELRLELDELRRLESLAKHPRVQILLANEIRNVEAKLAKATEPSPEPLAAASAPAPAPAARPVLSYVTLGSFSWEQDNEKIRIYVSLEGVEQEKVETTFKPTSVDIKFNDVKGKNXCAIPKLNKEMFLRMGCGETTRLLLPFQGSKTGDCTQGRQLSKHGQGKSRLI

SEQ ID NO: 190849 - protein, 153 aa, Triticum aestivum
  unsure (1)..(153): unsure at all Xaa locations
  Clone ID: PAT_TA_85267.pep
KALKKWHKAVVKKKHHKDSSHNSSETPSTDTTGPAGEAGEWXRLHEVPVRHLHRYKTIAHVGGVRSPLSDPDYSDTDDTEPLSLQTRHLIPPAKQRXLDTERXEVRVNXLXTAAAXSNFSQDSSXVPKXAPPRHVPDKLSNILLNTTNVLYDI

SEQ ID NO: 190850 - protein, 81 aa, Triticum aestivum
  Clone ID: PAT_TA_85268.pep
LRQPICLHRWYFPIVVANDSVQKPESFVNTEAQWFSHSHGGKTADRYKQLQHHYIIFIHDSTDAKYIMKLHVVLALQKGKL

SEQ ID NO: 190851 - protein, 113 aa, Triticum aestivum
  unsure (1)..(113): unsure at all Xaa locations
  Clone ID: PAT_TA_85269.pep
FYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGXTLLTRGG

SEQ ID NO: 190852 - protein, 76 aa, Triticum aestivum
  Clone ID: PAT_TA_85270.pep
NIVFLQTLPVTELYFLVVPIIVSHLGILLLSSRFQDSNPCSYLKPVFGRGEGDGKEWRRACSQHRLRVSIFSKSRS

SEQ ID NO: 190853 - protein, 171 aa, Triticum aestivum
  unsure (1)..(171): unsure at all Xaa locations
  Clone ID: PAT_TA_85271.pep
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATKYXIQGFPTIKISGTKGKNIQEYXGPREADGXVDYLKNKLACVKGYXXTKDATXLIDXKNITLVVPR

SEQ ID NO: 190854 - protein, 79 aa, Triticum aestivum
  Clone ID: PAT_TA_85272.pep
YNVTKMCSHRKITNNILGGHSNNIFSLVHLGLLQIKLVAQDQNSWLLSFLLGRNNNNQHSSDLAKLYSSKLSVPQFLDT

SEQ ID NO: 190855 - protein, 129 aa, Triticum aestivum
  unsure (1)..(129): unsure at all Xaa locations
  Clone ID: PAT_TA_85273.pep
RIYNGSTPIVDSGLSAGYATLLRALCPSNANSSTPTTTVIDPSTPAVLDNNYYKLLPLNLGLFFSDNQLRVNSTLNASVNSFAANETLWKEXFVAAMVKMGNIQVLTGXGPVKXNCSIVNNGRRWGFNR

SEQ ID NO: 190856 - protein, 62 aa, Triticum aestivum
  Clone ID: PAT_TA_85274.pep
MGKVHGSLARAGKVRGQTPKVAKQDKKKKPRGRAHKRMQYNRRFVTAVVGFGKKRGPNSSEK

SEQ ID NO: 190857 - protein, 84 aa, Triticum aestivum
  Clone ID: PAT_TA_85275.pep
MGYGTLDNGDWLMVGMSIFSKDRSVELRMQDDGKLAIYYNNRCAWQSTDQQISNAKGAIMQGDGNFCIYDKNGKATWHTNTAAP

SEQ ID NO: 190858 - protein, 64 aa, Triticum aestivum
  Clone ID: PAT_TA_85276.pep
FFFFVTLSVTHHSYPSRYKYVKQTAPNSLICFVRYKTTIHNQFTTSFSKIAAIQAPQMSGIQIT

SEQ ID NO: 190859 - protein, 63 aa, Triticum aestivum
  Clone ID: PAT_TA_85277.pep
MGNQILKETRGRGTGGTKLVIGHASRVSLILQLNLLLLPYDVMMRTPLQFMLLLLLLLRRRAL

SEQ ID NO: 190860 - protein, 47 aa, Triticum aestivum
  Clone ID: PAT_TA_85278.pep
SWSFMQQRSLHLIMDIRMWFNLCEILSVSVRTLISYQSSRNIQSLQM

SEQ ID NO: 190861 - protein, 94 aa, Triticum aestivum
  Clone ID: PAT_TA_85279.pep
GHQAQHGTDDTEELLAAHRQLWCHALGYVKSMALKCALDLRIPDTIDRCGGSATLGELLAASEIPASNHDYLRRVMRTLTAMRIFAVSHDDPAK

SEQ ID NO: 190862 - protein, 108 aa, Triticum aestivum
  unsure (1)..(108): unsure at all Xaa locations
  Clone ID: PAT_TA_85280.pep
NFMSITXLGSLAWTMMQSGGTRXVWETVXEQRRPGXANGRSTGGRRVPPISSRLLPLGLRQARVDEHPRRRGDIAAEDVEGPGHAHRPRYIGNERSSPRMALITRVDR

SEQ ID NO: 190863 - protein, 54 aa, Triticum aestivum
  Clone ID: PAT_TA_85281.pep
YVEFIFVESDTILVFTIFYNLFGGGTRLAMPKTICAPDSSSLKPGSGANEGVPD

SEQ ID NO: 190864 - protein, 75 aa, Triticum aestivum
  Clone ID: PAT_TA_85282.pep
QLPRHHQLRRQQLQPPRQHSRRQPKLREWLVWDLSTWSAPPDVYLTKQAKLFQRLTVDEGHRMYCMLNCCSNRTH

SEQ ID NO: 190865 - protein, 171 aa, Triticum aestivum
  unsure (1)..(171): unsure at all Xaa locations
  Clone ID: PAT_TA_85283.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYXGRYWXTMWKLPMFGCTDATXVINEXEESRKEYLTPXVRIIGFTTSSVXCVSSSPARAQDPQG

SEQ ID NO: 190866 - protein, 180 aa, Triticum aestivum
  unsure (1)..(180): unsure at all Xaa locations
  Clone ID: PAT_TA_85284.pep
LLHASGCEDTPNILCNVDPVVYETQKCVLEENLSRRAEHYFFEMKRVTKGRDAWAHGNLQELGQLISESGRSSILNYECGSKEMIQLYEILLKAPGAXAPGFSGAGFKGCCLAIVESDRAEDAAAYVRAEYEKXQPELVSKIPAGXRVLVCXPGDPRASCLISPELLMSWDRMMHQSCVG

SEQ ID NO: 190867 - protein, 127 aa, Triticum aestivum
  unsure (1)..(127): unsure at all Xaa locations
  Clone ID: PAT_TA_85285.pep
NTYDGRTIRYPDPLIKANDTIKIDLETNKIMDFIKFDVGNVVMVTGGRNTGRVGVIKNREKHKGGFDTIHVEDSMGHQFATRMGNVFTIGKGNKPWVSLPKGKGIKLXSIIEEQRRRDFAAQAAAKA

SEQ ID NO: 190868 - protein, 82 aa, Triticum aestivum
  Clone ID: PAT_TA_85286.pep
DYSMSASPELYRPAEAPAFSPSCATQPPLPLVFAGDDYCCRTPTGSGICYLREPNTCPPAPRKPPPPPPCASASSKRRITSC

SEQ ID NO: 190869 - protein, 157 aa, Triticum aestivum
  unsure (1)..(157): unsure at all Xaa locations
  Clone ID: PAT_TA_85287.pep
GDGRRLLRLLLAVYHPRNRYVLHLSADAPDDERLSLATGVVAAAPAVGAFENVVIIGNPTAGTPVGSSGLAGTLRAAAVLLRLHADWDWFLTLNAADYPLVTQDDLIHVLSSXPRDLNFIDHTXDVGXKELRNSTNYIDAGITVXEDNSFEEHRNSS

SEQ ID NO: 190870 - protein, 158 aa, Triticum aestivum
  unsure (1)..(158): unsure at all Xaa locations
  Clone ID: PAT_TA_85288.pep
MWWRAVRRRWVATARPASSAAAGAEKSCRAVVVPRFGGPEVLEVRQGMPVPDLKPQEVLVRARAVSINPLDLRMRCGYGRSIFEPLLPLIIGPDINGELRQRNLXLFXXAXSVXSLHQXLSKGISEYXILSLDNLSQTSNQWRQCNPFALTGRLMYLF

SEQ ID NO: 190871 - protein, 134 aa, Triticum aestivum
  unsure (1)..(134): unsure at all Xaa locations
  Clone ID: PAT_TA_85289.pep
TGSSANSEPXTXSQSFVCPSTVTSPGRNSASTCSLPPAQVGASPWCSCAVVATTRVAPANRMTSSLVMQIEASWSTGATLSETRRLFPSSGMQEPREVKIDQVNLANAAAAAAAWRTRRRPSPAWFGRIFASNP

SEQ ID NO: 190872 - protein, 78 aa, Triticum aestivum; identical to SEQ ID NO: 106977
  Clone ID: PAT_TA_85290.pep

SEQ ID NO: 190873 - protein, 181 aa, Triticum aestivum
  unsure (1)..(181): unsure at all Xaa locations
  Clone ID: PAT_TA_85291.pep
FPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPVGLPMASNFVGNSNSIQEISAAWSEQFTXMFRRKXFLHWVHNXGMDKWSHRGXSNMNDSLPSTTVQDATPRIQEXTHGKRTP

SEQ ID NO: 190874 - protein, 130 aa, Triticum aestivum
  unsure (1)..(130): unsure at all Xaa locations
  Clone ID: PAT_TA_85292.pep
MRFTSIFVAGAFATMAAAQSKTASVSPAQQSQLDCLDACDAGDVKCQSYCITVPSPDEKNINATTECVAACPKGXGSASDTEKYSVCLQDCIPNNYWEDSLRYSPRPAMLVQRTSFLRCRVCCFKGTARL

SEQ ID NO: 190875 - protein, 159 aa, Triticum aestivum
  Clone ID: PAT_TA_85293.pep
TRSLPLPLPLSGLSLPLSTVSTPPPLTPQFLSPHCRPPPSVLSPRLLQVQSPPPFLQFLIPTSCSGPAVHSKFFQEGQPTPPGRDPRKVALGLRALRLPPSLRSRDFKRRPCTESLVPIFLGIRLFFGFLGTALAHSLPLLTFFGFLVVPSRQAMGRNY

SEQ ID NO: 190876 - protein, 162 aa, Triticum aestivum
  unsure (1)..(162): unsure at all Xaa locations
  Clone ID: PAT_TA_85294.pep
EPLGVVLIISAWNYPFILSIDPVIGAIAAGNAVVLKPSEIAPATSSLLAKLLPEYVDNSCIKVVEGGVAETTSLLXEQRWDKIFYTGNGTVGRIVMAAAAKHLTPVALGAWWETPVVVDSNVDLHVXQEXXVGKWGCNNGQACIAPDYIITTKSFAQSWVAP

SEQ ID NO: 190877 - protein, 91 aa, Triticum aestivum
  Clone ID: PAT_TA_85295.pep
PPRRKSAIIFNGVCMSVGGGAGLTFSSLGPRLPSAIQSFHGGVNVNRIRHLSHDVPLSTATSAIHSWLNHSSPNDGESFAVCCSLLEQFLL

SEQ ID NO: 190878 - protein, 48 aa, Triticum aestivum
  Clone ID: PAT_TA_85296.pep
FRAITLAIYDFKCLQNSAEFKNNTVMRRTDGSVCFTSVSFLPMFVISV

SEQ ID NO: 190879 - protein, 112 aa, Triticum aestivum
  unsure (1)..(112): unsure at all Xaa locations
  Clone ID: PAT_TA_85297.pep
XYLSRGFAAREAPTTAGEEARFLRSSGAALAAGARFRSRDGGVVARNIGVDLAAVNGLRLGRRRGGRAGVVGAGSWTAVRHWGIGSELRGGGGRDERAGGRVGRSSSSSPGL

SEQ ID NO: 190880 - protein, 134 aa, Triticum aestivum
  unsure (1)..(134): unsure at all Xaa locations
  Clone ID: PAT_TA_85298.pep
INGSLHAFVGGDQSHPCSRDIYHELDNIMVDIKKLGYQADTSFVLQDLEEEEKEKALLYHSEKLAIAFGXVLSLNEDKTIFVTKNLRVCGDCHTAIKYMTLVRNRTIIVXRDTNRFHHFQXMGQCSCGNFTGQN

SEQ ID NO: 190881 - protein, 120 aa, Triticum aestivum
  unsure (1)..(120): unsure at all Xaa locations
  Clone ID: PAT_TA_85299.pep
VMLCSICLDTVVAGGEERSTARLQCGHEFHLDCIGSAFNAKGIMQCPNCRTIEMGNWLYANGSRSSQDVNNDEWGYDDLYDHGHSELATFVPLRIQXGCPIGRLEXPSLFEEGDPQLQLL

SEQ ID NO: 190882 - protein, 163 aa, Triticum aestivum
  unsure (1)..(163): unsure at all Xaa locations
  Clone ID: PAT_TA_85300.pep
MWRRRVGALLRSPRTSSSASSACQSRRHHLLPSEEPLALNRLARLFTSQAGSDGGDTQKPFIAFVLGGPGSGKGTQCTKIASXFGFAHLSAGDILRHEIASGSEXGSLILEIIKEGKIVPSGDNCGTIKKXMGMNNAKRVLIDGSQGVKENKTPKGFWNKTSI

SEQ ID NO: 190883 - protein, 156 aa, Triticum aestivum
  unsure (1)..(156): unsure at all Xaa locations
  Clone ID: PAT_TA_85301.pep
QFHNSWRPPWGLRTVVLSSWRDLSHRSRGSQFSGSTRATTEGSASILASSIKIKEVLLSHSHGSLQFFDSVCVGVKQHAKIQSTCEYLTKETRIVRYDESNKQAVSRLLQFDLIYSEDKLGKKXXXPTTGLGERLKPRRTPPLVSAGQWXLTRFEL

SEQ ID NO: 190884 - protein, 78 aa, Triticum aestivum
  Clone ID: PAT_TA_85302.pep
CCGGNCGCGSGCKCGNGCGGCKMYPEMDEGVTTTSQTLIMGVAPSKGTPSFEAAAETGADNGGCKCGSNCTCNPCTCK

SEQ ID NO: 190885 - protein, 135 aa, Triticum aestivum
  unsure (1)..(135): unsure at all Xaa locations
  Clone ID: PAT_TA_85303.pep
MGSLPPVDGQRRPPHVVMIPYPAQGHITPMLQFAKLLHTRGFHVTFVNNEFNHRRHLRARGPNALDGTDGFRFTAIDDGLPLFEADATQDIPALCXSTLTTCLPRFKXSSPGLTPRXSRRTTTVTCSSATHMTRA

SEQ ID NO: 190886 - protein, 149 aa, Triticum aestivum
  unsure (1)..(149): unsure at all Xaa locations
  Clone ID: PAT_TA_85304.pep
MSKVFTLDAVAKHNSKEDCWLIIGGKVYDVTKFLVDHPGGDDVLLSSTGXKDATDDFEDVGHSNTARAMMDEYLVGEIXDASTIPSKDEXYSPPKQPHYNQGQDSRFVIKFSNFWVPWSWAWLLPLGCPRILLNLLPLPLPPRDCTIEF

SEQ ID NO: 190887 - protein, 51 aa, Triticum aestivum
  Clone ID: PAT_TA_85305.pep
VSPEFEVALYTLCFFVGGEDNRVDIGPYSVNVKCYRLGNNKIGSAFPIVEN

SEQ ID NO: 190888 - protein, 147 aa, Triticum aestivum
  unsure (1)..(147): unsure at all Xaa locations
  Clone ID: PAT_TA_85306.pep
IREDDLSSLPYLKASMKEALRLHPPGPLLLPHYSTADCQIDGYHIPANTRVLVNGWAIGRDPAVWEKPEEFMPERFMRDGWDKSNSYSGQDFRYLPFGSGRRICPGANFALATMEXMLANLMYHFDWGSPNEKEDGCXKXSMDDTLG

SEQ ID NO: 190889 - protein, 61 aa, Triticum aestivum
  Clone ID: PAT_TA_85307.pep
GYKDDTPGHHSRIIQEQERCLHVTSTHVKHVNCISVSRESLPQDNHHVTKERNGVLFRKRK

SEQ ID NO: 190890 - protein, 47 aa, Triticum aestivum
  Clone ID: PAT_TA_85308.pep
LDLRIAHTQIRVLVRTIGPTIDREDQSMKISPFFNTHTRYPLKKKKS

SEQ ID NO: 190891 - protein, 181 aa, Triticum aestivum
  unsure (1)..(181): unsure at all Xaa locations
  Clone ID: PAT_TA_85309.pep
SKAAQMLSGIDLDSGIRMLDDTNKLSKCVQIARLYLEDDDAVNAEAFINKASFLVTNSHQEVLNLQYKVCYARILDLKRRFLEAALRYYDISQIEQRKIGDEEIDENALRTTLNAAXVTCTILGWVLGPQRSRXFLATLYKDERCSKLKIYPILQKFTXERFWRKPELIICGLRRTKTYYR

SEQ ID NO: 190892 - protein, 116 aa, Triticum aestivum
  unsure (1)..(116): unsure at all Xaa locations
  Clone ID: PAT_TA_85310.pep
GIFGVAGNAGFQRRELNVLXGVDVPRQVHRGRTCREFCSNGTKPGACRSRTFPGKFAGAKLVGSLCSNGTRPRVCRSRPLLSALGVDLGDFLDGGFRGLCRKVVASNQLPLFALSS

SEQ ID NO: 190893 - protein, 134 aa, Triticum aestivum
  Clone ID: PAT_TA_85311.pep
MLRSPGNSPRLLSPSPTPAPSTPRPASPPPSNAPSSKRRRSEVLDEDTYVAAIERIIERDYFPDLPRLRDRLDWLQAVRSHDPLILRDAQLKILDRRRRAQRHAAGPVPTPTPGTSTRSAPRPFQPRRIVAGGV

SEQ ID NO: 190894 - protein, 158 aa, Triticum aestivum
  unsure (1)..(158): unsure at all Xaa locations
  Clone ID: PAT_TA_85312.pep
MAAGRELVVSFGEMLIDFVPTVAGVSLAEAPAFLKAAGGAPANVAIAVSRLGGGAAFVGKLGDDEFGRMLAAILRDNGVDGGGVVFDAGXARTALAFVTLRADGXXIHFYRNPNAESPHCRXLXXRLIRXGCVFHYXXISLIADLAGNNLRAMXIAKR

SEQ ID NO: 190895 - protein, 90 aa, Triticum aestivum
  Clone ID: PAT_TA_85313.pep
RLRSVFHRNRPKQKVIHTSNSSSSHGLPGDNKTLPRVDSSTHCRLQNVFLGFCFPPTFTLHCARPHWIGSDQIKSVKKQAFHPAYAGYIM

SEQ ID NO: 190896 - protein, 74 aa, Triticum aestivum
  unsure (1)..(74): unsure at all Xaa locations
  Clone ID: PAT_TA_85314.pep
TNANSSSRSCIHRQNAAHPAPVLFVCPGSADEGRFCXIAEXSEKRIVNSPGWVLLEPRIXAVSSKINPGSCXXX

SEQ ID NO: 190897 - protein, 82 aa, Triticum aestivum
  Clone ID: PAT_TA_85315.pep
LTHLSHDTCTSSITTEISSRLTVHRRPTAAAARPEGGGLIDYRSGRRMGLKPKGIAPHAGGRANQAQQAYFLRLPRTPGLGL

SEQ ID NO: 190898 - protein, 112 aa, Triticum aestivum
  Clone ID: PAT_TA_85316.pep
LNYPAFAAVFSSYQDSVTYRRVVRNVGSNSSAVYQPTIASPYGVDVTVTPSKLAFDGKQQSLGYEITIAVSGNPVIVDSSYSFGSITWSDGAHDVTSPIAVTWPSNGGAAAM

SEQ ID NO: 190899 - protein, 185 aa, Triticum aestivum
  unsure (1)..(185): unsure at all Xaa locations
  Clone ID: PAT_TA_85317.pep
LKQMRNWTKEEFVHILRRQSTGFARGSSKYRGVTLHKCGRWEARMGQLLGKKYIYLGLFDSEIEAARAYDRAAIRFNGPDAVTNFDSVSYDGDVPLPPAIEKDVVYGRHLDLNXRISQPNVHDLKXSDGTLTGFGIKLYSXWNFNSIFLKPNGPQWLSSSTAXDAAQHXICITPCQALVTQGGPN

SEQ ID NO: 190900 - protein, 87 aa, Triticum aestivum
  unsure (1)..(87): unsure at all Xaa locations
  Clone ID: PAT_TA_85318.pep
MCPLRVILIFLSATVAGFFLIRGLNAEPDQFDADADDSGSPRAPLPLHSKVGXAVKAXFWTMVXDMASGRYSGAPRCQANLQIGAVK

SEQ ID NO: 190901 - protein, 143 aa, Triticum aestivum
  unsure (1)..(143): unsure at all Xaa locations
  Clone ID: PAT_TA_85319.pep
MKFTLFLAAASLALAAPGTKLTPRDTSPLVPRSARRAKYSSHPNQRLTSLSEVRTKNDQYSGNWAGAVQIGSGYNKVQGTITVPEVSGADGAAASAWVGIDGDTCQTAILQTGXSFYADGSFDAXXEWIPDYAYSFSNFDVSV

SEQ ID NO: 190902 - protein, 48 aa, Triticum aestivum
  Clone ID: PAT_TA_85320.pep
EDGIVVPMCLPGPAMETFVKEMDKLLSAPADAEAEQQKDAFPVIRSAL

SEQ ID NO: 190903 - protein, 60 aa, Triticum aestivum
  Clone ID: PAT_TA_85321.pep
SCRYAGKPPKGVKTNWIMHEYRLADVDRSAAARKKTNNALRALETCKARAAWRHGSRTPR

SEQ ID NO: 190904 - protein, 146 aa, Triticum aestivum
  unsure (1)..(146): unsure at all Xaa locations
  Clone ID: PAT_TA_85322.pep
LGPDVDAMKAVADAYSKRSLKYFETALRDYKAQLEEDPIVHRHLSSLYDTLLEQNLCRLIEPYSRVEIAHIAXIIELPMNHVXKKLSQMILXDKKFAGTLDQGAXCLIIFXEDSKTEEIFPATLETIXNVCKVVDSLYMRXGKXMA

SEQ ID NO: 190905 - protein, 54 aa, Triticum aestivum
  Clone ID: PAT_TA_85323.pep
DQVHGHPIMKSTFPLVSLSGQSQDVCLRYDTPISPYTVILLMTEGSQIFGTCRM

SEQ ID NO: 190906 - protein, 99 aa, Triticum aestivum
  unsure (1)..(99): unsure at all Xaa locations
  Clone ID: PAT_TA_85324.pep
GATWRAAACTREPAAPSIVEKAALLGGQIWVSVPDEGRRWKVLAEFWAEFIVFLPPSDNVDIHAXLGAGGEFMTQLWALLSHAGILERPGGATPSAPRT

SEQ ID NO: 190907 - protein, 61 aa, Triticum aestivum
  Clone ID: PAT_TA_85325.pep
SDDHGGTQTQKAMACLLSISFIILQFRQSSVVRCPHDDHMDSEELLVYSALFPHSFVPLLM

SEQ ID NO: 190908 - protein, 131 aa, Triticum aestivum
  unsure (1)..(131): unsure at all Xaa locations
  Clone ID: PAT_TA_85326.pep
MAADSGARRQPSFTKVDQLRPGTHGHNLILKVVDSKMVVQXGREGGPQGRQMRIAECLXLGDETGIIVLTARNDXVDVIKXGTTVELXNAKFDMFKGXMRLQWKWGIXETAETQLHSRRTTTVLNFLGDTD

SEQ ID NO: 190909 - protein, 176 aa, Triticum aestivum
  Clone ID: PAT_TA_85327.pep
RLRRLQVLIEDSGALADIDAAEIGEGQTNDFLRDIQAMRAKAATVTKPKAAGAEAERGEGDSVSIDVPFEELCDEDKITAFFRRLLDEWTQEVDGMPEAERRTAKGKAAIATCKQCTRYLDPLFKQCKKKILTASSNPFEYQYERQQRYGVSFTGIILKCTNTSTRLQLCSNSPLS

SEQ ID NO: 190910 - protein, 53 aa, Triticum aestivum
  unsure (1)..(53): unsure at all Xaa locations
  Clone ID: PAT_TA_85328.pep
LNILVASGASLLALSRSCYAKASLVSRGGGXGGGXXQGXCXLXXXWXAGSXXL

SEQ ID NO: 190911 - protein, 51 aa, Triticum aestivum
  Clone ID: PAT_TA_85329.pep
FLLKSQAAGPYVMSNIDFYYMATSIFFGFVCTLSKLWATFLPENRKIMGCY

SEQ ID NO: 190912 - protein, 48 aa, Triticum aestivum
  Clone ID: PAT_TA_85330.pep
LYILGLNKYKDKKKVAVIHPRLVSSPLIFTLHDLVFGKPCLAIGIFQM

SEQ ID NO: 190913 - protein, 109 aa, Triticum aestivum
  unsure (1)..(109): unsure at all Xaa locations
  Clone ID: PAT_TA_85331.pep
XVXGQRXAMCSGYXGQEPVLQQLRXCALAGRARRWRSNGGVGCRFATGGGGGPLEWEEEEHARAAAVQPXTRQTDGGGGACGVGAXFPLGWPAFIDLTGSGEEEDDDDA

SEQ ID NO: 190914 - protein, 64 aa, Triticum aestivum
  Clone ID: PAT_TA_85332.pep
RGLFHSDAQLLADPSTRAYVLRHATGAHRDEFFADFAASMVKMGSVGVLTGGQGEVRKKCNVVN

SEQ ID NO: 190915 - protein, 194 aa, Triticum aestivum
  unsure (1)..(194): unsure at all Xaa locations
  Clone ID: PAT_TA_85333.pep
QALLDALGTARRVHVVDLDVGFGGRWAPLMQELALQWRRAPVSPLPPPCLKVTALVSPGSSAHPLELHLTHQGLTRFAADLGISFEFNAVAFDPLGPVAPHGAVRRARRSVAVHSPFGPGPVXSYLRVLEQLRPAVXVCLXQRMQRGTAAVAQRASVXRQTRLSLEPAGPRRSVAWRICLQGGLCKHILKGDKL

SEQ ID NO: 190916 - protein, 175 aa, Triticum aestivum
  unsure (1)..(175): unsure at all Xaa locations
  Clone ID: PAT_TA_85334.pep
TAGQERFRTITSSYYRGAHGIIIVYDVTDQESFNNVKQWLNEIDRYASDNVNKLLVGNKSDLTANKVVATETAKAFADEMGIPFMETSAKNAINVEQASWLWLHPSKDRMASQPAAANAXPTTVQIXRGQPVXPETPCCXTLRLPDFFLGVPTHTTLWCMYLHYFKKPAIHYHGR

SEQ ID NO: 190917 - protein, 170 aa, Triticum aestivum
  unsure (1)..(170): unsure at all Xaa locations
  Clone ID: PAT_TA_85335.pep
MPAGHGLRSRTRDLFARPFRKKGYIPLTTYLRTYKIGDYVDVKVNGAVHKGMPHKFYHGRTGSVWNVTKRAIGVEIKQAVNGRIIXXRFMSAWEHVHPPRFTEDFRLXKXKNDXLKGGAKGRGEXXNNKEEPVGPKXGFMVXGLHPXXSYPYEWTQGLQKRFCTQQNWKL

SEQ ID NO: 190918 - protein, 139 aa, Triticum aestivum
  unsure (1)..(139): unsure at all Xaa locations
  Clone ID: PAT_TA_85336.pep
HWDPMAKLAVLLLLLAVAASATVPAHGRDTPTEIKLIKGTDASGVGDDSMECVYTVFIRTGSILKAGTDANVTLELAAADGNGWGISKPARLGXGSWXRXXXFXPNNLDNLNRXXAXNAKRPFLIPXGXXGTGXXXDWT

SEQ ID NO: 190919 - protein, 122 aa, Triticum aestivum
  unsure (1)..(122): unsure at all Xaa locations
  Clone ID: PAT_TA_85337.pep
APDGGVMCVEEPKDAERFGFGDPGVEEPAKFPLAQDGESCENTTSADFRQKLSNLSQVIRFGGLGLILEVANTWKTPTCAFQTLLRTWXPIIKIMNCFIPMGPXDGHRGKRCCPFFGDNLQG

SEQ ID NO: 190920 - protein, 79 aa, Triticum aestivum
  unsure (1)..(79): unsure at all Xaa locations
  Clone ID: PAT_TA_85338.pep
MGVYLSTPKTDKLSADGENSRVRFGLSSMQGWRTTMEDAHAALPDLDECTPFWVFNDXHGGKVXSKFCAKHLHXQXLYK

SEQ ID NO: 190921 - protein, 99 aa, Triticum aestivum
  Clone ID: PAT_TA_85339.pep
AFSRTARKNKPLIITVQENETVLDDTPDKFSIDALNVQNYWEAIGVIAAHKAGINPNALRRQGVDHLKSHQRLYSARSSGRRPYASSPMQDKVYVHQLV

SEQ ID NO: 190922 - protein, 63 aa, Triticum aestivum
  Clone ID: PAT_TA_85340.pep
SDCKCGKMYPDLTEQGSAAAQVAAVVVLGVAPENKAGQFEVAAGQSGEGCSCGDNCKCNPCNC

SEQ ID NO: 190923 - protein, 74 aa, Triticum aestivum
  unsure (1)..(74): unsure at all Xaa locations
  Clone ID: PAT_TA_85341.pep
XLLKLMNLLRAFWRPSSNXHSXTXSYXTGTQXGLLWYXDAXQHXXGXFSXAVVXXNSXDDXCHIXSGPLSFQXS

SEQ ID NO: 190924 - protein, 118 aa, Triticum aestivum
  unsure (1)..(118): unsure at all Xaa locations
  Clone ID: PAT_TA_85342.pep
TLAWAAXXKTGSNPARKTGRARLCFAARKIVRARLRLQFFRISGRVFTCAYLKNSIRAGLSGFGLDFGPGSGLKIWSISGFGLGSGLRNEGRAFTSPTRNPARPDVCPGLIDCYTCWL

SEQ ID NO: 190925 - protein, 143 aa, Triticum aestivum
  unsure (1)..(143): unsure at all Xaa locations
  Clone ID: PAT_TA_85343.pep
GCQISSQFLVPNMASGLNDVDKNXLPPXTSKLSSLHGESASGVGITGAWSCILSHCLAFFGRADADFGGVLDRWQYAQDYVLTERLAYAFLWDILLYSIFQPWLIGDNLQNVKPKAREFVNVARFIPVVGIVAYLLCLEEKKD

SEQ ID NO: 190926 - protein, 73 aa, Triticum aestivum
  Clone ID: PAT_TA_85344.pep
ITPEEDDIVPETVGPVATEPHPARILALLPKKNSSLGVKRKPPKRTFKSKARAKRGDKKRGAAKGKRKGKGMK

SEQ ID NO: 190927 - protein, 71 aa, Triticum aestivum
  Clone ID: PAT_TA_85345.pep
DQSMYKELKRIIPTAAAFGGACIGALSVTSDLLGALGSGTGTLLAVTIIYGYFEIAAKEGDMAGMKGMIMG

SEQ ID NO: 190928 - protein, 90 aa, Triticum aestivum
  Clone ID: PAT_TA_85346.pep
MKDPPGAPGTPAGLGLRLAQAFFAAAALAVMASTNDFPSVSAFSYLVAAAILQCLWSLLLAFVDIYALLVKRSLRNARAVCIFTIGDGVQ

SEQ ID NO: 190929 - protein, 166 aa, Triticum aestivum
  Clone ID: PAT_TA_85347.pep
TVALREIRKYQKSTELLIRKLPFQRLVREIAQDFKTDLRFQSSAVSALQEAAEAYLVGLFEDTNLCAIHAKRVTIMPKDIQARPIRGERRRGLSEASSSHRKRRRCCFGPACRTCASLGFLSGGNGSSYHCAFLKTLRIESVQLGNLIVYLHSCLRGCRRLKEIYS

SEQ ID NO: 190930 - protein, 110 aa, Triticum aestivum
  Clone ID: PAT_TA_85348.pep
HVLDNRRNTLLMCNPSRTPDTMYLDEVESVRPSQNGLYSIIKPLETVVQQDYGRQDTPTLLYETQSLQGFGCMSVPLSAADPSSSDERSGISTLLSAKWITTTTNGAVGR

SEQ ID NO: 190931 - protein, 119 aa, Triticum aestivum
  Clone ID: PAT_TA_85349.pep
MAAAAATKASSWMVAMSVGAVEALKDQGGLCRWNYALRSVYRTAKANVRSGSRSFAAQRDKDLGPGGGEGAGRTRPRGGGFRTVMFLSCWGPINYLSYPNWPWLPQRPRTRQLIINIRR

SEQ ID NO: 190932 - protein, 153 aa, Triticum aestivum
  unsure (1)..(153): unsure at all Xaa locations
  Clone ID: PAT_TA_85350.pep
PGHAHTTRSPITSAVEEKRQQPPAIEEKPPKPEVAPEEKPPKEEKPPRVDVEGPHAETDEDQKKPVPDDDAAANGVATESAPAKKPACDIQGPXASDVCDIDGNVRXHGSRGTVLXAPFHRKRRQPEPXEWXVRPIPGTQGGRSYVASWLNPP

SEQ ID NO: 190933 - protein, 57 aa, Triticum aestivum
  Clone ID: PAT_TA_85351.pep
QYYSYVLETPLALTGSHNLAKATAKGSTVVLFVASASDKQWQSSEKILKAMVDSFQI

SEQ ID NO: 190934 - protein, 119 aa, Triticum aestivum
  Clone ID: PAT_TA_85352.pep
REEPAEASVYAIQAASGSNGSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAWR

SEQ ID NO: 190935 - protein, 118 aa, Triticum aestivum
  unsure (1)..(118): unsure at all Xaa locations
  Clone ID: PAT_TA_85353.pep
RTLEGGPWGYGGRGGGGGLGRGGGLGAGITAAAXGTRLALQWILVKXLDCTHSNYQTLTRPXIVIYCHYLPVSGLGNLRACCLXLDVVAVSQAPSPESNPNSPSPVTTMVGPYPTIES

SEQ ID NO: 190936 - protein, 80 aa, Triticum aestivum
  Clone ID: PAT_TA_85354.pep
ATSITYHHSRRPNPFIEYERNITSNTNMQESTNQVAKTRQREVHVVYLAASVTVSTPSPLVERPTDSWQTNQKHSSNLEG

SEQ ID NO: 190937 - protein, 162 aa, Triticum aestivum
  unsure (1)..(162): unsure at all Xaa locations
  Clone ID: PAT_TA_85355.pep
AENKVLDPKKAQNIAILLRALNVTKEEVSDALCEGNTENFGADLLETLLKMAPTKEEEIKLREFKEESSPVKLNPAEKFLKAVLDVPFAFKRVDAMLYIANFDAEVNYLKKSFETXEAACDELRSSXLFLKLLXEAVLKTGNXMNVGTNRGDHXFKLDTLLK

SEQ ID NO: 190938 - protein, 88 aa, Triticum aestivum
  unsure (1)..(88): unsure at all Xaa locations
  Clone ID: PAT_TA_85356.pep
PKKGSLGTIAPIAIGFIVGANILAAGPFSGGSMNPARSFGPAVAAGDFAGNWVYWVGPLVGGGLAGLVYGDVFIGGSYQXQVADQDYA

SEQ ID NO: 190939 - protein, 139 aa, Triticum aestivum
  unsure (1)..(139): unsure at all Xaa locations
  Clone ID: PAT_TA_85357.pep
MEGKEEDVRLGANRYSERQPIGTAAQGTEEKDYKEPPPAPLFEAEELTSWSFYRAGIAEFVATFLFLYISILTVMGVSKSSNKCATVGIQGIRGPFGGNILXLGYCTAGISGGHINPALXXGSSCAGTFSTRAPSKHCR

SEQ ID NO: 190940 - protein, 63 aa, Triticum aestivum
  Clone ID: PAT_TA_85358.pep
EAQSRGGRGGGGGGYGGGRRDGGGYGGGGGGYGGGRGGYGGGGGYGGANRGGGYGNNDGNWRN

SEQ ID NO: 190941 - protein, 193 aa, Triticum aestivum
  Clone ID: PAT_TA_85359.pep
LAATFFSPCLLLHRAAGIPRQQQQGAVLLSMAPSSPSSSSSQQAPPSTPCAQQQPWRCLSSPWRAAAHPPLSPMACCSSRSPSSLCPLPQEQAAPPPMVGLPSPPRLLPPGRAPMPGTAAPLDRCSIFFPRSALSAAGSGATPLLLLSTHKTATRKSFSQWSQEFKEPLLAVLWCRRCSENAHKATPCFTCFK

SEQ ID NO: 190942 - protein, 55 aa, Triticum aestivum
  unsure (1)..(55): unsure at all Xaa locations
  Clone ID: PAT_TA_85360.pep
XPYXVQSIPDLGCXLTMSCYXHVFQVANSCHQLDIFRXEPXSVSLWLLXSSXAQN

SEQ ID NO: 190943 - protein, 63 aa, Triticum aestivum
  Clone ID: PAT_TA_85361.pep
HDTFFFLVGVGAQTRGKYLLSELPKLPRPRQSHTPDNHKAGRREMKQTYRSRMPRLAAAASKI

SEQ ID NO: 190944 - protein, 117 aa, Triticum aestivum
  Clone ID: PAT_TA_85362.pep
QWAGLVLLDDTTVQKDTPSPLKTEIWFGSHKEDCVPQLKKTGTGLARCPEDKKKAVFSLFVRDPNRGPLSRYGLYLRFPRIGIKENPFPVHVIEDLGDFYPLLGARRFKVKIFVNPF

SEQ ID NO: 190945 - protein, 93 aa, Triticum aestivum
  unsure (1)..(93): unsure at all Xaa locations
  Clone ID: PAT_TA_85363.pep
MGLRVRASSLLLSLAIELAAVLVSVSAQXKFGINYGQIANNLPDPTXVATLLRSMNVNXVKLXDXDPRVLTAFANXGVEFIIAXGNENCPWRP

SEQ ID NO: 190946 - protein, 91 aa, Triticum aestivum
  Clone ID: PAT_TA_85364.pep
MGLQEEFEEHAEKAKTLPATTTNESKLVLYGLYKQATVGDVSTGRPGIFSLKERAKWDAWKAVEGKSKDEAMADYITKVKQLLEAAAASNL

SEQ ID NO: 190947 - protein, 49 aa, Triticum aestivum
  Clone ID: PAT_TA_85365.pep
HGALCPVAEFPAIKAVGLNNHWVDACVMALMLVGYRVVAYIALDRLKPR

SEQ ID NO: 190948 - protein, 193 aa, Triticum aestivum
  unsure (1)..(193): unsure at all Xaa locations
  Clone ID: PAT_TA_85366.pep
DALEKPFDEAVTSQSQESVDCMQPMGWTSENVSKDFGVTRDVMDKYAAESFQKAEAAQKAGLFADEIVPITTKVKGPDGQEKEVTLTQDEGIRPGTTAESLGKIRSAFPQWGXATTGGNASQLTDGAAAVLLMKRSTAIKLGKPIMGKYVGSTVAGLAPRIMGIXPTLHPQLLAKNLDDIACINLSPWLCQTG

SEQ ID NO: 190949 - protein, 121 aa, Triticum aestivum
  unsure (1)..(121): unsure at all Xaa locations
  Clone ID: PAT_TA_85367.pep
VDYDQRPDIFRGTIRYASVHAHLGRTGSRRDDLESLAYTLIFLIRGRLPWQGYXGDTKSFLVCKKXMAXSPEMXCCFCPAPFXXFLEXVTXMXFDEGAXLCKLISIFDGLXEQPAXKXIQH

SEQ ID NO: 190950 - protein, 81 aa, Triticum aestivum
  unsure (1)..(81): unsure at all Xaa locations
  Clone ID: PAT_TA_85368.pep
MDASGAGSKGKKGAAGRKAGGPRKKSVTRSVKAGXQFPVXRIGRYLKXGRYAQARGHWRPVYLAAVLXYSPAEGSGGRERR

SEQ ID NO: 190951 - protein, 42 aa, Triticum aestivum
  Clone ID: PAT_TA_85369.pep
TKRTGLKGEHLYIIINIHLGFLIKPSRCSYGVVTPEDKKIVI

SEQ ID NO: 190952 - protein, 104 aa, Triticum aestivum
  unsure (1)..(104): unsure at all Xaa locations
  Clone ID: PAT_TA_85370.pep
TGREIIWAQRRRLTAVPSLELPSSTSRQIRQLSVSHVVFLSPSAAVGFPAAVVCVVGSVACLCVRGRACRVLCLXLXXALXVPVCCCKQEDXFWXLWRNXXLRX

SEQ ID NO: 190953 - protein, 94 aa, Triticum aestivum
  unsure (1)..(94): unsure at all Xaa locations
  Clone ID: PAT_TA_85371.pep
GVRRGCSGLEMAASDVEYRCFLXGLAWXTDDHSLXXDFSXYGXVLEXXIILDXXTHXSRXFXFXTFSTXRRXXKRXSRGXXXXDLDGXXITVIG

SEQ ID NO: 190954 - protein, 164 aa, Triticum aestivum
  unsure (1)..(164): unsure at all Xaa locations
  Clone ID: PAT_TA_85372.pep
MAGVVVVFDFDKTIIDVDSDNWVVDSLGFTEPFERLLPTMPWNTLMDTMMGELHAHGRTLDDVAEALRAAPVVAGVXAAIKAAYALGCDLRVLSDANAFFIDTVLAHNGLLGCFXKINTNPSTPXXNXDGRSHRAYTTARCGVGTGRQKGKWISGPPEPVPAYR

SEQ ID NO: 190955 - protein, 131 aa, Triticum aestivum
  unsure (1)..(131): unsure at all Xaa locations
  Clone ID: PAT_TA_85373.pep
MSRHPEVKWAQRIDKVYITVQLPDAKDAKVNLEPDGVFTFSGSAGTNLYELKLDLNDKVNVEASKISVGVRSIFCIVEKAEAKMXWKKLVRDDQRAPHFVKVDWDKWVDEDDDGLMSTWGWASILGGMVDG

SEQ ID NO: 190956 - protein, 142 aa, Triticum aestivum
  unsure (1)..(142): unsure at all Xaa locations
  Clone ID: PAT_TA_85374.pep
PPFLLNESSEEGRCSWAAFGGGSPPARAGNPLVHDPSFLLSQRHPAADPPLELGFFDHLIRTSSYVHRPTPTTSYTSTSSSGSSSKSSFGPSSFAPAVRIQGFDVXACRSSHSGGXLRAAFCPPPAAGPAPCDGGIKEEELV

SEQ ID NO: 190957 - protein, 130 aa, Triticum aestivum
  unsure (1)..(130): unsure at all Xaa locations
  Clone ID: PAT_TA_85375.pep
MPPRSDHAAGSGAAAAATQAHFDSIDPLFHVLRVLPFSFLLPPRTRLRLPSNLALPSPMTVFSLILLTYFAVVSGXVYDVIXVXPLGIXXRPRPGTGPSARRLLPRVNIHHRRSPPGQFLPWRISSSTRR

SEQ ID NO: 190958 - protein, 181 aa, Triticum aestivum
  unsure (1)..(181): unsure at all Xaa locations
  Clone ID: PAT_TA_85376.pep
DVLTDDVADLAVGLAIAALRRIPHADSYVRAGLWKANDGHYGLTTRFSGKRVGIIGLGRIGXSIAKRVEXFGCPVCYYQENKXDAYPXYIYSPTVLQLATNXDFLVVACSAGTSRPXDPDRXVXXGXPNGVLLNVWRRAHNNPTLGSPMPPPARADFSKAIKPNGLTWHAHGNTISMRLCI

SEQ ID NO: 190959 - protein, 71 aa, Triticum aestivum
  Clone ID: PAT_TA_85377.pep
VPKGLPGWDDAEKEHLGEELADVLLYLVRLSDMCGVDLGKAALRKMEINARKYPVGQCKGSSKKHTPLRLH

SEQ ID NO: 190960 - protein, 79 aa, Triticum aestivum
  unsure (1)..(79): unsure at all Xaa locations
  Clone ID: PAT_TA_85378.pep
GXYKSXPCDXQISQNCVTXHHAVFILSNXIYIEGDHNRNEKKVSNTLTVLFTQETLVNSSFPVIHNVTMSQRNITVFRK

SEQ ID NO: 190961 - protein, 68 aa, Triticum aestivum
  unsure (1)..(68): unsure at all Xaa locations
  Clone ID: PAT_TA_85379.pep
TLLAWVILXGMQXKMKSVXFPIGXPXDAGLAEVRAETAQIPENSFHRASSRVCAVVGGDSTPRDGGSD

SEQ ID NO: 190962 - protein, 118 aa, Triticum aestivum
  unsure (1)..(118): unsure at all Xaa locations
  Clone ID: PAT_TA_85380.pep
HHPPPLEFDLFAPPDMSGRGKGGKGLGKGGAKRHRKVLRDNIQGITKPAIRRLARKGGVKRISGLIYKETRXRAQIFLXNXIRXXXTKXGQXRXKNXKTMXSSXPLKXXGXPFKGXGG

SEQ ID NO: 190963 - protein, 63 aa, Triticum aestivum
  Clone ID: PAT_TA_85381.pep
VGVEFQMFKNTMVSAKPWYSKQSFLQCNQTPLSKTMRNTIVFFNIMVLPQNSKNTLLQTPPKL

SEQ ID NO: 190964 - protein, 71 aa, Triticum aestivum
  unsure (1)..(71): unsure at all Xaa locations
  Clone ID: PAT_TA_85382.pep
GALDGGLDIPHSEKRFAGFKKDDKQLDADTHRRYIYGGHVADYMKNLAEEEPEKYQXHFSAYIXKXXKADE

SEQ ID NO: 190965 - protein, 173 aa, Triticum aestivum
  unsure (1)..(173): unsure at all Xaa locations
  Clone ID: PAT_TA_85383.pep
AKRWRITSTRRGRLPLLVIGSSPVRSWLLLVLWLQDDPWCSPTPSSFTXANRCPFPVLAGVRPNTGTHXPPAAVSTPARQFERVXAPGKLDGRFLGRTGFNFNRERMGLTGXSTATAKAVPCTVRLRPPASYPGYLHKXPXXTPTXYLVTVNPLSFXQXPXAGGPXXXMRCQX

SEQ ID NO: 190966 - protein, 92 aa, Triticum aestivum
  Clone ID: PAT_TA_85384.pep
HSKASNPFVNLKKEYKGIFWQEDIIPFFQNVTIPKDCDTVQKCYIYLSGQVKEKLGTIDPYFVKLGDAMVTWIEAWDELNPSTPAAANGKAK

SEQ ID NO: 190967 - protein, 73 aa, Triticum aestivum
  Clone ID: PAT_TA_85385.pep
HSRHSSPPIYRNHHSSKSHKQKLKGTQLCLGSIFYVAAKKDTFPACEVDSASYFPARRQQNQRSLPCFKGRGG

SEQ ID NO: 190968 - protein, 118 aa, Triticum aestivum
  unsure (1)..(118): unsure at all Xaa locations
  Clone ID: PAT_TA_85386.pep
MFDLFPMLLSSVACYLFPIFASYKALKTHDPTQLTPWLMYWVVLSCCLLAESWVXFIVSWIPLYGYFRLLFLLYLILPQTQGARRLYEEYVHPYLEKNETRLTXLIASAHERLTAAGY

SEQ ID NO: 190969 - protein, 178 aa, Triticum aestivum
  unsure (1)..(178): unsure at all Xaa locations
  Clone ID: PAT_TA_85387.pep
PPKLAEGYFEIEAIRRRRLRKGQLQYLVKWRGWPESANTWEPLENLKACSDIVDAFNKRSRSPRSCGKRKRKTPTTPTSDPNPSRGKRGRPPRSEARSMHSIHASEVKKLPCRTSSXRANNNSNKTSPGGLGAAMNLLXGQRIVQEGSXGVAQLGFISRXPLSVNLTDQQDANTCYGQ

SEQ ID NO: 190970 - protein, 97 aa, Triticum aestivum
  Clone ID: PAT_TA_85388.pep
EACSLKDRYGLHSYMRAPVAVNGLSATTQECSLALSTPPGAQVPSLYPGNVVNRTVVPQLGLARKFGGGGTNGQQSGPFDRPRELWDQGHSMKHLTK

SEQ ID NO: 190971 - protein, 104 aa, Triticum aestivum
  unsure (1)..(104): unsure at all Xaa locations
  Clone ID: PAT_TA_85389.pep
MDVYNFLARSGSRKLETRQCSGHVCIGMTAPSTTISIMGMVCGYTYYAHVRSLHTLGQCVVVATASSRGPPRFTILXTSRFKSPDHQAKPVTNLXFGDXRLSKE

SEQ ID NO: 190972 - protein, 99 aa, Triticum aestivum
  unsure (1)..(99): unsure at all Xaa locations
  Clone ID: PAT_TA_85390.pep
VSIPTPPTAASFSFARRHPIRSSPPLRRSLSPRVVTRPRPPPSLSSFPLLKPPVRQPQWIFAPHLHPLAMAPPPASPADSAPDPRPTAXAPVXXXVXTP

SEQ ID NO: 190973 - protein, 60 aa, Triticum aestivum
  unsure (1)..(60): unsure at all Xaa locations
  Clone ID: PAT_TA_85391.pep
VXGKEQXSETXXTMPIARSRPSLPFPSLSLHLDPTPSYRNGETRKDLLSALVQQSELRLF

SEQ ID NO: 190974 - protein, 125 aa, Triticum aestivum
  unsure (1)..(125): unsure at all Xaa locations
  Clone ID: PAT_TA_85392.pep
VHAAIRDRSLFGLPAPPPLRRPKPGAEGLRRSFHRRRRPTRKRIFLAYFCFQKYSCQVGMSGITAIWRRSCPLAASQILMETYFGPSVSSGVLRWFSSGTKHSRKPEFSVANHIXVVGFAFCFCN

SEQ ID NO: 190975 - protein, 136 aa, Triticum aestivum
  unsure (1)..(136): unsure at all Xaa locations
  Clone ID: PAT_TA_85393.pep
FFLKELKVKICIKYGPIPFNDITRQYPPLLMATSQPTKACPLSLSLSLSLSLSLSLSPRLHDESPRPIQPPPPPSPRLVFPPIQRPMECIAEMPRAPLDSKLRKRQRLGWDVGPAEMYXGXRPPHGWEVGPPRCIS

SEQ ID NO: 190976 - protein, 159 aa, Triticum aestivum
  unsure (1)..(159): unsure at all Xaa locations
  Clone ID: PAT_TA_85394.pep
LHEFQRRVAGRGMIVSWCSQQQVLAHRAVACFVSHCGWNSTMEGLRNGVPFLCWPYFCDQYLNRSYIVNVWRTGLAVTPDADGIXGXKDLGXRVDQVVGDXXIKDRARVLKDEAHRCVPXGGSSNDNFKKLVNLSVNDENRETGNIVSMSWRNVHLLVW

SEQ ID NO: 190977 - protein, 118 aa, Triticum aestivum
  Clone ID: PAT_TA_85395.pep
QALTTTDNEDKISTKPKNRKKKYTLRLKNKANTLHISRKKTQTRQQLIHHHLKKQRERHVTWPGQLQVQEASECIFVAVVAGHGALDHDAGSRRQPFLDLDELLLALLPEGLYPRRRV

SEQ ID NO: 190978 - protein, 65 aa, Triticum aestivum
  unsure (1)..(65): unsure at all Xaa locations
  Clone ID: PAT_TA_85396.pep
HPTRGXTTXKXLGSCAXERIFPXSFNISLLSLGCMNLKNFTQQHVCICSNVKDKIXVXQKKKKKK

SEQ ID NO: 190979 - protein, 164 aa, Triticum aestivum
  unsure (1)..(164): unsure at all Xaa locations
  Clone ID: PAT_TA_85397.pep
SISQPWRXEKHHHHLFHHKKEGEDFQPAADGAFDMYGYSTETVVTATGNEGEYERITKEEKHHKHKEHLGEMGAAAAGAFALYEKHEAKKDPEHAHKHKIEEEVAAAAAVGAGXFVFHEHHEKKQDXKEAKEASXEKKHXHFRLDRRRAVAGLAAGRCYVTCVP

SEQ ID NO: 190980 - protein, 137 aa, Triticum aestivum
  unsure (1)..(137): unsure at all Xaa locations
  Clone ID: PAT_TA_85398.pep
MAEEKHHHHLFHHKKEGEDFQPAADGRXTCTXYSTETVVTATGNEGEYERITKEEKHHKHKEHLGEMGAAAAGAFALYEKHEAKKDPEHAHKHKIXEEEVAAAAAVAPALRFHEHHEKKQDHKEAKEASXEKKHHHF

SEQ ID NO: 190981 - protein, 89 aa, Triticum aestivum
  Clone ID: PAT_TA_85399.pep
VKPENKSNPKVLRPPGYIAPDSSGIRRKAGKLSRPPGYIAPDSSLVQCIQGACWVKVLPFCPRLVKCVFRFHVEFDVKPEKAPRLHCTR

SEQ ID NO: 190982 - protein, 122 aa, Triticum aestivum
  unsure (1)..(122): unsure at all Xaa locations
  Clone ID: PAT_TA_85400.pep
SPXXSPGXSNXXLAXSPKXFHSCXLTPTAQXXSGVXXTSKGKTILLRXPXVMMIKCKKXEEFKSPTTMEASRAMKRPLLKXKXXLKSXSQEEMVQHPSFESGQKKTLLRDVLCRSECIILCR

SEQ ID NO: 190983 - protein, 67 aa, Triticum aestivum
  Clone ID: PAT_TA_85401.pep
KDGISWCKQVLSSVKHNQMTHPQLLCCTLMKLSRTKSAFLHFSTTFSRGAEKCKENQLYGYIVRWFA

SEQ ID NO: 190984 - protein, 164 aa, Triticum aestivum
  unsure (1)..(164): unsure at all Xaa locations
  Clone ID: PAT_TA_85402.pep
DGRVICSMGLLPIKTKHRGPAQVVSDPNALDIIDEALDFFKANVFFRNYEVEGCADRVLIYLTLYIHQALNKIIGKDKGGAEKELYQLAIANFSIPGDGAFPLGGFVTNPASRADADTIRQYFTQLRQEXNIRLIARVYAFRKREPSKWWTCFSKRKFLNMSLE

SEQ ID NO: 190985 - protein, 101 aa, Triticum aestivum
  Clone ID: PAT_TA_85403.pep
AFKASMMQYKTMPARSILDTCFDFTGLELDSITVPDVALVFDGGAVVNLDRSGVIIGNCLAFAAITNPSGVPSVIGNVQQRTLEVLLNVGQSVVGFRPGAC

SEQ ID NO: 190986 - protein, 101 aa, Triticum aestivum
  Clone ID: PAT_TA_85404.pep
EKVHVLRLRPSGSPAGRILLLAPFSSVCLVQHPYVNRNHFESLFGHKLLPTDHDLSGLYIFRSAFISRSIMRLKGNRVFVFHRASRRCTMKFLKVRRADTA

SEQ ID NO: 190987 - protein, 79 aa, Triticum aestivum
  unsure (1)..(79): unsure at all Xaa locations
  Clone ID: PAT_TA_85405.pep
VLDNPVRSDAAAKXQGQDRXQPPPPRPRRHSLLLISXCILLIGSIRFNDLXLNLLIPFDDSIQXLSKNRIFSCSVVGGP

SEQ ID NO: 190988 - protein, 52 aa, Triticum aestivum
  unsure (1)..(52): unsure at all Xaa locations
  Clone ID: PAT_TA_85406.pep
VSLEPKEWRNLLSLXERSYKRKLNFIILESYSLEKESVVPXYSKEHYLGNKY

SEQ ID NO: 190989 - protein, 76 aa, Triticum aestivum
  Clone ID: PAT_TA_85407.pep
EGLIYVVMHALHKSNHRRGSSMLSRGKSPRLKGNPNFRPSLSFSFFSNDQHTASNATCSNLTFFRTYLPYIGDYVH

SEQ ID NO: 190990 - protein, 94 aa, Triticum aestivum
  Clone ID: PAT_TA_85408.pep
GDEFDCECGLCSHVLKVLDFIRMNQIHVKHILKRRTKDARDVLAHHLCHYQKNLHNNPFSYRHFNLYMQAMELFWLGDTSMDAYERLMVWVWET

SEQ ID NO: 190991 - protein, 107 aa, Triticum aestivum
  unsure (1)..(107): unsure at all Xaa locations
  Clone ID: PAT_TA_85409.pep
XGPXLDLXPPLGXLPPLXKEACPAPFFGQGSGAPFLKAFRPCQHHEGGARAPHVGVXRGMFPSGGRQPKSSWHSGVHRQGISGASGSKNNTRRPPPTWRCSPPRRGL

SEQ ID NO: 190992 - protein, 107 aa, Triticum aestivum
  unsure (1)..(107): unsure at all Xaa locations
  Clone ID: PAT_TA_85410.pep
RLXXXXKFXXXPLXSRXXAAAXPEMXRLKISLXSQKYXHHVYIAERTCSAQNFSFRVFFPFPFVFYLYTRRCAVGMLLYGVIKRATCLDKPVRLNGQFIKKKKKKTR

SEQ ID NO: 190993 - protein, 76 aa, Triticum aestivum
  unsure (1)..(76): unsure at all Xaa locations
  Clone ID: PAT_TA_85411.pep
MQSPIDLSDHRTSRAPNLGYLNHSYLPVEASIVNRGHDIMVKFNGDAGXLWINGTAYHLRQVHWHSPSEHRVKDAG

SEQ ID NO: 190994 - protein, 98 aa, Triticum aestivum
  unsure (1)..(98): unsure at all Xaa locations
  Clone ID: PAT_TA_85412.pep
GGDIVHLRFRXPXLTRQFISHMNATSRPLCQLEGDDLDVFKKNVESATKYLLSKLKDLQFFVGESMHDDGGVVFAYYKEGAADPTFLYFAHGLKEVKC

SEQ ID NO: 190995 - protein, 56 aa, Triticum aestivum
  Clone ID: PAT_TA_85413.pep
AVCARRRVGAAEGQPRQLRGGACCARGNTWRGSQGGKGCCRNCRGRQERAGGEGGT

SEQ ID NO: 190996 - protein, 80 aa, Triticum aestivum
  Clone ID: PAT_TA_85414.pep
LMTTNVSLFHYKLTLQAPYFASSLGIIYCLVKPATYAIISREVVSADQGKDRDSSNSEIHSILMAHCYEPSNLLLHLERP

SEQ ID NO: 190997 - protein, 169 aa, Triticum aestivum
  unsure (1)..(169): unsure at all Xaa locations
  Clone ID: PAT_TA_85415.pep
MGLAMLVLPVLLGLFYGASDINCSTVHGNTTDHRSLLDFKGAIRADPRGALRSWNENIHYCMWSGIKCSTMHPERVTVLNLANMSLTGQITPSLGNLTFLWELTLSNNLFSGQLPSLNRLIRLEXLYLQNNLLQGNIPNALTNCSKLLLLDLSSNMLVGRFWNIGSSTI

SEQ ID NO: 190998 - protein, 97 aa, Triticum aestivum
  unsure (1)..(97): unsure at all Xaa locations
  Clone ID: PAT_TA_85416.pep
MTRDPIAXLHXGXHMEXYDMRSARLFPSSNDLLEAPHXNTSGSMALSSGLKSRCYIVVGLWLYKLLPCYLTMLKISSSVYFAIWSHVIYPIGMYGGW

SEQ ID NO: 190999 - protein, 89 aa, Triticum aestivum
  unsure (1)..(89): unsure at all Xaa locations
  Clone ID: PAT_TA_85417.pep
RXKVXMEXNXXXDXNTQLGEELKDVRAQXADSVKENKRLRGGIFSMWSNXPSNNSEIERTDRVMSAGTLTGCPEEEMSGSSTICYKSCR

SEQ ID NO: 191000 - protein, 54 aa, Triticum aestivum
  unsure (1)..(54): unsure at all Xaa locations
  Clone ID: PAT_TA_85418.pep
IKXRLPFRCNDTXTXRAXXRRXPXXPRXRHRRSXWXSKXKFSQDXLYXMFPXKM

SEQ ID NO: 191001 - protein, 81 aa, Triticum aestivum
  Clone ID: PAT_TA_85419.pep
RGPKGRGGIHHPSMALAAISTRFVHRREVAPFSFSFFKIELRFETMDDVLGLGLLPAPLWSMIVLSSYTCTHYRMEEIMKA

SEQ ID NO: 191002 - protein, 94 aa, Triticum aestivum
  unsure (1)..(94): unsure at all Xaa locations
  Clone ID: PAT_TA_85420.pep
NDDCYDXCAYYQHXARRXFSXDQXHXQQHHXPRQXRXRLXXSTLTRPNKKGIMXXTXHELLPQPPCDXQQQXGRAXXRLESVAXAIXEXXVXXP

SEQ ID NO: 191003 - protein, 56 aa, Triticum aestivum
  unsure (1)..(56): unsure at all Xaa locations
  Clone ID: PAT_TA_85421.pep
EFXFFFXVXFDKITLLKFPYILAYIYMHNXCNHMXXTCIYTYVFXDXXXQIXXSXQ

SEQ ID NO: 191004 - protein, 84 aa, Triticum aestivum
  unsure (1)..(84): unsure at all Xaa locations
  Clone ID: PAT_TA_85422.pep
GSGMPRWRRRRSRRRWPRXRSGPGSPPCGHPGRGEGGSGGQGPGVGFGRHPITWGRRSGARVLGXWEEMGKSGRFPLSNGGGNG

SEQ ID NO: 191005 - protein, 50 aa, Triticum aestivum
  unsure (1)..(50): unsure at all Xaa locations
  Clone ID: PAT_TA_85423.pep
ALXDNRSNNQXKRXQDRIISXEDQKQDTTQXNXXRKQXKXTXXPTQXXEA

SEQ ID NO: 191006 - protein, 84 aa, Triticum aestivum
  Clone ID: PAT_TA_85424.pep
IFKVLKQVHPDIGISSKAMSIMNSFINDIFEKLAGESAKLARYNKKPTITSREIQTSVRLVLPGELAKHAVSEGTKAVTKFTSS

SEQ ID NO: 191007 - protein, 58 aa, Triticum aestivum
  unsure (1)..(58): unsure at all Xaa locations
  Clone ID: PAT_TA_85425.pep
LNHAXIHHPQSDEISSNAEHKISKLWASDRLNNMENXXFCKLVVXXHSYSXERXXHPW

SEQ ID NO: 191008 - protein, 111 aa, Triticum aestivum
  unsure (1)..(111): unsure at all Xaa locations
  Clone ID: PAT_TA_85426.pep
TISSIIRLMKISPLAITELIPKPSRLHLLIHFFQLLFVWRSLWLRGVRRRILKDLDPRRPREVRRXFSRVSAKVMTWPTAREPWQRCCSLVQWRRLLRNSPSHPLMVNYWI

SEQ ID NO: 191009 - protein, 149 aa, Triticum aestivum
  unsure (1)..(149): unsure at all Xaa locations
  Clone ID: PAT_TA_85427.pep
MAPTVMASSATSVAPFQGLKSTAGLPVSRRSNGASFGSVXNGGRIRCMQVWPIEGIKKFETLSYLPPLSTEALLKQVDYLIRSKWVPCLEFSKVGFIFREHNASPGYYDGRYWTMWKLLCSGDRRHEVINEVEEVXRVPDAYXAYRLAR

SEQ ID NO: 191010 - protein, 47 aa, Triticum aestivum
  Clone ID: PAT_TA_85428.pep
SNEWIVLWCLVWFRPFARKDKIDWFFSAPSRVSVYVAWMCCKHLMDY

SEQ ID NO: 191011 - protein, 43 aa, Triticum aestivum
  unsure (1)..(43): unsure at all Xaa locations
  Clone ID: PAT_TA_85429.pep
FFALIHXDXGTTKNIIXIXGHIDVPFNYTDRWAKRLEXRLIYX

SEQ ID NO: 191012 - protein, 115 aa, Triticum aestivum
  unsure (1)..(115): unsure at all Xaa locations
  Clone ID: PAT_TA_85430.pep
TCPSGEHLCIIILQWLRAAPTTHQLPQCGGRVFTWIARAGQNAGVRFYKXVNKDVSTTHSXSSXSTRXFQTSNTFFXFXDSICFXXGAXKLHXNQXRVLXXVSIIWGRRTASARK

SEQ ID NO: 191013 - protein, 34 aa, Triticum aestivum
  Clone ID: PAT_TA_85431.pep
SRVLQDNQNTIVFWQKWKETKYYLAPHCVCLMVS

SEQ ID NO: 191014 - protein, 71 aa, Triticum aestivum
  Clone ID: PAT_TA_85432.pep
CTVPCSLKVILPFGACVTFMLSLNVQCYLVCIGVTESHLLFHCYPSISWLLSFVTILLLIFVLVVHLLLRF

SEQ ID NO: 191015 - protein, 141 aa, Triticum aestivum
  unsure (1)..(141): unsure at all Xaa locations
  Clone ID: PAT_TA_85433.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKXQASALEAHAAPNCKVLVVXNPANTNALI

SEQ ID NO: 191016 - protein, 58 aa, Triticum aestivum
  Clone ID: PAT_TA_85434.pep
PPNFAIATIEIMLANLMYHFNWKLPMELMEGGIDMTEVFGMTVHRKEKLLLVPVVPHD

SEQ ID NO: 191017 - protein, 72 aa, Triticum aestivum
  unsure (1)..(72): unsure at all Xaa locations
  Clone ID: PAT_TA_85435.pep
HYXGLGRXXTXLXLLQEYDYLTSCPTSGPHMXRSYPEAAKLIXASIVIXASLQGXARFTXFTNCMVNLLNAT

SEQ ID NO: 191018 - protein, 55 aa, Triticum aestivum
  Clone ID: PAT_TA_85436.pep
SVAQPPRLLHHLQFHHLLDAFSYIAAAAFLILSKKLNVYVFSTCVVRVRQVLASL

SEQ ID NO: 191019 - protein, 112 aa, Triticum aestivum
  unsure (1)..(112): unsure at all Xaa locations
  Clone ID: PAT_TA_85437.pep
LATGYIINHALMLLILTSSCFEFLICRFQGDLKHNFFFKFLSKENFSSMRRAFVNGLNSLVNILSNGTLTHHLSPSLNTLXGISAPLTGXSTVCSNCALKAGIHRXXGPAGR

SEQ ID NO: 191020 - protein, 106 aa, Triticum aestivum
  unsure (1)..(106): unsure at all Xaa locations
  Clone ID: PAT_TA_85438.pep
TRPPPPPAPXNRXXRRCVGXXRRRGXXRRLXLRDPQXGCDLIYXXXPAPSPFVXGFFELFIFLXFVAXMMITXXXSIRVTSRQYXWVXXWIDRXDCLVVXVXGXGV

SEQ ID NO: 191021 - protein, 47 aa, Triticum aestivum
  unsure (1)..(47): unsure at all Xaa locations
  Clone ID: PAT_TA_85439.pep
DGLFGVSPFLHFFGVCSXSXARRXVVPRVXXVELXVWICGTKWLPAD

SEQ ID NO: 191022 - protein, 78 aa, Triticum aestivum
  Clone ID: PAT_TA_85440.pep
FFFLVLYRIICRYGAKVIYHRSHSQHVRAHALMQLILIAHYCASYVLVRSITQRADYMIYSTNYMTGRFKKKKNYMTG

SEQ ID NO: 191023 - protein, 109 aa, Triticum aestivum
  unsure (1)..(109): unsure at all Xaa locations
  Clone ID: PAT_TA_85441.pep
MARLNSKXVAAAVVLXAVVLMMAGRXASAALXCGQVDSKLAPXVXAYXTGRASSISKECCSGVQGLNXPGPQQXGAXRYXCRXCXRALATSIKSXIKIGKVXGVXXKRR

SEQ ID NO: 191024 - protein, 115 aa, Triticum aestivum
  unsure (1)..(115): unsure at all Xaa locations
  Clone ID: PAT_TA_85442.pep
MAPTVMASSATSVAPFQGLKSTAGLPVSRRSNGASLXSVSNGGRIRCMQVWPIEGIKKFETLSYLPPLXTXALXKQVDYLIRXRWVPCLXXEGRVHLPXHXRXRYXXGRXWQLLG

SEQ ID NO: 191025 - protein, 72 aa, Triticum aestivum
  unsure (1)..(72): unsure at all Xaa locations
  Clone ID: PAT_TA_85443.pep
FFFFFFFISTNSSFTTRIVSFLSITKCTLHNALRLSWIESEAEFTVHDRTVCPGYWLGILXMTXGSMTLXSX

SEQ ID NO: 191026 - protein, 77 aa, Triticum aestivum
  unsure (1)..(77): unsure at all Xaa locations
  Clone ID: PAT_TA_85444.pep
IPPTPTVSPPPPPPQLDKKKKRERRTRREGSRSVSGEREFLRSESEQAGALGIGVTIQFFPGTFSECANGVXGWQKV

SEQ ID NO: 191027 - protein, 96 aa, Triticum aestivum
  unsure (1)..(96): unsure at all Xaa locations
  Clone ID: PAT_TA_85445.pep
MARLNSKAVVAAVVLAAVVLMMAGREASAALSCGQVDSKLAPCVAYVTGRASSISKECCSGVQGLNXMARXTXDRKIAXRCLKTPASFMDRPECSC

SEQ ID NO: 191028 - protein, 72 aa, Triticum aestivum
  unsure (1)..(72): unsure at all Xaa locations
  Clone ID: PAT_TA_85446.pep
AIFTSITNHQLLQFDPITMGEQVATXEEANXEESPAPAAXPEAAPAPXPEEXXRXXAPXDQXQGGRTXRGKK

SEQ ID NO: 191029 - protein, 129 aa, Triticum aestivum
  unsure (1)..(129): unsure at all Xaa locations
  Clone ID: PAT_TA_85447.pep
MAPTVMASSATSVAPFQGLKSTAGLPVSRRSNGASLGSVSNGGRIRCMQVWPIEGIKKFETLSYLPPLSTEALLKQVDYLIRSKWVPCLXXTRLVIFREXXASPGYTWRYWKCETASGDRVLTGESKRP

SEQ ID NO: 191030 - protein, 127 aa, Triticum aestivum
  unsure (1)..(127): unsure at all Xaa locations
  Clone ID: PAT_TA_85448.pep
MAPKAEKKPAAAEKTPAAEKTTAGKKPKAEKRPPKSKEGGADKKKKKAKKSVETYKIYIFKVLKQVHPDIGISSKAMXIMNSFINDIFEKSPASPPTRRYNKKPHHSGSSDSSLSPGTPRFEKRTVN

SEQ ID NO: 191031 - protein, 176 aa, Triticum aestivum
  unsure (1)..(176): unsure at all Xaa locations
  Clone ID: PAT_TA_85449.pep
PRPHPLHSLPGEPPPRPRLPEQVAPAELPRPPHRSSAATPSCCRASGGHCPMLWCGSRLGASSPAACSGRRVPQPRRRCSNGPQTWRRCFKARGGLRGHPGTPKMQEESALLSSNAVSPGRGGRDDVPAALLRSSLQIRIRXXSRLRIPRSLXGMSHTGNQXRGLTXGQFVGXAEP

SEQ ID NO: 191032 - protein, 109 aa, Triticum aestivum
  unsure (1)..(109): unsure at all Xaa locations
  Clone ID: PAT_TA_85450.pep
MARLNSKAVVAAVVLAAVVLMMAGREASAALSCGQVDSKLAPXVAYXTGKASXXSKECCSGVQGLNGMSRSSXDRXIAXRCLXXLAXDXXIXXXKXRAGLPSHQSQDIN

SEQ ID NO: 191033 - protein, 124 aa, Triticum aestivum
  unsure (1)..(124): unsure at all Xaa locations
  Clone ID: PAT_TA_85451.pep
MAPTVMASSATSVAPFQGLKSTAGLPVSRRSNGASFGSVXNGGRXXCMQVWPIEGIKKFETLSYLPPXSTEALLKQVDYLIRSKWVPCLEXNXVGXXPXRQXSPGXYXXRXXTMWSAIXGCPTH

SEQ ID NO: 191034 - protein, 56 aa, Triticum aestivum
  unsure (1)..(56): unsure at all Xaa locations
  Clone ID: PAT_TA_85452.pep
TNSASTITAIAAGKSGNAMEWXYRAAHQSARGRKKQIIISVSGKGKQSRQRRSSEE

SEQ ID NO: 191035 - protein, 98 aa, Triticum aestivum
  unsure (1)..(98): unsure at all Xaa locations
  Clone ID: PAT_TA_85453.pep
MSRGGSAGGGQSSLGYLFGDGEPAKPAAAPAAXXXPAXKPAPXXADVAKQIPXGIPXSRANNYYXSDGQNTXNFLTXXLQPSSCCPGGVLLGWKVIWG

SEQ ID NO: 191036 - protein, 97 aa, Triticum aestivum
  unsure (1)..(97): unsure at all Xaa locations
  Clone ID: PAT_TA_85454.pep
MSCSHLSTAXSSSALASTSXRXRASTGSXXSLVVRXSLRDXRNRIDSVRNTQKITEAMKLVAAAKVRRXQEAVXSPXPFSCGVLYKRGGITLTARGR

SEQ ID NO: 191037 - protein, 130 aa, Triticum aestivum
  unsure (1)..(130): unsure at all Xaa locations
  Clone ID: PAT_TA_85455.pep
MAPTVMASSATSVAPFQGLKSTAGLPVSRRSNGAXRQRHNGGRIRCMQVWPIEGIKKFETLSYLPPXSTEALLKQXDYLIRXKWVPCLELARXGXFREHKXSPGYXDGXYWTXGXAMFGALXHTGXNXVE

SEQ ID NO: 191038 - protein, 67 aa, Triticum aestivum
  unsure (1)..(67): unsure at all Xaa locations
  Clone ID: PAT_TA_85456.pep
SINRAKVKPHRTXLPPGKXTAPXVXSNXRAPXTRXXQXLFXXXAVVYXXTXIXSPGXXFXXLNKQIQ

SEQ ID NO: 191039 - protein, 98 aa, Triticum aestivum
  Clone ID: PAT_TA_85457.pep
RIHRPLRRSGARPGGLSCSSTSVQGIGARREAEWTELTTSSSSSHLRRVHRRRPSPNPAASAAPSLPTSHRVLLHAGAQEPDATAGAYYYVKTADDQE

SEQ ID NO: 191040 - protein, 61 aa, Triticum aestivum
  unsure (1)..(61): unsure at all Xaa locations
  Clone ID: PAT_TA_85458.pep
VDLQYLNNQNSEYSIIQTKLPQILTHWSLSSLVTPAVLILRIPVIILSSGXAYVWLDFTIK

SEQ ID NO: 191041 - protein, 65 aa, Triticum aestivum
  Clone ID: PAT_TA_85459.pep
KLKIQLKNYMKASSSSFADAELLPLMMQNSCPSMMQNSWPWYSMSRYRLHPRCPRSIKSIFCCKL

SEQ ID NO: 191042 - protein, 111 aa, Triticum aestivum
  unsure (1)..(111): unsure at all Xaa locations
  Clone ID: PAT_TA_85460.pep
PASSVLTASSQSLASFPRRHPPXKGGCLAAAATAGAAPAXSAAXAAAGXRCSPTWXPPPXPPPXSCPXPPXXXSXAGSXRXXRXAAXTAPPXXVAPVCCXCCSATXXASMR

SEQ ID NO: 191043 - protein, 62 aa, Triticum aestivum
  unsure (1)..(62): unsure at all Xaa locations
  Clone ID: PAT_TA_85461.pep
ARLRQHPXYHRRENXKKKYQXHXPXXHFXVXDXVELVRXRPISKXNHFLXVPXPXXDTXRKX

SEQ ID NO: 191044 - protein, 60 aa, Triticum aestivum
  unsure (1)..(60): unsure at all Xaa locations
  Clone ID: PAT_TA_85462.pep
ARLRQHPKYHRREKIXKKYQAHDPDNQFKVGDVVELVRXRPISKTKXFLAVPVPPRDTRR

SEQ ID NO: 191045 - protein, 33 aa, Triticum aestivum
  Clone ID: PAT_TA_85463.pep
VNTAMERLAKADVRYRFVIDIGNTLDKAAAASE

SEQ ID NO: 191046 - protein, 52 aa, Triticum aestivum
  unsure (1)..(52): unsure at all Xaa locations
  Clone ID: PAT_TA_85464.pep
FFFFFYSXSSQYFXIKHWSLTXXVVEDEQKREDNXAXLKRXMKXIKMXQNEX

SEQ ID NO: 191047 - protein, 129 aa, Triticum aestivum
  unsure (1)..(129): unsure at all Xaa locations
  Clone ID: PAT_TA_85465.pep
MASMLCSYSVSMPAAARAPLLRSSAAYATSVGFATSXLAGXSLSLGXTSXAAVSXPAKNTIXARRICPFLEKKTNRANKVXFSNHKTKKQQXVNLEYKKLXWEAXKXXVKXXXLXKALKXIXKKGLRRQ

SEQ ID NO: 191048 - protein, 143 aa, Triticum aestivum
  unsure (1)..(143): unsure at all Xaa locations
  Clone ID: PAT_TA_85466.pep
MSDTDEHHFESKADSGASKTYPQQAGAIRKGGHIVIKARPCKXVEVSTSKTGKHGHAKCHFVAIDIFNGKKLEDIVPSSHNCDVPHVDRQDYQLIDITDXGXVXLLTESXNTKDDLXLXPPXDXLXWXIXNGLMGYLEPKRGK

SEQ ID NO: 191049 - protein, 109 aa, Triticum aestivum
  Clone ID: PAT_TA_85467.pep
APPSFSDPAMSSSFLLCSGHERLRRCATRHHPTASAASILPALRLHLPPPSVTAHIHINNIFFWMQFNKRICSNSSVSYYPINNSSRVGFCCLLFKKRTISANFEKNAV

SEQ ID NO: 191050 - protein, 91 aa, Triticum aestivum
  unsure (1)..(91): unsure at all Xaa locations
  Clone ID: PAT_TA_85468.pep
PXQXXFXXXVYVHVRXAAXVRLXRXXPAKTTTSXXSSXXRRXAAAPXPGPAITGXEARXXRDXGTGAARELDAIAPPCRSSGVLIIAVWRV

SEQ ID NO: 191051 - protein, 64 aa, Triticum aestivum
  Clone ID: PAT_TA_85469.pep
SISFVGAGSSKETETQVLFDLYMMMENGAERDEHEWSKIFFEAGFSDYKMMPVLGARSLIQVFP

SEQ ID NO: 191052 - protein, 125 aa, Triticum aestivum
  unsure (1)..(125): unsure at all Xaa locations
  Clone ID: PAT_TA_85470.pep
MAAPTRGLVLAVLLAIAVANAEAASVVVGLAKCTDCTRKNMKAEEAFKGLEVAIKCKNVHGDYESKAVGAIDGTGAFSVPLASDLHGADCVAQLHSXAFQRARAPAXRRQRXVPVSERAXFRHRR

SEQ ID NO: 191053 - protein, 53 aa, Triticum aestivum
  unsure (1)..(53): unsure at all Xaa locations
  Clone ID: PAT_TA_85471.pep
MAPGTCVAAIPDLPDAYKPPPRHRRPTLVLLAPISLCXPPXIPLLLDLRXGXV

SEQ ID NO: 191054 - protein, 84 aa, Triticum aestivum
  unsure (1)..(84): unsure at all Xaa locations
  Clone ID: PAT_TA_85472.pep
MPASIAFGRFDDSFSLASFKAYIAEFISTXIFXFAXXGSXIAYSKVSGGAPFXXSGXIXVXICXGVSGFXXGVXWGKKNXGGEX

SEQ ID NO: 191055 - protein, 75 aa, Triticum aestivum
  Clone ID: PAT_TA_85473.pep
QQAPILRNPHSEVVEVSTAALRTSKCRPMTGSSRRSCCCPTWRYHPRPPPLLRPLLMLLLAAPTPAAGRGGEGNA

SEQ ID NO: 191056 - protein, 76 aa, Triticum aestivum
  unsure (1)..(76): unsure at all Xaa locations
  Clone ID: PAT_TA_85474.pep
TSLSPSPXRRRRRXRRRRXRXXRPXSXXXLILRGXXPPARXPXLRRTXXKKXHHSXKLGTXDXVEKSXSKEGQEEP

SEQ ID NO: 191057 - protein, 61 aa, Triticum aestivum
  unsure (1)..(61): unsure at all Xaa locations
  Clone ID: PAT_TA_85475.pep
XGXNXPRSCTXRMDKTXCFFXQNVLPXIQTPTFXLNXAYDGWQXQESLGPXTGXPRXXKKV

SEQ ID NO: 191058 - protein, 74 aa, Triticum aestivum
  unsure (1)..(74): unsure at all Xaa locations
  Clone ID: PAT_TA_85476.pep
MANPRXFFDMTVGGAPAGRIVMEXXKDAXPRTXENXXXLXTGEKGXXKKGKPXEXKGXXFHRVXPVFXKRGDFG

SEQ ID NO: 191059 - protein, 75 aa, Triticum aestivum
  unsure (1)..(75): unsure at all Xaa locations
  Clone ID: PAT_TA_85477.pep
WXIXYRPPXRKIXXVSYXQSVIVISTIQSHTTXFCPSAAEANTILEIXXQGMINWLXARIRSLXPXWKRRISIVV

SEQ ID NO: 191060 - protein, 90 aa, Triticum aestivum
  unsure (1)..(90): unsure at all Xaa locations
  Clone ID: PAT_TA_85478.pep
RLLHVGLCLXWDITISXILLXHLXXWXRXEXSAYAXXXFHXWRXSFVIPGLWXXILRPXTGGXIXGPPEXXLKKXFRRXTXXYXCXPIFP

SEQ ID NO: 191061 - protein, 96 aa, Triticum aestivum
  unsure (1)..(96): unsure at all Xaa locations
  Clone ID: PAT_TA_85479.pep
MPGSIXFGRFDDSFXXASFKAYIAEXISTLIFVFAXVGSAIAYTKXSGGXALDPSGLXAVXIXXGFGXFVAVXXGXXIXXGHVNPXXTSXSRWQPC

SEQ ID NO: 191062 - protein, 77 aa, Triticum aestivum
  unsure (1)..(77): unsure at all Xaa locations
  Clone ID: PAT_TA_85480.pep
DAQAARVXWAPRYXTSPPRXRSCRTPGXSXXANIXXQXXXFLGAPXGXRTFKXARPPVLXQXXLRAXIGTNPXXPXI

SEQ ID NO: 191063 - protein, 56 aa, Triticum aestivum
  Clone ID: PAT_TA_85481.pep
GLPSAHTQSLTMAPGVHHLLVLLLAFTAFNGSSAASRRLLDTAAAPETTTADQKKK

SEQ ID NO: 191064 - protein, 82 aa, Triticum aestivum
  unsure (1)..(82): unsure at all Xaa locations
  Clone ID: PAT_TA_85482.pep
PSRVTPRTQETTSEPKSSPLRRHGSLIXLXLPPPPHPEXAIHLQIKPLPPYPGLCRRRHRXPIXXXAPLXDXXDLGCXXRVL

SEQ ID NO: 191065 - protein, 51 aa, Triticum aestivum
  unsure (1)..(51): unsure at all Xaa locations
  Clone ID: PAT_TA_85483.pep
KEKAHISCSFTSYFRLFFLLGKVIWPVPLFXNAGRYPNFLISIPCHTXXTM

SEQ ID NO: 191066 - protein, 60 aa, Triticum aestivum
  unsure (1)..(60): unsure at all Xaa locations
  Clone ID: PAT_TA_85484.pep
ELVSSFFFFFFGRTYHILLQVTADAATAYCVGGYTRKTLGCNENPQLGXPFKFPENXWMP

SEQ ID NO: 191067 - protein, 132 aa, Triticum aestivum
  unsure (1)..(132): unsure at all Xaa locations
  Clone ID: PAT_TA_85485.pep
MARLNSKAVAAAVVLAAVVLMMAGREASAALSCGQVDSKLAPCVAYVTXGRASSISKECCSGVQGLNGLAXRSSPDRKDSCRCLKDLATXSIKSINMGKVSXGXPRXFGXSXXSPIXIXTNXXIXNNKNPPK

SEQ ID NO: 191068 - protein, 73 aa, Triticum aestivum
  unsure (1)..(73): unsure at all Xaa locations
  Clone ID: PAT_TA_85486.pep
MDAAALXDVIRQLLXARGGRTVRPXQLSDAEIXRLCXXANDVFLSXPXLLELXXPIKXXXDIHXXYSDHXRXL

SEQ ID NO: 191069 - protein, 80 aa, Triticum aestivum
  unsure (1)..(80): unsure at all Xaa locations
  Clone ID: PAT_TA_85487.pep
SRPPRRALDLDLRSRPPPSPSTTSSFLHRLSSLWRAPLHLSSSASPQHILLPPFPFFLSSFPCLXVFFPFXLGXERXXXK

SEQ ID NO: 191070 - protein, 149 aa, Triticum aestivum
  unsure (1)..(149): unsure at all Xaa locations
  Clone ID: PAT_TA_85488.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARQRRQFGXAVWFKGXVPSXLXEGRLQILXP

SEQ ID NO: 191071 - protein, 113 aa, Triticum aestivum
  Clone ID: PAT_TA_85489.pep
MGGGNAQKSKMARERNLEKLKGGKGSQLEANKKAMNIQCKICMQTFICTTSEAKCKEHAEAKHPKSESVQCFPHLKAMISAQSRQRESREREREAVHNPPYYLHVPRKLTDCL

SEQ ID NO: 191072 - protein, 73 aa, Triticum aestivum
  unsure (1)..(73): unsure at all Xaa locations
  Clone ID: PAT_TA_85490.pep
APPHPAGDRAMAAAASPPAAALEQLSKTKMFGGHNLRFRHQSAALGCPMTFSLFLPASXGSKLPLLXXVPGLX

SEQ ID NO: 191073 - protein, 69 aa, Triticum aestivum
  Clone ID: PAT_TA_85491.pep
MATAMMAAATTSCSPRRALLKPAASSSSAPPPRPQPRSFLKQLPGLAATAAAAAVASVPLPALAVEMEK

SEQ ID NO: 191074 - protein, 76 aa, Triticum aestivum
  unsure (1)..(76): unsure at all Xaa locations
  Clone ID: PAT_TA_85492.pep
IXXXHXVSXXHTSPIHMSFXYSPXXGISSRXXPLTXISQXPFLKPGVXSQXGKLPXXSPVXKFXFSXGAQXXEIFF

SEQ ID NO: 191075 - protein, 39 aa, Triticum aestivum
  unsure (1)..(39): unsure at all Xaa locations
  Clone ID: PAT_TA_85493.pep
FFFFFFFCHIFFLLFFXFYFKNRKGEIEFEHYRRGDYHI

SEQ ID NO: 191076 - protein, 65 aa, Triticum aestivum
  unsure (1)..(65): unsure at all Xaa locations
  Clone ID: PAT_TA_85494.pep
FLPLTPEPKPQELPMASTTFSSAFSILSLXSSSPSPSASAPRTLPVAXRRXXXVXMXXXQGPKGL

SEQ ID NO: 191077 - protein, 86 aa, Triticum aestivum
  unsure (1)..(86): unsure at all Xaa locations
  Clone ID: PAT_TA_85495.pep
FLLLFLPLTPEPKPQELPMASTTFSSAFSILSLPSSSPSPSASAPRTLPVANRRRRAVAVASTAXEXPKAFXXGXQLXGXLXXPTF

SEQ ID NO: 191078 - protein, 63 aa, Triticum aestivum
  unsure (1)..(63): unsure at all Xaa locations
  Clone ID: PAT_TA_85496.pep
GPPXGPXXPLPPTARTAMMAASTAKRAIWLLLVAENFTEIERGEETTGSECLGSGVESGEWRV

SEQ ID NO: 191079 - protein, 75 aa, Triticum aestivum
  unsure (1)..(75): unsure at all Xaa locations
  Clone ID: PAT_TA_85497.pep
AXYVXKVWKVRFXLEGKLEXGXIXRXVRKLFCHQQGXEXRWRAKDLXDKATXCXXKGXSSETIXNLWGNFEPITH

SEQ ID NO: 191080 - protein, 64 aa, Triticum aestivum
  Clone ID: PAT_TA_85498.pep
IMWPFIESKRGDWYDANLPNSSLHGLNGYQVFISIAMIMGDGLFNFFSILFRTSYDMYLKRTGR

SEQ ID NO: 191081 - protein, 97 aa, Triticum aestivum
  unsure (1)..(97): unsure at all Xaa locations
  Clone ID: PAT_TA_85499.pep
PNPTRAAAPRGSSATMSGRGKGGKGLGKGGAKRHRKVLRDNIQGITKPAIRRLARRGGXKRISGLIYEXTRGVLKIFLXNSSNSLHEKPPKSPRGFS

SEQ ID NO: 191082 - protein, 89 aa, Triticum aestivum
  unsure (1)..(89): unsure at all Xaa locations
  Clone ID: PAT_TA_85500.pep
EINLDISRTPPSDGPMDAPPSHQQGGGGGGMIPFYPSVARPAGVDIDHLLXASVPKMXAPPXGPGXGXFRXTCXXGXKKTPPFGPXGFN

SEQ ID NO: 191083 - protein, 79 aa, Triticum aestivum
  unsure (1)..(79): unsure at all Xaa locations
  Clone ID: PAT_TA_85501.pep
YPXXFXPFPPXRNXAAFRXSDXDXNLRSXIXAISXSGLPIAAAAAVCWLGFRRGSGSGDRGLGMGTREDWGFFRGGEAD

SEQ ID NO: 191084 - protein, 53 aa, Triticum aestivum
  unsure (1)..(53): unsure at all Xaa locations
  Clone ID: PAT_TA_85502.pep
TPGGIPXLCVHLDALLVDVVLEIHLGSRRGDQPRRLAEAEAASGRRKRRGGGL

SEQ ID NO: 191085 - protein, 91 aa, Triticum aestivum
  unsure (1)..(91): unsure at all Xaa locations
  Clone ID: PAT_TA_85503.pep
TNEVRAKSKFWYFLRKLKKVKKANGQMLAINEIFEKNPTTIKNYGIWLRYQSRXTGYHNXYRXYXXXTXKXGXXHXYXEMVTFCFPETISV

SEQ ID NO: 191086 - protein, 76 aa, Triticum aestivum
  unsure (1)..(76): unsure at all Xaa locations
  Clone ID: PAT_TA_85504.pep
STSSFLPLRIQVEQGKGVGATQARRQSQAHPPLPRKSSSEQGPLLGSNARCVLPDSHPSLLHRXCRRRLVXRQPXR

SEQ ID NO: 191087 - protein, 94 aa, Triticum aestivum
  unsure (1)..(94): unsure at all Xaa locations
  Clone ID: PAT_TA_85505.pep
MASMLCSYSVSMPAAARAPLLRSSASSYATSVGFATSQLAGLSLSLGLTXTAAVSLPAXNTIVARRICPFLXKXTNRANXVXFSNHKDQEAXFC

SEQ ID NO: 191088 - protein, 85 aa, Triticum aestivum
  unsure (1)..(85): unsure at all Xaa locations
  Clone ID: PAT_TA_85506.pep
MARRSGGGRSSRPAPRAAPVXNPPAPARPAPPPATTQSSGGGIMSGIGSTIAQXGMAFGTGXAMAXRAXXAVXGPXXIXHXFSLM

SEQ ID NO: 191089 - protein, 53 aa, Triticum aestivum
  unsure (1)..(53): unsure at all Xaa locations
  Clone ID: PAT_TA_85507.pep
MSAYCGKYKDELIXNAAXIGTPXXGILAADESTGXTIXKRFAXHQILKXXXEN

SEQ ID NO: 191090 - protein, 92 aa, Triticum aestivum
  unsure (1)..(92): unsure at all Xaa locations
  Clone ID: PAT_TA_85508.pep
MMMRVAPPADDSSGSGVPGWLEAXXXTCFFLACAXHXGSXXXEXNMFXXDCRAXRAAFXXYXXXXXHTSHRVXQIRXSXXTTGREWRTSQRC

SEQ ID NO: 191091 - protein, 59 aa, Triticum aestivum
  unsure (1)..(59): unsure at all Xaa locations
  Clone ID: PAT_TA_85509.pep
QHTTLSTPSNPSTXTPLSPPLPSSXXXNASSGXGIHXDCXLRFVELXXKRMHRXIXYRX

SEQ ID NO: 191092 - protein, 72 aa, Triticum aestivum
  unsure (1)..(72): unsure at all Xaa locations
  Clone ID: PAT_TA_85510.pep
NLSAKLEGDDLDAFKKNVESATKYLLSKLKDLQFFVGESMHDDGGVVFAYYKEGAADPTFLYFAXGLKXVXC

SEQ ID NO: 191093 - protein, 55 aa, Triticum aestivum
  unsure (1)..(55): unsure at all Xaa locations
  Clone ID: PAT_TA_85511.pep
MXXERXCVCSGXWLKEXMIXRXPDAXPIXFPDLPLMPHPXAXXSSXPPSTLAXSS

SEQ ID NO: 191094 - protein, 50 aa, Triticum aestivum
  unsure (1)..(50): unsure at all Xaa locations
  Clone ID: PAT_TA_85512.pep
KXXKFARXFPXPXFRXXCPXRPXRFPPSFACVRTRVGEERRAEEEEGRCL

SEQ ID NO: 191095 - protein, 68 aa, Triticum aestivum
  Clone ID: PAT_TA_85513.pep
TGGFNILIYTRHGTILPLVTKFIIQQGENIGTSCNRQLPRGGPEGRLNESMLGESTLTITSSPTDSSL

SEQ ID NO: 191096 - protein, 47 aa, Triticum aestivum
  Clone ID: PAT_TA_85514.pep
EAARYEGVRGFYRGITSNLLKNLPAASVTFVVYENVIKLFRAAKEKT

SEQ ID NO: 191097 - protein, 45 aa, Triticum aestivum
  unsure (1)..(45): unsure at all Xaa locations
  Clone ID: PAT_TA_85515.pep
FLXVFXFWRSVSQILRVRANESIYYIEKARVIKDIGGLAQQLAKR

SEQ ID NO: 191098 - protein, 68 aa, Triticum aestivum
  Clone ID: PAT_TA_85516.pep
FFFFAFNQKLYCFHQRERYFQSQLHTVLIQIKDLFAKKEKNATVKWRVCFKTKSNCFHASNFANSNVT

SEQ ID NO: 191099 - protein, 63 aa, Triticum aestivum
  unsure (1)..(63): unsure at all Xaa locations
  Clone ID: PAT_TA_85517.pep
LXYLSLSNXXLXGXIPTSIXHMQDXILYMXXRNDPYSPAXSPXELGMXTKDRRHLRRGXTRSP

SEQ ID NO: 191100 - protein, 153 aa, Triticum aestivum
  unsure (1)..(153): unsure at all Xaa locations
  Clone ID: PAT_TA_85518.pep
RAAMSSNGKPNPQPPAAAAATNGAGAGGPPKMYQRPIYRPQGPAKGRRGGRSSCRFSCCCCFFWAVLVVLLLALVAAVAGGGXLLLYRPHRPASPLVARVNNSALXSATGRVTIHRLPNAKNQQSLLYTTHVTPGASVPREARPGLQRQHTRI

SEQ ID NO: 191101 - protein, 146 aa, Triticum aestivum
  unsure (1)..(146): unsure at all Xaa locations
  Clone ID: PAT_TA_85519.pep
PLVLLLLTFLLLLLVLCPWCCSSFPRPCCCSLPLCCSSLNPLLLLLHFLCSPSSSLNLAAAAPPLKTAAAPSXTFLAAVPSLFSXKLLLSXSXFACCDTFLKLXQLXXVLYSTVLSYAXXXXVIFXYXYIXLKRXSELKLXXLKLX

SEQ ID NO: 191102 - protein, 130 aa, Triticum aestivum
  unsure (1)..(130): unsure at all Xaa locations
  Clone ID: PAT_TA_85520.pep
FCEGFSSYGPFWDHCLEYWKESLARPNNVLFLKYEEIKSDPXKFVRRLXKFLXVPLSRKEERSGXAQXVVRLXSFEMLTTLXVNQMGGIDRGNKCYVGNCFLKKKIGTGGTHEMGEKLDARPKERRLLIT

SEQ ID NO: 191103 - protein, 76 aa, Triticum aestivum
  unsure (1)..(76): unsure at all Xaa locations
  Clone ID: PAT_TA_85521.pep
PPXKXGGGEIXNFGXXFPRSPXLXXAXGVSNPQVPXGXXLXLPEIQRRRHRLVSAASFPFLSSRPRRRRRGAARAG

SEQ ID NO: 191104 - protein, 88 aa, Triticum aestivum
  unsure (1)..(88): unsure at all Xaa locations
  Clone ID: PAT_TA_85522.pep
MTEVCVKAAVGHPDTLGDCPFSQRVLLTLEEKKVPYQMKLIDVSNKPDWFLKINPEGKVPVYNGGDGKWIADSDVITQXIEENYPIIT

SEQ ID NO: 191105 - protein, 98 aa, Triticum aestivum
  unsure (1)..(98): unsure at all Xaa locations
  Clone ID: PAT_TA_85523.pep
MASTTFSSAFSILSLASSSPSPSAXGXRTLPVXNRRRXAVAVASTATESXNVLELGDAIAGLXLEEVATLXXYLXERXGVXAAPXSRSAGXGPGGGGR

SEQ ID NO: 191106 - protein, 62 aa, Triticum aestivum
  Clone ID: PAT_TA_85524.pep
GGGGGRLCGVGGHGLAAGEAPARRNAREGEQQQDGDDGLVFLYWKINLENTSVINCFLLLDT

SEQ ID NO: 191107 - protein, 98 aa, Triticum aestivum
  unsure (1)..(98): unsure at all Xaa locations
  Clone ID: PAT_TA_85525.pep
XQPKXEDGXLHXXRQRTMXQIPRQRRSKSLSNLAQASTFKKEATHDASLLTSLRKIRDFSRDCSGGERAQTSTTPPRRGTTPTDVDVVVAREHQPKDF

SEQ ID NO: 191108 - protein, 85 aa, Triticum aestivum
  unsure (1)..(85): unsure at all Xaa locations
  Clone ID: PAT_TA_85526.pep
MANPRVFFDMTVGGAPAGRIVMELYKDAVPRTVENFRALCTGEKGXGKSGXPLHXXGXXFHXXXXXFMCQGGXFXRGXXAXEAHG

SEQ ID NO: 191109 - protein, 102 aa, Triticum aestivum
  unsure (1)..(102): unsure at all Xaa locations
  Clone ID: PAT_TA_85527.pep
PSSRRNASYHNIFFTSFSTPKPYPVPLSQLLPSSVSPFLLAIHNXTSSQKPASPRGGELRLLDLTRRDAXAXXSLXAXLAXXXVXXSSGDAALRGLGAKGGS

SEQ ID NO: 191110 - protein, 75 aa, Triticum aestivum
  unsure (1)..(75): unsure at all Xaa locations
  Clone ID: PAT_TA_85528.pep
FQASDGVLSLGNSNISFAARAAARFGGRFSYCLVDHLAPRNTSSYLTFGPDAXNGASSXRTPLLLALVAPFVTVD

SEQ ID NO: 191111 - protein, 88 aa, Triticum aestivum
  unsure (1)..(88): unsure at all Xaa locations
  Clone ID: PAT_TA_85529.pep
PPSXGTNPRFXLSGXSQVPWXPCSKGAXXSLLCIKLVVCLXFLGXSXGAGXTSASMLSVFHXHFCXRPXTPAPXFAXNNLQXSLGDDS

SEQ ID NO: 191112 - protein, 92 aa, Triticum aestivum
  unsure (1)..(92): unsure at all Xaa locations
  Clone ID: PAT_TA_85530.pep
PNKKXAGXXXHGXQXRXVGGHVSLVHVLWPVVLVLVVNALTLHGVEVDGDEPHAVVCTKHDRPLRHRDNLLQHVDVQLTFTLNLTDQLLQLD

SEQ ID NO: 191113 - protein, 80 aa, Triticum aestivum
  unsure (1)..(80): unsure at all Xaa locations
  Clone ID: PAT_TA_85531.pep
MAALAPTKMLGTRLNFAGSSRYATAAPTAGAQXIVSLFDRFKKKPAPKPKPAPVATSSVGIDDXLAKWYGPDRRIYLXNG

SEQ ID NO: 191114 - protein, 63 aa, Triticum aestivum
  unsure (1)..(63): unsure at all Xaa locations
  Clone ID: PAT_TA_85532.pep
MSQEXVNPKXYPLADXQMTITILELXRQVANYXHVXKGAXXATKTLXXGIXXFVVMAADTXPL

SEQ ID NO: 191115 - protein, 137 aa, Triticum aestivum
  unsure (1)..(137): unsure at all Xaa locations
  Clone ID: PAT_TA_85533.pep
MSRGGSAGGGQSSLGYLFGDGEPAKPAAAPAAKPAPAEKPAPAAADVAKQIPAGIPGSRANNYYRADGQNTGNFLTDRPSTKXHAAPGGGRPGHCLAECMMVCLMNDDNWLYYVKWMLVTLQPSEGHSTLGTLPNCP

SEQ ID NO: 191116 - protein, 142 aa, Triticum aestivum
  unsure (1)..(142): unsure at all Xaa locations
  Clone ID: PAT_TA_85534.pep
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIKRSSNEVTALRXXRHXGXIVNAGGMLTLTLHPSHWEKHLGTRCRRRETRR

SEQ ID NO: 191117 - protein, 97 aa, Triticum aestivum
  Clone ID: PAT_TA_85535.pep
HKPAHTPVFSELPTQVDLSAGNLVPVQVLERKMVKKGNAAHVQIRVQWSGLPEAAATWEDYEVLKKRYPAAPAWGHAGFPAGGTVSDQEHMGGEARE

SEQ ID NO: 191118 - protein, 107 aa, Triticum aestivum
  unsure (1)..(107): unsure at all Xaa locations
  Clone ID: PAT_TA_85536.pep
PLPLIQSRLRRTTPTSLRLHTDAAPSPPRSLVPLGAVPTASPLARLPVALRRPPPPGTPPXPCRXTSSXTLEPRSQTPPSTTTPNTPGVPTTMXRPLXXTRXILGGS

SEQ ID NO: 191119 - protein, 65 aa, Triticum aestivum
  unsure (1)..(65): unsure at all Xaa locations
  Clone ID: PAT_TA_85537.pep
TPATKAYHNPLAPPSPRRPDPXWRSSLIHLPHLRCGPGATLQVLHPDXRGPSLXSPSXLGLRXPV

SEQ ID NO: 191120 - protein, 102 aa, Triticum aestivum
  unsure (1)..(102): unsure at all Xaa locations
  Clone ID: PAT_TA_85538.pep
LLPLFRNSCRWEFLVQFPSRYDISVISETTLPLPLSLSSXTRSLAPESLSHXSRRLSXARVPXASXPHAAPRPLPLASXPPCXVAYAXASPFAGXNFTXXVG

SEQ ID NO: 191121 - protein, 68 aa, Triticum aestivum
  unsure (1)..(68): unsure at all Xaa locations
  Clone ID: PAT_TA_85539.pep
VSRIGXPAPXSRPARGRTGPSAGDGASSPLPPAAYLXVAPTTYNTYLLTXCSNXQASKERKTMDIYVA

SEQ ID NO: 191122 - protein, 36 aa, Triticum aestivum
  unsure (1)..(36): unsure at all Xaa locations
  Clone ID: PAT_TA_85540.pep
FFXXXNRXYFXIRLHXKMPXXXIRVLLCYLNXPFAX

SEQ ID NO: 191123 - protein, 75 aa, Triticum aestivum
  unsure (1)..(75): unsure at all Xaa locations
  Clone ID: PAT_TA_85541.pep
GFGLGRAPPARRGSACAAKLPPPPPCSRSCXMLNCXSVGIRYGKFXXXGWXXXKGXPYDDXXXXCXEXXSCLKKX
